United States Patent 10,463,711 (NUTRITIVE POLYPEPTIDES AND FORMULATIONS THEREOF, AND METHODS OF PRODUCTION AND USE THEREOF) - sequence listing, part 2

SEQ ID NO: 3067 - protein, 579 aa, Agaricus bisporus
  var. bisporus
  strain H97 / ATCC MYA-4626 / FGSC 10389
MAQVIVVGGGLAGLSAAHTVLERGGNVLVLDKQPFMGGNSTKATSGINGAGTQPQQDAGIADSARIFFEDTKKSARELARDDLIQVLTGRSADAVHWLQSKFGLDLTKVARLGGHSQPRTHRGGAQFPGMVITYAQLERLEDLSVSDPERVKVIKKARVTKLVKDSSGAVVGVEYECGGKTETAYGPVILATGGYAADFTGDSLLKKYRPEYYELPTTNGEHSTGDGHKLALSIGASAIDLEKVQVHPTGLVDPKEPDAKVKFLAAEALRGVGGLLLDNTGKRFVDELQHRDYVTGKMWENGKYPIRLVLNGKASKDIEWHCKHYVGRGLMKRFDSGEALAKEFGLAPEVLRKTFEDYNVSVRTQKDPFGKKFFQGEWKFDDFFHVAVMTPVLHYTMGGLEIDAESRIIDQSGKPIPGLFAAGEVAGGVHGANRLGGSSLLGCVVFGRVSGDSASAYLLQATSAAVQKAGGRLGALAGHISGSTAASTPDSAAAAPVGKSASGEYTLADVAKHNKKDDIWVVIDGQVLDVTKFLPDHPGGEKAIILYAGRDATEEFNMLHDPKVIPRYAPDAVIGKVKA

SEQ ID NO: 3068 - protein, 895 aa, Agaricus bisporus
  var. bisporus
  strain H97 / ATCC MYA-4626 / FGSC 10389
MATLTTPGAPDEYRLPTNVKPAHYDVTIKTDLENLSFEGFVRIELDVKEPTSRIVLNTSGLDLGQATLYSDSLKKELAPSEQTLDTASERVAYSVNDTLPAGSKAFLKVSFKGELTGSMMGYYKSTYEEDGKPKYYALTQFEPTAARRAFPCWDEPLLKATFGITLISRADTTNLSNMPAISEEAVTPNTDFGGDASLFSGLKDGQWKVTKFQTTPPMSSYIVAFANGYFKYLEDSVVLPLSGKTLPLRIYTTAEYIHQAQFALDIKKAVLPIYEKIFDVGYPLPKLDTLVASDFDAGAMENWGLITGRTNAFLLDPKKADLQAKKQIAATQSHEVAHMWFGNITTMEWWNYLYLNEGFATLMGEVIIAGEVFPEWKVDSNFISEHLNRALGLDAKPSSHPIEVDCPDANHINQIFDSLSYSKAASVLRMLSNYVGEDRFLKGVSIYLKNKLYGNSVTNDLWEGISQATGIDVPKIMDTWIKKIGFPVITVTETPEGIRVRQDRFLETGKGEGADNETIWNVPLRILSIDSNGKPVLDNSALLTEREQTFKIDSSKPFKLNTGTSGVYRVLYEPKTLAKIGEEAAKDGSVFSLNDRLGLVYDSVALSKAGLAQVSSALTLMDILGKTEKEYLVWSGIADNLSALVSTWWENQDVVDQLNAVRGALFVPLVKKLGFDYSSSDSVDTTLLRTLAVSQAAAAGDPSVIKELQSRFEHFMKTGDDSRIPADLQRATFSTVVRRGGRAEYNAIVGIYDKPSTPTARVAAIVAMGATHDVKLLQETYSFIKNKSRDQDIVYFFRGLSDNIKMRRGMVAYFENEYDTLIERFGGNFTLQYLVTLSFSFLSTNEDLKKTEEFFKGRDTSKYSMALAQSLDSIRARVQFIERSTSDLEKWLKER

SEQ ID NO: 3069 - protein, 1199 aa, Agaricus bisporus
  var. bisporus
  strain H97 / ATCC MYA-4626 / FGSC 10389
MYGLSNRTSAWRALRSHVIPFTSASRLNSTKPPRSAWQQALTPSSPVLVQENFPKHFIFALDIGRRFLKYSIFGLTILAVSAGGAYEAAHMFVEKNGLAPESDEEVKRWQWESDADKWTGDSVNGGTDPNLGFKVRHLVRAAWMAYTWGIGYTTAAIGSSDQRGSGLVGPMGIKVINPRLQLTEDFLREAIRVAESSQDGRHSHTLAHLWTLHASILEKLGDDFLPEAKAELERAAASLDGDKRLNSARLALKLGDIDARLGLKEQALERWTRTLALLNDKQPEVASIAGELVPERPPSSPLAQRLLSSTLVSLSAFYARTGQYREAQLVEERALSVLRAIHPPDSLATASPPQALHALFLLQRSSVISVHLAEVAFAQRRPAVFSMQWLTSAAESSERVARVLTGLPLVKSQDFHSKSDLPHPLEERLLTSYSSSRSMKGVAEGLLRDARRTAAESWNLMGALHEKKEGARSRSALACYERAVEWAGCPSSDGDNGREAAQGIPDADWKMVWSNYQRMKLQVEGRCSYRGVVLNLSFIDTRFLADRSTPLCSLEVAKSFALLSSNEKKYTHYLNQASWAGARIIQGQWTPHAIELYDLLILIFSSSDKFKLADLEALRVASKVNTEDWENLLQYTIQVLSNLVNFKSFGFTKIIPRVNSEIFEAVVLNSANKEQAASLWNKLKDHIYSTTPEASLYIGKRSLGHVSNYYVGEVINDEEVTAIQAAAEKLNIDVLNTRVAKKGPGDYVLLIASANTGPSATHEIDVQGKTAQLRVEYAAHNTRFETGSIQDHKDASKEWVKDVGPVVESYIGFIETYVDPYGGRAEWEGFTAIVNKELSAKYEILVNKAPELIKVLPWGKNFEVDIFRKPDFTALEVVNFATGGIPAGINIPNYYDIRASTGFKNVSLANILAAKSPNEKLTFIHPDDVDLYNSWDNRSFELQVANHELLGHGSGKLFEEYADGTKNFVPEQVINPLTGKPITSWYKPGQTPGSVLGEVSSSMEECRAETVALYLVGERDILEIFGYTDSQDIENIQYITFLLMARAGLRGLEFYDPVNKKHGQAHMQARLGITQHLIRSGIARLEEVRDANGALVDLYVRVDKNLVLTKGREVAGKLLIELQVRKSTADGAGAREYYNNLTNPIAGWEGEIRDLVLAKKQPRKVFVQPNTHLVNGNVELKEYAFTPAGVIESFIERNL

SEQ ID NO: 3070 - protein, 312 aa, Agaricus bisporus
  var. bisporus
  strain H97 / ATCC MYA-4626 / FGSC 10389
MGATRADKQVYFEKLKELLYAYPSVFIVNVDNVGSNQMHQIRVALRGKGVVLMGKNTMVRRALRTLIPESPQFERLLPHVRGNVGFVFTKSDLKEIRDIIVANKVAAPARAGAFAPKDVIVPAGNTGMEPGKTSFFQALGIPTKIARGTIEIVSDVKVVTALTRVGPSEATLLNMLNISPFTYGMTVNQIYDSGNIFSPEVLDIGEDELVNRFLTGIKTIASISLALNYPTVVSVAHSLVNAYKNLVAVSLATEYTFEGAAKIKEYLENPDAFAAVAAAAAPAAAAEAPKEEEKKEEEEEASDDDMGFGLFD

SEQ ID NO: 3071 - protein, 310 aa, Agaricus bisporus
  var. bisporus
  strain H97 / ATCC MYA-4626 / FGSC 10389
MPFVKKVKSDAYFSRFQVKYRRRREGKTDYSQDYARKRLVTQAKNKYNAPKYRLVVRFTNKDIIVQIVYARLQGDFVLTSARSAELPRYGIKHGLTNWAAAYATGLLAARRALTKLSLADQYEGVAEPDGTLSITEAIEEEDAPRPFKAFLDVGLKRTSTGSRVFGALKGASDGGIYIPHNEKRFPGYDPESKELDAEVLKKYIFGGHVAEYMESLEEEDDERFKKQFSKYLADGVGSEDIEEIYTNAHAAIRENPEFKPSEKTKDWKAECLKFKAKRFTLEERRARIAEKIEKFKAGGLEEEDAGEDDD

SEQ ID NO: 3072 - protein, 338 aa, Agaricus bisporus
  var. bisporus
  strain H97 / ATCC MYA-4626 / FGSC 10389
MVKVGINGFGRIGRIVLRNALQFQDIEVVAVNDPFIDLEYMAYMFKYDSVHGRFKGTVEVKNGSLVVDGRPMKVFAERDPAAIPWGSVGADYVVESTGVFTTIDKASAHLKGGAKKVVISAPSADAPMYVCGVNLDKYNPKDTIISNASCTTNCLATLAKVIHDNFGIVEGLMTTVHATTATQKTVDGPSHKDWRGGRGVGNNIIPSSTGAAKAVGKVIPSLNGKLTGLSMRVPTQDVSVVDLVVRLEKPASYEQIKEVMRKAAEGEYKGIIAYTDEDVVSTDFISDNNSCVFDAKAGIQLSPNFVKLIAWYDNEWGYSRRVCNLLQYVAKEDAKAGI

SEQ ID NO: 3073 - protein, 375 aa, Agaricus bisporus
  var. bisporus
  strain H97 / ATCC MYA-4626 / FGSC 10389
MEEEVAALVIDNGSGMCKAGCACDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAFYVAIQAVLSLYASGRTTGIVLDSGDGVTHTVPIYEGFALPHAILRLDLAGRDLTDFLIKNLMERGYPFTTTAEREIVRDIKEKLCYVALDFEQELQTAAQSSALEKSYELPDGQVITIGNERFRAPEALFQPAFLGLEAAGIHETTYNSIFKCDLDIRRDLYGNVVLSGGTTMFPGIADRMQKELTSLSPSSMKVKIVAPPERKYSVWIGGSILASLSTFQNLWCSKQEYDESGPGIVHRKCF

SEQ ID NO: 3074 - protein, 457 aa, Agaricus bisporus
  var. bisporus
  strain H97 / ATCC MYA-4626 / FGSC 10389
MVLPHEPEFEQALHELETSLQPFLTTNPQYKKALEIIQVPERVLQFRVTWEDDQGKPQVNRGFRVQYNSALGPYKGGLRLHPTVNLSILKFLGFEQTFKNALTGLSMGGGKGGSDFDPKGKSDNEIRRFCVAFMSELFRHIGQDTDVPAGDIGTGAREIGFLFGAYRRLKNEFTGMLTGKGINWGGSFIRPEATGYGLIYYVEHMIAHACPEYSLDRPSTLVAISGSGNVSQFTALKVIELGATVLSLSDSKGSLISEKGYTKEAIEKIAELKLKGGALEAIVDDLGAGYTYHAGKRPWTLLPQVHIALPGATQNEVSQEEAEALVKAGTRIVAEGSNMGCTEEAIAIFENSRRASRAGVWYAPGKASNCGGVAVSGLEMAQNSQRLAWSTQEVDAKLKSIMAECYQICYTAGSRWSGEKVAEGVAEGEALPSLLSGANVAGFIKVADAMKEQGDWW

SEQ ID NO: 3075 - protein, 474 aa, Agaricus bisporus
  var. bisporus
  strain H97 / ATCC MYA-4626 / FGSC 10389
MSQLRVSGTKIVNEAGSETVLRGAGLGGWMNMENFISGYPGCEYQIREALTDTIGQEKADLFFDKFLEYFFQEQDAKFFQSLGLNCIRIAFNYRHFEDDMNPMVLKESGFKHLDRVIDICAQHGIYTILDLHVAPGGQNTDWHSDHGGHIANFWNHRHFQDRALWLWTELAKHYKGNKWIAGYNPLNEPTDSKHTRVIKFYDEVHAAIRAQDPDHIIFFDGNTFASDFSHFGDSHKNWDNTAYSIHDYSVFGFPAAPENYTGTPEQQRRLRRSYEKKREWMDERGLCVWNGEWGPVYARKQYDGAATDSINEGRYKVLSDQLDIYTKDRLSWSIWLYKDIGFQGMVHTSLDTPYMQLFKDFLAKKHRLATDAWGADDSAVRSAYQPLIELITKEVGDQYRQIYPAPVWKFTDRVGRLSRNILVAEFLVKEWADHFVGKSEAEIDAIAASFKFENCLKRDGLNAILTANAKLVKQ

SEQ ID NO: 3076 - protein, 1029 aa, Agaricus bisporus
  var. bisporus
  strain H97 / ATCC MYA-4626 / FGSC 10389
MSTPEPAYVARLGLNSKTPLNLVKNMPGYTTPVFKGKEEQRALVEEEVASKGFIPRELVAGEVNWFYSNLGIDDTYFQNESHEVISDHILALFGAKIMAYTKHDPSTLVIDLERIDERGNSATFIHSSAPGLTSTEGPGATCEARIDELFLDPSTPEKAYRLETFRSAGSISATASQQLRCYFVTKCDFPKTKAEIVPGQTEIRSVSDSNFLERATKNTLDIYQKVMSNVETRHGPVIEVYEVEGTRKRRLVIGYKMGATSRFFSALSNLYHFYSLYSTGKYVEQFANGITIISIYLNPLPNSSAPPIENSIYQVMKEASLLFCLPDNPFFLPKSAESHAVQEATYAYCGWVFAQHFCNRLGPAYLQLKNVLNESDPTHAEVLNNIKRRFREETFTRESIAQAIHAYPNLIRLLYVNFAMSHYPQSAEASKLGPTLSYQRLQTVQPLSDEELYDKIRRSVPNKQELQVLESFLIFNKHVLKTNFYQSTKVALSFRLTPEFLPEVEYPKTPFGVFFVIGNEFRGFHIRFRDVARGGIRLVMSRNRENYSINQRMLFDENYNLASTQSLKNKDIPEGGAKGTILPSLGAHPRRCFEKYVDAIIDLLIPGQTPGIKEPLVDLFGKPEILFFGPDEGTAEMMDWAALHARDRGAETWWKSFTTGKTAATLGGVPHDTYGMTSRSIRQYVLGIYSKLGLREKDITKVQTGGPDGDLGSNEILLSSDKTVAIIDGSGVLHDPVGINRAELIKLAKARLTVGHFDVSKLSENGYLVKVEQHDVKLPSGEIVLDGTDFRNTAHLRFKADLFVPCGGRPESVNISNMNALIDEDGKPYFKYVVEGANLFFTQQARLHLEKRKVVLFKDSSTNKGGVTSSSLEVLAGLALSTEEYTNLMIFKDGKPSTFYQNYVKDIQAIIVDNAAAEFQCLWKEHTRLGETKPRTQISDELSSTLNSLQAELEGSDLFDDEPSRRGVMRRAIPKTLVDEIGLDTLLKRLPDAYQRALFSSYVAAHFIYKYGVNASSVDFFHFAKDLAK

SEQ ID NO: 3077 - protein, 200 aa, Agaricus bisporus
  var. bisporus
  strain H97 / ATCC MYA-4626 / FGSC 10389
MATFSSTPIVIDGKGHLLGRLASIISKQILSGQKIVVVRCEEINVSGSFFRNKLRYHNFLHKRHIVNPKKSGPFHHRAPSKILYRAIRGMVPHKTPRGAAALERLKLFEGVPPPYDKKKRMVVPEALRVLRLKPGRKYCTVKRLSHEVGWGYKDVVDRLEDKRKLKAQAFHERKVAALKLRQKAVSDATPSFQQLAQLGY

SEQ ID NO: 3078 - protein, 250 aa, Agaricus bisporus
  var. bisporus
  strain H97 / ATCC MYA-4626 / FGSC 10389
MAPSTTVPSASAIEVPETLLKKRKQNEKAREERLAAAAAARKAQKAKRKVIFKRAESYVKEYLSKEKEEIRLKRAARASGDFYVPAQPKVYFVIRIRGINEIAPKPRKILQLLRLLQINNGIFVKVTRATQQMLRLIEPYVAYGEPNLKSIRELIYKRGYGKVNKQRIPLTNNGVIEESLGKFDILCVEDLVHEIATAGPNFKQASNFLWPFKLSNPTGGWRTRKFKHYVQGGDFGDRETSINKLIRQMN

SEQ ID NO: 3079 - protein, 371 aa, Agaricus bisporus
  var. bisporus
  strain H97 / ATCC MYA-4626 / FGSC 10389
MASRPTVSVHSSTGEASSSLPLPAVLTAPIRLDVVQQVHKSIAKNRRQAYAVAENAGHQTSAESWGTGRAVARIPRVGGGGTHRSGQAAFGNMCRGGRMFAPTKTWRRWHVRVNQNQRRFAVVSALAASALPSLVLARGHRIEEIQEVPLVIAADAESFTKTKEAVALLKTLKAYSDVVKVSNSRKLRAGVGKLRNRRHRQRRGPLVVYNEDKGIVKAFRNIPGVELINVRRLNLLQLAPGGHLGRFVIWTEGAFKALDDVFGTFDKASSYKKDYLLPTAKISNPDVTRLINSDEIQSVVRPANPKISKRPWTQKKNPLVNKAILFRLNPYAKTLRRQEILKQERLKKKNAKKPKQPKAAGKQFLDNLFAL

SEQ ID NO: 3080 - protein, 393 aa, Agaricus bisporus
  var. bisporus
  strain H97 / ATCC MYA-4626 / FGSC 10389
MATAATAGVIVPHLKTLADLSPAQIVGILARAHTLKKHGAAYLSPIGWPPREFISHRRPGPTLRNKSIALLFSKRSTRTRLAAETSATFLGGNAIFLGRDDIQLGVNESLRDSARVIGGMCAGIFARVDDHSEIEELAKYSPVPVLNALSSLWHPTQVLADLLTLHEKHRLFEKPLELARETPGIPPLSPLTVAYVGDSANVLHDMLVTYPRMGHKLRIASPEKYRAPSEVWDRVVQLGCDKDIVWTADPKEAVHNADVVVTDTWISMGQEAEKEERLQAFQGYQVTEALCKEGGAKENWKFLHCLPRKSHEVDDEVFYGPRSLVFDAADNRMWTIMALFDLLFARWSLSPERITAIQQAHNARTTTMQGKGQKSPLKPLIDILAVKTPNPSE

SEQ ID NO: 3081 - protein, 416 aa, Agaricus bisporus
  var. bisporus
  strain H97 / ATCC MYA-4626 / FGSC 10389
MAPIGSLYTVDAQSKGKMIRSVVALAGQEVELLPFEFGVTNKSSEFLSKFPLGKIPAYQHSNGFKLYEGNAIARYLAGLYPNTGLLGGTPEEAALVDQWMHVVETEADTYDTWISFLVRGLVPYNKPIELNFYERLERCLAVLESHISTRTFFVGERITLADLSVASVLSKAVAQTVDASRRPKYPNLMRHLDTIANQPKLKAVFGQVNYIDKAIQYTPPAKEKKEKAPAPPKAEKKPKQEEADEEEEPAVPAEPKVKNPLDDLPKSTFNLEDWKRAYSNKDTRGADGAIEWFYQNFDSTGFSVWRVDFKYNEELTLTFMSSNQITGYFNRLEASRKYLFGSVGVLGENNNSIISGTLILRGQDAEPVVNVAPDWESYEYKKLDLSKEEDKQFFEAALAWDLEVSGKKWADGKNFK

SEQ ID NO: 3082 - protein, 504 aa, Agaricus bisporus
  var. bisporus
  strain H97 / ATCC MYA-4626 / FGSC 10389
MSSSLMPRSDSYNARVRGASHIDFKTATTGVAAKAMRNELSGIVSTISDPPSRKAFDTEMQSFFYLFTRYLAERAKAVDLDWDCIKSPADDKIVPYAQLPKPKDVSNLNKLAVLKVNGGLGTSMGMTGAKSALEVKDDMTFLDLTVRQIEHLNTSSRVDVPLILMTSFNTHEDTLRIIKKYANQQLRITTFNQSRYPRIYKESLLPCPQRADDDKKHWYPPGHGDLYNALLHSGVLDQLLSEGKEYLFVSNSDNLGAVVDESILQHMIDTQAEFIMEVTDKTKADIKGGTLIDYEGSIRLLEIAQVPSEHVEDFKSVRKFKIFNTNNLWINLKALKRIMEVEGMELDIIINPKTTDDGHAVIQLETAAGAAIKHFKNAHGINVPRKRFLPVKSCSDLLLIKSDIYSLSHGQLVINENRMFETTPVIKLGDHFKKIQQFQRRFKKIPRIIELDHLTVTGDVYFGRNVTLRGTVIIVANEGQRIDIPDGCILENRLLSGNLSMIEL

SEQ ID NO: 3083 - protein, 546 aa, Agaricus bisporus
  var. bisporus
  strain H97 / ATCC MYA-4626 / FGSC 10389
MATAQLATFKIPPVSNEPMLSYAPGSPERAGLQAALAEMQSQLPFEVPCIINGQEVRTNNIQKQPMPHDHARHLCTFHEGSPELVEKAIAGALQAKDAWETMPWNDRAAIFLKAADLASGKYRYKLMAATMLGQGKNTWQAEIDAAAELADFFRFGVSYVEELYAQQPPKNAPGCWNRTEYRPLEGFVLAVSPFNFTAIGGNLPGSPALVGNVVVWKPAPAATYSNYLVFKILAEAGVPPGVIQFIPGGAEIVQAAIQSPNFASLHFTGSTNVFKSLWKDISSNLDKYKVYPRIVGETGGKNWHVIHKSAEVRNAVLQSVRGAFEYQGQKCSALSRLYVSRSVWENGFKTQYLEEIAKIKVGPCLDWNNYMGPVIGRRAYDNITGFIKKAKEEGGEVLIGGSGDDSKGFFIQPTVILTKDPRSTTMVGEIFGPVVTAYVFEDSDYEKTLELIDTTSIYGLTGAIFASERQALLTATNRLRNAAGNIYYNEKCTGAVVGQQPFGGARGSGTNDKAGSISIFYRFVSARSIKENFVGLEDFHYPSNLV

SEQ ID NO: 3084 - protein, 546 aa, Agaricus bisporus
  var. bisporus
  strain H97 / ATCC MYA-4626 / FGSC 10389
MKILHSTSLSSSTIMYPVDGIRSQIEWNTTLNVSDAPVPTETTKYHRKTAIIATIGPKINTVEKLTELRHAGVNIVRMNFSHGTHEYHQSVIDNTRQMIKNDPHGRPVAIALDTKGPEIRTGQTRDGNDYPIKAGDEFIVTTDPKYSDICDNKVLFVDYANLASVTAPGKLIYIDDGIISLLILSIDGMNLHVRALNNGTLSSRKGVNLPKTDVDLPPLSEKDKDDLRFGIRNGVDMIFASFIRRGEDVRQIREVLGPDGASIKIIVKIENEQGVANFDEILKEADGVMVARGDLGIEIPASQVFLAQKMMIAKCNIVGKPVIVATQMLESMTYNPRPTRAEVSDVANAVLDGSDCVMLSGETAKGSYPVQSVLMMAETCLLAETAICYPPLYDDLRAVQARPTETAETVAIAAVAAAAEQDAKALLVLSTSGETARLVSKYRPKIPIITVTRNEQTARQIHLHRGCYPFWYPEPRGVQNHQWQTDVDNRIRFGLRNALALNVIQPGASIIAVQGWKGGLGHTNTLRILTVPTDPADLELQPLGSL

SEQ ID NO: 3085 - protein, 576 aa, Agaricus bisporus
  var. bisporus
  strain H97 / ATCC MYA-4626 / FGSC 10389
MSDPISLIPIVGIPGEVKNRLDILDFVKDEKFFTLYVRALKILQDRDQSDYSSFFQLGAIHGVPHTEWAKARPQLNPFPGGYCTHGNVLFPTWHRAYESAWEQILWQAAGTVAEKFTTPNKEEWLQAARDLRQPYWDWGYWPNDPDFLSLPDEVVRHEEVEITDFDGTRIKVENPIRRYKFHPIDPSFEGDFAQWPTSVRYPNAQKQENTEGMIAGMKAAAPGIRERTFNTLTKNYTWEHFSNHGAIYGTNANSLEMVHNTMHLLMGRDPTLDPLITGHMGSVPHGAYEPVFWMHHCNCDRLFALWQAMNYDVYVSEGMSYEATINYLPGQVLSEDSPLEPFYTKNQDPWQSDDLENWEVLGFSYPDFDAVKGKSKEERRKYISDLVRRRYGFVTTQTENPALRLLSSFQSAQSGHETQYALYDWVIHAKFRYYEINESFSIIFYFDEGEGCTLNSIIGTVDAFRGTTSETCSNCARNQELIAEGFVHLNYYIGNDIGKHVDRKADAVPIYEPAKVTEYLKKRKISCKVLSTGAKLPSLTVEIKGSPYYLPAGETRPQVDKEKPTVVLNDIIRVIT

SEQ ID NO: 3086 - protein, 765 aa, Agaricus bisporus
  var. bisporus
  strain H97 / ATCC MYA-4626 / FGSC 10389
MVLSSVLGFPRIGANREIKKAVEAYWAGKTSAEDLQKVAAEVRKTSWTSVKNHRVDFVPSGEFSLYDHVLDHSAAFNVIPQRYVGLGLTPLDVYFAMGRGRQSEGVDVPASEMKKWFDSNYHYVVPELSEETDLKLIYNKALEEFKEAKEAGITTRPVVLGPVSFLVLGKSAKSAQPGFRPISLLPKLIPVYKQLLSELKAAGAEWVQIDEPILALDSAAALEKEYTASFTELAPVSPKIMLTTYFSRLDSNVRFIAKLPVAGLHIDLDRAPDQLTEVANAVKNTPIVLSLGLVSGRNIWKTDFGAAIKLAQTAIDILGAGRVIVATSSSLLHTPVTLASENKLTAEQKDWFSFALEKAEEVAVIAAVLSGSQDASVTAALEANRVSINKRREFEKNSDDTVRKRVAAITPDQLNRKSPFPVRKETQAKHLNLPKFPTTTIGSFPQTKEIRQARAKFNKGELTKEEYETFIKKEIEHVVRFQESIDLDILVHGEPERNDMVQYFGELLNGFVFTQNAWVQSYGSRYVRPPIIVSDVSRPGPMTVKWSSYAQSLTKKPMKGMLTGPVTILNWSFPRADISREMQSKQLALALRDEVIDLENAGIHAIQVDEPAIREGLPLRRADWDGYLEWAVDSFKLATAGVTDQLQTHSHFCYSDFDDIFPSIQRLDADVISIEASKSDMKLLNTFKHYGYSNQIGPGVYDIHSPRVPGDQEIKDRLQAMLSILPDSLVFVNPDCGLKTRGWKETEASLKNLVAGAKWARQNYA

SEQ ID NO: 3087 - protein, 151 aa, Agaricus bisporus
  var. bisporus
  strain H97 / ATCC MYA-4626 / FGSC 10389
MSNTERTYIMIKPDGVQRGLVGKIIARFEERGFKIVALKMAHPTEDHLRKHYADLANKPFFPGLVKYMASGPVIAIVFEGLDAVKTGRAMLGATNPLASPIGSIRGDFALAVGRNICHGSDSVESANKEIDLWFPEGITSWKSVYEGWLYE

SEQ ID NO: 3088 - protein, 156 aa, Agaricus bisporus
  var. bisporus
  strain H97 / ATCC MYA-4626 / FGSC 10389
MSLVVPDQHQQFQHILRLLNTNVDGKRKVMYALTEIKGVGRRYSNIVCKKADVDLNKRAGDLNSDELERIVTIIQNPTQFKIPTWFLNRQKDIVDGKNSQILSNGVDSKLRDDLERLKKIRAHRGLRHFWGLRVRGQHTKTTGRRGKTVGVSKKRG

SEQ ID NO: 3089 - protein, 190 aa, Agaricus bisporus
  var. bisporus
  strain H97 / ATCC MYA-4626 / FGSC 10389
MRDILKTEELEIPEGVEVTINSRLITVTGPRGTLKKNVRHVDMDIRLLKGKTTRVSLAVWQGGRKHVACLRTIRSLINNMVTGVTKGFQYRMRAVYAHFPINCIIQDDGKSLEIRNFLGEKTVRHVNMLNGVIVSESKTQKDELILEGNDVDNVSQSAASIQGICRVRNKDIRKFLDGIYVSDKGTIDKD

SEQ ID NO: 3090 - protein, 216 aa, Agaricus bisporus
  var. bisporus
  strain H97 / ATCC MYA-4626 / FGSC 10389
MGRRPARCYRYCKNKPYPKSRYNRGVPDPKIRIFDLGRKRASVDEFPFCCHLVSDEYEQLSSEALEAARICANKYVTKTSGKDSFHLRVRVHPFHVIRINKMLSCAGADRLQTGMRGAWGKPYGTVARVNIGQIILSIRCKETNSQVIIEALRRARYKFPGRQKIIVSKKWGFTNVDKAEYTRLKEEKKVLQDGAYVQFIRPRGNLEKNLRNQLRA

SEQ ID NO: 3091 - protein, 262 aa, Agaricus bisporus
  var. bisporus
  strain H97 / ATCC MYA-4626 / FGSC 10389
MQMTTEVREDAVYLAKLAEQAERYEEMVENMKRVASSDQELTVEERNLLSVAYKNVIGARRASWRIVSSIEQKEETKGNETQVRMIKSYREKIEGELADICEDILDVLDKHLIPSAATGESKVFYHKMMGDYHRYLAEFATGDKRKDSADKSLEAYKAASDVAVTELPPTHPIRLGLALNFSVFYYEILNSPDRACHLAKQAFDDAIAELDTLSEESYKDSTLIMQLLRDNLTLWTSDMQEAESATAENKETEATDAQPTDD

SEQ ID NO: 3092 - protein, 268 aa, Agaricus bisporus
  var. bisporus
  strain H97 / ATCC MYA-4626 / FGSC 10389
MPPKAKPGTGKKPAAAPFGASKKTQVKKNPLFEAAPKNFGIGQDIRPKTDMTRFVKWPEYVRLQRQKVILNQRLKVPPAIAQFAHTLDKNTATQLFKLFNKYRPESKQEKKERLRAAAAATAEGKTVETKKPLFVKYGLNHIVALIEAKKASLVAIAHDVEPIELVVFLPALCRKMGVPYVIVKGKARLGTVVHKKTAAVAAIQDVKSEDQRELATLVSAAKANFTDKYDEQRRQWGGGIRGYKSTQMLRKRAKAAGQNPAAASLGKL

SEQ ID NO: 3093 - protein, 351 aa, Agaricus bisporus
  var. bisporus
  strain H97 / ATCC MYA-4626 / FGSC 10389
MAGLDSRQSDIHSYRQSTQWSRLSFLVLLVASVNLSLLLKCNPLVTELGLYDIVNTPGVAADLAHISTPAKVEGNLPDNDGLSKTLKGADVVVIPAGVPRKPGMTRDDLFKINAGIVRDLATGIATYSPKAFVLVISNPVNSTVPIVAEVLKKHGVYDPKRLFGVTTLDVVRSSTFVAEKHGNLSLATEVVVPVVGGHSGVTIVPLLSQSSHPLPNLSTTEYEALVKRIQFGGDEVVQAKGGAGSATLSMAYAGAEFANKVIKAFKGEKGLIAPSYVSSEADREGAALLTKELGKEVAYFSSNIELGPGGIAKINPLGKITDAERNLVKAAIPELEKNISSGVTFVVEARL

SEQ ID NO: 3094 - protein, 430 aa, Agaricus bisporus
  var. bisporus
  strain H97 / ATCC MYA-4626 / FGSC 10389
MSYKVADISLAAFGRKEIEIAENEMPGLMHVREKYRAQQPLKGARIAGCLHMTIQTAVLIETLTALGAEVAWSSCNIYSTQNHAAAAIAVTGVPVYAWKGETEEEYTWCIDQTLAAFKGGKPLNLILDDGGDLTRHVHDKYPQYLKDIRGLSEETTTGVHHLYKAFRDGSLKVPAINVNDSVTKSKFDNHYGCRESLVDGIKRATDVMLAGKVAVVAGYGDVGKGCSEALRGFGARVVITEIDPINALQAAMAGYEVTTMDEIASRGNVFVTTTGNRDIITGKHFNVMPEDAIVCNIGHFDVEIDVAWLKENAKSVSNIKPQVDRYTMANGRHIILLADGRLVNLGCANGHPSFVMSCSFTNQVLAQIALWTTPEKFPLGVHLLPKELDEEVARAHLGQLNVKLTELTETQSKYLDIPTNGPYKPSHYRY

SEQ ID NO: 3095 - protein, 576 aa, Agaricus bisporus
  var. bisporus
  strain H97 / ATCC MYA-4626 / FGSC 10389
MSDKISLIPLVGIPGEIKNRLNILDFVKNDKFFTLYVRALQILQARDQSDYSSFFQLGGIHGLPYTEWAKAQPQLHLYKANYCTHGTVLFPTWHRAYESTWEQTLWEAAGTVAQRFTTSDQAEWIQAAKDLRQPFWDWGYWPNDPDFIGLPDQVIRDKQVEITDYNGTKIEVENPILHYKFHPIEPTFEGDFAQWQTTMRYPDVQKQENIEGMIAGIKAAAPGFREWTFNMLTKNYTWELFSNHGVVVGAHANSLEMVHNTVHFLIGRDPTLDPLVPGHMGSVPHAAFDPIFWMHHCNVDRLLALWQTMNYDVYVSEGMNREATMGLIPGQVLTEDSPLEPFYTKNQDPWQSDDLEDWETLGFSYPDFDPVRGKSKEEKSVYINDWVHKHYGFVTTQTENPALRLLSSFQRAKSDHETQYALYDWVIHATFRYYELNNSFSIIFYFDEGEGCTLESIIGTVDAFRGTTSENCANCARSQDLIAEGFVHLNYYIGCDIGQHADHEDDAVPLYEPTRVKEYLKKRKIGCKVVSAEGELTSLVVEIKGAPYYLPVGEARPKLDHEKPIVILDDIIHRVN

SEQ ID NO: 3096 - protein, 685 aa, Agaricus bisporus
  var. bisporus
  strain H97 / ATCC MYA-4626 / FGSC 10389
MAFTQTKTDDVAIATIRTLAADTVSKANSGHPGAPMGMAPVAHVLFSRFMNANPKSSRWFNRDRFVLSNGHACALQYVLLHLLGYKLSLDDLKGFRQVDSKTPGHPEVGHTDGIEVTTGPLGQGFSNAVGLAMAQAHLAAVYNKEGFDLINNYTYAFAGDGCLMEGVASEAASVAGHLKLRNLIVIYDDNHISIDGDTAVAFTENVPQRFEAYGWQVLHVDDGDSDLTGIYNAIAEARKSTDKPTIIRLRTTIGYGSKLQGSHSVHGAPLKADDIVQLKERFNFPTDKQFYVPQETYDAYAEVGRRGAALEQQWNALLASYQQKYPKEHAELVRRIDGKLPEGWEKSLPVYTTADAAQASRKLSEIALTSISSVLPELLGGSADLTGSNLTKVKGSVDFQHPSTGLGTYAGTYIRYGVREHGMGAIANGLHAYGGIIPFVGTFMNFVSYAAGAVRLAALSGHQVIWVATHDSIGLGEDGPTHQPIETYIHFRATPNIAFWRPADGNETSAAYYSAITSRGTPSILSLSRQNLPNLEGSTIQNALRGGYVLVEEQNEALTIVSTGSEVNIAVDAAKKLKAEGIKTRVVSLPCWLTFDQQDQEYRLSVLRSGAPILSLEAASPTGWQKYSHEQFGLNGWGASGPYLKVYEKFGITGSNIAAVGKKIVEFYTSNSIPTVSPLLKAVQH

SEQ ID NO: 3097 - protein, 159 aa, Agaricus bisporus
  var. bisporus
  strain H97 / ATCC MYA-4626 / FGSC 10389
MQIFVKTLTGKTITLEVESSDTIDNVKAKIQDKEGIPPDQQRLIFAGKQLEDGRTLSDYNIQKESTLHLVLRLRGGAKKRKKKTYTTPKKIKHKRKKVKMSILKYYKVDSDGKIKRLRRECPSAQCGAGIFMAFHQDRQYCGKCGLTYTFAPGSKPPAV

SEQ ID NO: 3098 - protein, 189 aa, Agaricus bisporus
  var. bisporus
  strain H97 / ATCC MYA-4626 / FGSC 10389
MADPKSKPPTNPMKEPRIDKLVINISVGESGDRLTRASKVLEQLTGQTPVTSKARYTVRTFGIRRNEKIACHVTIRGPKAEEILERGLKVKEYELRRKNFSDTGNFGFGIQEHIDLGARYDPGIGIFGMDFYIVMGRPGARVARRRAKKNRIGFTHRIKKEDTMAWFKQRFDGIILVCGHQILLSTVAH

SEQ ID NO: 3099 - protein, 191 aa, Agaricus bisporus
  var. bisporus
  strain H97 / ATCC MYA-4626 / FGSC 10389
MPRAPRNHSKTYKIPRRPYEAPRLDAELKLAGEYGLRNKCEIWRIALTLSNIRRAARELLKLDPKDPKRLFEGNALIRRLVRIGVLDESRMRLDYVLALKIEDFLERRLQTQVFKSGLAKSIHHARVLIKQRHIRVGKQIVDVPSFVVRLDSQKHIDFALTSPYGGGRPGRVKRKRAAAAAKGGEDAEEEE

SEQ ID NO: 3100 - protein, 217 aa, Agaricus bisporus
  var. bisporus
  strain H97 / ATCC MYA-4626 / FGSC 10389
MVLKLYGTNISPPSRYAGLVLLEMKVPFELVNVDLGKKEQKSPENLANQPFGQIPYIVEDDGFILYESRAIARYIATKYANQGPKLIPTGDLKKIAKFEQATFAESAHFNDPAFSLLLEIFVKKMQGLTPDEARVTELKTTLLSKMDVYEQILSKQKYIAGDEITLVDLAHLPLASVMPDIGIDITTGRPHLTKWLNELLQRESWQTLKANGLVSTA

SEQ ID NO: 3101 - protein, 238 aa, Agaricus bisporus
  var. bisporus
  strain H97 / ATCC MYA-4626 / FGSC 10389
MKFNIANPATGAQKLIDTDDEKRIRIFYDKKISQEIPGDGLGDEWKGYIFRITGGNDKQGFPMKQGVLLPYRVRLLLSDGQSCYRIRRTGERRRKSVRGCIIGPDIAVISLVIVKQGDSEIPGLTDTVLPKRLGPKRATKIRKFFNLSKEDDVTKYVVRREVKSQKKENAKPYTKAPKIQRLVTPLRLQRRRHLRSLKRRKLEHQKEQKAEFDVIVAKRLAEKKAKVAAVKASHKTTA

SEQ ID NO: 3102 - protein, 242 aa, Agaricus bisporus
  var. bisporus
  strain H97 / ATCC MYA-4626 / FGSC 10389
MARSKELVPGVGRLSRSQVFTKRGLYKGIKKSDKPAGEEPAATKEKAVGGAKNGEKRVIPTVKAPRYYPTEDVRQPKKSRKSHNPPGLRSSITPGTVLILLAGRFRGKRVVFLKQLESGLLLVTGPYKANGVPLRRVNQAYVIATSTKLELPGFTVEHQVDEKINDAYFAKTSTKGARSAEEEFFEDGKPKAKETFPATKAADQKQVDSAILDAVKKTPDLVKYLKSTWGLSKGQYPHQLMF

SEQ ID NO: 3103 - protein, 312 aa, Agaricus bisporus
  var. bisporus
  strain H97 / ATCC MYA-4626 / FGSC 10389
MAEAKRVKTPKDFAIDFMMGGVSAAVAKTSAAPIERIKLLVQNQDEMIKQGRLATPYKGVSDAFTRTYKEEGLVSLWRGNTANVIRYFPTQALNFAFKDYFKSLFGFKKSEGYWKWFAGNVASGGAAGASSLLFVYSLDYARTRLANDAKSAKGGGARQFNGLVDVYRKTLASDGIAGLYRGFIPSVVGIIVYRGLYFGVYDSLKPVVLVGALEGSFLASFGLGWGVTIGAGLASYPLDTIRRRMMMTSGSGQNYKSMFDAGSQILAKEGTKSLFKGAGANILRGVAGAGVLSLYDKLQQVMFGKVYSGGSG

SEQ ID NO: 3104 - protein, 396 aa, Agaricus bisporus
  var. bisporus
  strain H97 / ATCC MYA-4626 / FGSC 10389
MAEVETTPTSAAADKKPSVSTLETDLTKYKVAADIVRDVIKKIIESTVEGAKLIDLCVEGDKLLEQGTGAVYNKPVKGVKVTKGIAFPTSISVNNAVAHFSPLASDPQSSQTISKGDVVKIQLGAHIDGFAAITAETIVVGASVDNPVTGRQADVIKAAWTAAEVAMRLVKVGNKNWAVTEGVAKAASAWDCKPVEGMLSCQQTQNVIDGKKRVILNPSEAQRKEFETATFAEGEVYGIDILISSGEDGKARVEESRTTIYQRDSAVTYQLKMKNSRMVFTEVQKKAGSFPFNIRILEDEKRARMGLQEAVQHSLVKPYEVIYTPNNTFVAGFHFTIALLPGGPALITHPPHWYKPELVKTEKELEDEELKGLVARNLRPSKKKGKKAGETEAKAE

SEQ ID NO: 3105 - protein, 471 aa, Agaricus bisporus
  var. bisporus
  strain H97 / ATCC MYA-4626 / FGSC 10389
MPPIFDKPTTDKYDYVVIGGGSGGSATARRAALYGKKVAVVETDPYLGGTCVNVGCVPKKIMWHAADLQDRLNHHYPGYKFNGIANAQFDWATFKPQRDAYIHRLNGIYARNFEKEGVEFHHGTARLTSPTSVEVKRGDGSTYTLNGDRITICVGGRPNSPSEKQIPGASKGIDSDGFFGLNEQPKRVAVVGAGYIAVELAGVLNALGSETHLIIRGESVLRTFDPMIQETLTPWMEKTGIKIHKSSQVTSVEGEKGQTLTVKTNKGEQIDVDVVLWAIGRSANTEGLGLEELGIKLDKKGDIVVDEYQNTNVKNVYAIGDVAGKWLLTPVAIAAGRRLSNRLFGPPEYKDEKQSYENIPTVVFAHPPIGTVGLTEPQARQKHGDAVKIYTSSFKSLYFSMVEEEHKEPTVYKLIVVGPEERIVGIHMIGQGSDEAMQGFGVAVKMGACKKDLDDTVAIHPTSAEELVTLR

SEQ ID NO: 3106 - protein, 797 aa, Agaricus bisporus
  var. bisporus
  strain H97 / ATCC MYA-4626 / FGSC 10389
MAVVGVDFGTLHSKIGVARHRGIDIIANEVSNRATPSLVAFGPKQRSIGESAKTQETSNFKNTIGGLNRLIGRTFDDPQVQNVEKNFTHAALVDLNGTIGVEVNYLGERQQFSFTQLVGAYLGKLRDITANELKTGVTDIVIAVPGYYTEIQRRAILDAAAIANLNVLRIINDTTATALGYGITKSDLPDPENPRHIAFVDVGHSTFSVAIVAFAKGQLTIKSTAYNHNLGGRDIDYVLLKHFAEEFKTKYKIDVLANPKAIFRLAVGCEKLKKILSANAEGPLNIESIMNDVDASSKMSRDQLEALIPSLLDGIDGPIKQALAESGLTVDQIDSVELVGGSSRIPSVRTRISQAFNNKPLSVTLNQDEAVARGATFACAMLSPVFRVRDFHIHDINHYPVQVQWQAVPTDPDEDTEILLFPQGNAIPSTKILSFYRRQAFHVDAAYKDPSGLPGGIKPVIGGFDVTDVPPDPKGDSTIVKVKARLNLHGIVSFENTYVEEIEEREVEPAPMDVDQQQNATATSSGAAEGEAAPPVPPKKKKIVKKKEVPFFTTTSSLDKKTLEQLRERESEMHAADKLVQDTEDRKNALEEYIYDTRGKLDDRYAAFVTADEKSKLLQELSAAEDWLYTEEGEESTKSVYVSRLDALKTLGDPITFRYRETEDRQKSVAALRETLNNYMNQATSNDEKYAHIDGKDKESIVERVAVIQKWLDDMSVRQAERRKDVDPVLTSEQVTKKRDEIIFFATPILTKPKPKMPTGTGTDSGTGTPRRDGTPQPPPPQKNEQEGGKDASMDVD

SEQ ID NO: 3107 - protein, 931 aa, Agaricus bisporus
  var. bisporus
  strain H97 / ATCC MYA-4626 / FGSC 10389
MAEINEAKSASTESFVTALVFNAIVFGVEIGVFTLIRPYFKAIYEPRTYAPAPSERSEPLSRNIFLWPVALWRADFRSIKHANGMDAYCFVRFLRMMVKVFLPIWIISWIVLLPTTAVGTSNPGKDNLDKLTFGNVSPDQYKRYAAHLILAWFFTFWVLYNIVHEMRHFITARQQHIIEPNHAKSLQANTILVTGIPDRYLNRRSLLDLFDELPGGVKKIWINRNLKELPEIYSRRLSACNKLESAETALLRTAAKIRQREEKKKSKASKKTVPVSKEHTHTHSEDLETAAIVVPHGQRPTHRLGFLPFTGKKVDTIDWAREEIVTCNRLLEEGCAAIRADDEASNEVQNPGEFSSDASSAKLSTFLLSLSTSICNNFPAVGLKPVAAIKNTTTAIKARFAGYGDSKYPPFNSAFVTFHKQIAAHLAVRVLTHHEPYSMTNKYNEVSPQDVIWANLNMNPYEQKIRMAISYAITAALIIFWVIPVGRRALSNVPSLCNQFSWLAWICGLPPVIVGIISGVLPPVLLAILMALLPIVLRLLARFEGIPKYTGLELSLMTRFFIFQVVHSFLIVTVTSGIVAALEGLVESPTSTPNILANELPKASTFFLTYIILQGLAGSGSGFLQIVRLVIYYVKLIVLGSTPRSVYNIKYVLGNVAWGTLFPTITLLTVISLAYSIISPVINGLACATFFAFYQLYKYLFLWVYEQNPSGDTGGLFFPKAIQHVFVGLYIEEICLCALFFLARDPNDNASAVIEGALMIVLIVLTAGFHAIFNNSYDPLLQALPLSLKDKTYSPATGMTEGRNPRKSEAGNDNHEIVEEMRGIEGDDEDDVSSKHKGKRPENEKVGQVGEGTAARHTREDAEFGFAHPAISRPQRTLWIPRDTLGLGEGEVAACEDMGLNASMSGAVMNEKGKVDVPTADDVPGEIVVRL

SEQ ID NO: 3108 - protein, 159 aa, Agaricus bisporus; identical to SEQ ID NO: 504
  var. bisporus
  strain H97 / ATCC MYA-4626 / FGSC 10389

SEQ ID NO: 3109 - protein, 156 aa, Agaricus bisporus
  var. bisporus
  strain H97 / ATCC MYA-4626 / FGSC 10389
MPGVRDISADAFIAAYASYLKKSGKLEVPPWVDIVKTGAYKELAPYDADWYYIRSAAVARHIYLRKDVGIGALTKLHGGRKRRGNRPSHHAASSSNVQRKVCQSLEKIGVLEKSDNGGRRITESGQRDLDQIATQVFDQTKEDDDEEEEEEEEEEE

SEQ ID NO: 3110 - protein, 201 aa, Agaricus bisporus
  var. bisporus
  strain H97 / ATCC MYA-4626 / FGSC 10389
MGAYKYIGELYKKKQSDVLRFITRVRCWEYRQLHVIHRASRPSRPDKARRLGYKAKQGYVIYRIRVRRGNRKKPVPKGATYGKPVRQGVNHLKPQRSHRTVAEERVGRRCGNLRVVNSYWVNQDGVYKYYEVILVDPNHKAIRRDPRINWIVNPVHKRREARGLTSSGKQNRGLGKGHRHNHNPGYSVWKKHNTLSLRRYR

SEQ ID NO: 3111 - protein, 325 aa, Agaricus bisporus
  var. bisporus
  strain H97 / ATCC MYA-4626 / FGSC 10389
MSFGKTITLSNGAKMPRIGLGTWQSKPHEVENAVEIAVRNGYRHLDLAMIYQNQDEVGRALKKVIPSVVKREELFITSKLWNNAHQPDQVENQLDETLKQLGLDYLDLYLIHWPVAFPPGNGFFPPHSSLKDEVELDTETSLVDTWKAMLALPKSKVRAVGVSNFTVEHLKGIFDATGVHPVANQIEAHPLLQQPELVKYCQEHNIHITAYSPLGNNSEGKPMHTENPVVVEIAKRLNATPAQVLIAWGARRGQSVIPKSVHEDRIISNFKEVEITDDDFARMNKIGEGDLWHRYNIPFFYNPCWSISTFSEDREKGARVPVKIN

SEQ ID NO: 3112 - protein, 481 aa, Agaricus bisporus
  var. bisporus
  strain H97 / ATCC MYA-4626 / FGSC 10389
MSAHHGESTLRPEPDKVLQDIANYVHGYKIDSPLAFETARLCLIDTIGCGLEALRFPECTKLLGPVVEGTIVPNGTRVPGTSHQLDPIRGAFNIGTQIRWLDYNDCFLAAEWGHPSDNLGAILAVADHLARQGQPLTVHDILEAMIKAHEIQGGLALLNSYNRVGLDHVVLVKVASTAVVSKLLGLDRDQTVDAISQAWVDGQSLRTYRHAPNTGPRKSWAAGDACSRAVNLALLVKKGEKGLPSVLTAKTWGFYDVLFKGKAFEFQRPYGSYIMENVLFKISYPAEFHAQTAVEAAHTVHNKLKVIGRTSDDIKSVRIRTQEAAIRIIDKQGPLDNFADRDHAINYMVAYPLIFGELTSESYTDASAADPRIDALRAKIHCVEDSRFSVEYHDPEKRSIGNALLVELNDGTILDEVEVEYPVGHKRRRAEGTPLLINKFKRHISYHFDDARQKKILDTVSDAQNLAKMPVDKFTDLFVKA

SEQ ID NO: 3113 - protein, 478 aa, Agaricus bisporus
  var. bisporus
  strain H97 / ATCC MYA-4626 / FGSC 10389
MPQITSGATAQSAFATQPTEKDPYRYQVGFGNSFASEALPGVLPEGQNSPQKNKYGLYNEGMTGASFVAPRAENRLAWLYRIRPSVAHQGFTRLPDNPDLESNFLPTNKNVHVSPTQLAWLPFKLPADSEKVDWVDGLKTIAGNGDPTLREGLAVHMYLANKSMDKRAFCNGDGDMLILPQQGRLDIQTEFGKMMVRPGELCVIQRGMKFKVILPDGPSRGYIQEIYGTHFELPELGALGGNGLANRRDFETPVACFDIDQSSWEIVYKVSGQLHACHQEHTPFDVVAWHGNYVPYKYAMEKFIFVGSISKDHIDPSCFCVLTAKSKHNNAPLVDFLILGERWDVATNTFRPPYYHRNSSTEFMGLIHGVYGGRSDGFQPGGASFETGFCPHGVSYDVWKAASEHPLTPEIVHKGVLAFMFESSMPFTITEYAMNRCGTKHEHEPQMWDNLKAHFMNHLDEINADLKAAKLPLLGSNR

SEQ ID NO: 3114 - protein, 678 aa, Agaricus bisporus
  var. bisporus
  strain H97 / ATCC MYA-4626 / FGSC 10389
MSLTPPQSPLQWDHAAQDISRLTQQAIDADRALQDKVAALDPKNCTFESVFVELAFAETKLDAITEPLAFYQNVSPSKELRDASNEAEALVRDYGVESSMRVDVYKAKVAARDNLKKSGQRDKLSSEEQRLVDKMILDGTRAGLALDETSRVKLVELKKELSKTCLDFSKNFNEENGVVTFTLEELKGVPEDVVSGFTKRTENGKDVYDVTYKTPDIFPLFKFAENPNTRQRAQEGYESRLAINVPLLDRAIELRRQISGILGYDTWADFITEVKMIKSGNGIKDFLDDLENKLRPVGMKERETLLAMKKKEHEQKGYPFDGEFYIWDYRYYDRKYIEETLDLDDMLVKEYFPVSVVVPTILQIYQDMLSVKFIEIETSTWHPDVQKFAVWEKGAKDESGFIGYCYLDLFPRTAKYSHAAVWPILPGYDKADGKRSYPTTAMVANLAKPTPDKPALMRHDDVVTFFHEMGHVFHGLLSQTKFARFHGTSVARDFVEAPSQMLENWCWEPKVLERMSSHYEKKEPLAKDLIEKIIKSRYVNVGLFYLRQLFFAKYDYKVHTDKESSDYTRLWNDLREKISLVKYKVAAPGQGTFGHITGGYDAGYYGYTYSLVFASDMYATVFKGDPLDPKHGSHYRQEILLPGGSREELDSLKAFLGRPPNSDAFLKELFGDNPTSNL

SEQ ID NO: 3115 - protein, 701 aa, Agaricus bisporus
  var. bisporus
  strain H97 / ATCC MYA-4626 / FGSC 10389
MSAPESFGFQAEISQLLDLIINTFYSNKEIFLREIISNSSDALDKIRYASLTDPSALDSERDLYIRITPDKENKILTIRDTGIGMTKADLVNNLGTIAKSGTKGFMEALNAGADISMIGQFGVGFYSAYLVAERVQVISKHNDDEQYIWESAAGGTFTIALDTVNPPLGRGSEVRLYLKEDQYEYLEEKRIKDIVKKHSEFISYPIQLAVTKEVEKEVEDEEEVKEEDGEKSKIEEVDEEEENGEKKKKKTIKEKEVTNEELNKTKPIWTRNPQEITTEEYASFYKSLTNDWEDHLAVKHFSVEGQLEFKAILFIPKRAPFDLFESKKKRNNIKLYVRRVFIMDDCDELIPEYLNFVKGIVDSEDLPLNISRETLQQNKILKVIRKNIVKKTLDLITEISEDKDNFAKFYEAFGKNLKLGIHEDAQNRSKLAEFLRFYSTKALDDQISLKDYITRMPEVQKSIYYLTGESLAATKDSPFLEVLKRKGFEVLLLVDPIDEYAITQLKEFDGKKLVCVSKEGLELEETEEEKASREAEVKEYTELCSTVKDALGDRVEKVVVSNRITDSPCVLVTGQFGWSSNMERIMKAQALRDSSMSSYMASKKTLELNPNNAIVKELKNKVMEDKADKSVRDLTFLLFETALLTSGFSLDDPTSFAKRIYRMISLGLDVDEDEVPPALESTTAAPAAEATASASAMEEID

SEQ ID NO: 3116 - protein, 737 aa, Agaricus bisporus
  var. bisporus
  strain H97 / ATCC MYA-4626 / FGSC 10389
MAHTAHPFSSVPSAAVRRRLSSSVSAKKPLVTATFSSLTPMWAGVAGVIINNNTEFEVAVSVHDSVYSTDFASVVLPYDPNDPEKNAKTIEQYILQVLRRFSVEHLCKFLGAGVTLTLLREVPNVCTRLWLDLDIVPFVFNIKQYHTDSLTRPNIKHRISSTTGSYVPSGAETPTVYVDSAHLKAMSGLQTGVSGRLPIQRTLDEQADSAARKCLMNFGPGNNPRLNIGPRNQVLVDDGGRVHLLDDLDEYRNTVGPRTWNAVIKLADELREKKVKIGFFSSTPQGGGVALMRHALIRFLTALDVDAAWYVPNPSPAVFRTTKNNHNILQGVAAPDLRLTEEARDAFDAWILKNGLRWTAEGGPLARGGVDVAFIDDPQMPGLIPLIKKIRPELPIVYRSHIEIRSDLVHVPGSPQEEVWKYLWKNIQLADLFISHPVSKFVPQDVPLEKVALLGAATDWLDGLNKDLDPWDSQYYMGEFRALCARERMLELRWPQRDYIIQVARFDPSKGIPNVIDSYVKFRELLKLKSPELDDEDHPQLLVCGHGAVDDPDASIIYDQIMQIINSEQYEAYAKDIVVMRLPPSDQLLNSLMSNAKIALQLSTREGFEVKVSEALHTGKPVIASRTGGIPLQIEHGKSGYLCTPGDNEAVAGHLYDLYTDEILYKTMSDYAKTHVSDEVGTVGNTAAWLYLAVMYNRGIKIKPNGAWLNDLLRTETGEDYEEGEPRLPRGGLKMQG

SEQ ID NO: 3117 - protein, 767 aa, Agaricus bisporus
  var. bisporus
  strain H97 / ATCC MYA-4626 / FGSC 10389
MAAGVATAATRIGDTKVAMSAFEKDSFINYQRIEDNLAVVRNRLKRPLTLSEKVVYGHLDDPHGQDINRGVSYLKLRPDRVACHDATAQMALLQFMSVSMDTAAAPTTIHCDHLIEAQIGGVKDLQRAVQTNKEVYDFLATVTAKYGLGFWKPGSGIIHQILLEHYAFPGGMMVGTDSHSPNAGGLGMVACGVGGADAVDVMAGIPWELKCPKVIGVNLTGKIGGWTTPKDVILKVAGILTVKGGTGAIVEYKGPGVESLSCTGMATICNMGAEIGATTSLFPFNRRMADYLQATKRSDVANYAKAFAHNLQADEAAEYDEHIEINLSELEPHINGPFTPDLATPISKFASEAKKNGWPEEVKVGLIGSCTNSSYEDMTRSASIVKQAADRGIDFKSKFTVTPGSEQVRATIARDGLIDSFESAGAIVLANACGPCIGQWDRQDVKKGEVNSIVTSYNRNFTGRNDANPATHAFVASPDITTALAFAGRLSFNPLTDELIGSDGKPFKFSDPSGNELPPRGYDPGEDTFQPPPQDRASVQVAIDPKSDRLQVLTPFKPWDGKTPSDLPVLIKVKGKCTTDHISAGGPWLKYRGHLENISQNCLIGAINAENGEANKIKNQITGEYDGVPQTAAYYRERGIKWVVIGDHNYGEGSSREHAALEPRFLGGLAIVARSFARIHETNLKKQGMLALTFIDPADYDKVRPDDKVDILGLEAFSPGRNLTLVAKHTDGTQDEISLAHSFNEGQIEWFKAGSALNLIAAKAKSA

SEQ ID NO: 3118 - protein, 867 aa, Agaricus bisporus
  var. bisporus
  strain H97 / ATCC MYA-4626 / FGSC 10389
MVTTGNKFAVSRSLEDWSFTQVGGGQGTKDGEWLKVSNFPTTVHVELLKLGRIPDPFIGLHEWDVQWVGEAEWAFRINFDVTREELDFPHLDLVFGGLDTFAAVTLNGHDILKTSNQFIEHRVAVKDRLTIGLNELVIHFESAFLKGRDTEKQHGKFNLWNGDSSRLHVRKAQYNYGWDWGPILMTVGPWKPITFEAYTNRIVDVDIRARVNEDLSVNLSADVTFAEKKSGFMVFSLSGPDGAATASISPTATDSGQAKVSLAFPPGKLSLWYPIGYGKQSLYTASIKFTDEHGDVVDSKTQTIGFRRVRIVEKKLVDQEGLTFLFEINNIRIFCGGSNWIPADSFLTAVTPKRYRDWLQLAVDGNQNMIRVWGGGIYEHDSFYESCDGKSHLLAMWISFLVWQDFMFGCGQYPAYDSFVESVREEAVQNVKRLRHHPSVVIYDYQLAESLNLELDYADETSDFRDTNFPARYIYERVLPEVVQALTDTYYHRASPYSGHGKVTTDPKFGDIHQWNVWHGSQEPWHNWDILAGRFVSEFGMQGYPNVRTVDNWLGGDVSERFPQSRVCNNHNKADGFERRLELYLVENFRHAFDMESYIFYTQVMQAETLASAYRLWRRNWRGPGREYTAGALVWQLNDCWPVTSWAIVDYFLRPKPAYFAIARELRPYTVGMTRKEYQKFDDDRTAAFFKIETVLEIWGTNSTLEEKKARLELTAFDLHSDWIEGWTKEVVLAPNSSTEIYKGGAPGLPVRTKKSEAARTVIFSARLLGDNEDVLGRYSNWPEPFKFVKFPSVKDVGLGITVGRDGETVTLSALKPIKGIVLDVDGEDVKWSDQAIDLAPGDPQIIRAVGLKGREVKARFLGDGTA

SEQ ID NO: 3119 - protein, 162 aa, Agaricus bisporus
  var. bisporus
  strain H97 / ATCC MYA-4626 / FGSC 10389
MSNVFFDITVDGQAAGRIVFKLYDDVVPKTTKNFRELATGQHGFGYAGSSFHRVIPNFMLQGGDFTRGDGTGGKSIYGEKFADENFARKHTKPGLLSMANAGKNTNGSQFFITTVVTDWLDGKHVVFGEVVEGMDLVKKVETLGSQSGKVSKKVTIANSGTC

SEQ ID NO: 3120 - protein, 213 aa, Agaricus bisporus; identical to SEQ ID NO: 488
  var. bisporus
  strain H97 / ATCC MYA-4626 / FGSC 10389

SEQ ID NO: 3121 - protein, 256 aa, Agaricus bisporus
  var. bisporus
  strain H97 / ATCC MYA-4626 / FGSC 10389
MADAPRGRGGFGRGRDRGRGRRGPRRGGRKEEDKEWVPVTKLGRLVKDGKIKSMEEIYLFSLPVKEFQIVDFFLPKLKDEVMKIMPVQKQTQAGQRTRFKAFVAIGDFDGHVGLGVKCAKEVATAIRGAIILAKLSVIPVRRGYWGAALGEPHTVPTKVSGKVGSVMCRLLPAPRGTGIVAAPACKRLLQLAGVQDVYTQAQGSTATMGNFLKATFAAITKTYAFLTPDLWREIPLSRLPFDEFSAHLALSATKKY

SEQ ID NO: 3122 - protein, 293 aa, Agaricus bisporus
  var. bisporus
  strain H97 / ATCC MYA-4626 / FGSC 10389
MASKLPSVLSATEDEIQLLLAAQCHIGTKNCDKQMIPYVWKRRSDGIHIINIGKTWEKLVFAARIIAAIENPNDVCVISARPYGHRAVLKFAANTGAQAIAGRFTPGSFTNYITRSFKEPRLIIVTDPRVDHQAIREASYVNIPVIALCDTDAPLQFVDVAIPTNNKTKHSIGLIWWLLAREVLRLRGTIPRSPDGWNVMVDMFFYRDPEEVEKQQQEEAAAKAAVTAGEEAPAPTEWDVSGGHQAGAINPALVETSLDWAADAAPTNTDWAAEPAVGNWAADAPATGGGGWD

SEQ ID NO: 3123 - protein, 337 aa, Agaricus bisporus
  var. bisporus
  strain H97 / ATCC MYA-4626 / FGSC 10389
MLCRAALRSSSARLFSTSAARQTKVAVLGAGGGIGQPLSLLLKSDPLVSSLSLYDIRGAPGVAADVSHVDTASEVNGYPADKIDAALDGVQVVVIPAGVPRKPGMTRDDLFNTNASIVRDLATAVARASPSAHILVISNPVNSTVPIVAAALEKAGVFDPRRLFGITTLDVVRAQRFLAGIVESDPRQTPVTVIGGHSGATIVPLLSQSQYGKGIKGETYDKLVHRIQFGGDEVVKAKDGAGSATLSMAYAGAKFTNLLLRGLNGEKGVITPTFVRSPLYESQGIDFFSSSVELGLQGVEKIHPIGDISPEEEKLLAACLPELKKNIEKGKAFVAPN

SEQ ID NO: 3124 - protein, 425 aa, Agaricus bisporus
  var. bisporus
  strain H97 / ATCC MYA-4626 / FGSC 10389
MPENKGRVLLAYSGGLDTSCILAWLIEEGYEVYAFMADVGQEEDYAAAEKKALKVGAKKFFLADLKREFVTELIYPAVQANCIYENVYLLGTSLARPVIARGMIEVADKEGCDYVSHGCTGKGNDQVRFELAFYGLKPDIKVIAPWRIPEFYNRFAGRQALLQYAAEQNIPVQQTVAKPWSTDENLFHISYEAGILEDPNVTPPNDMWKLTTAPEDAPTSPERIILEFQNGLPTKVIVPEQQKEYTDAVEIFSALNTLARKHGIGRIDIVENRFIGVKSRGCYESPGATILRVAHMDLEGLTLDRNVRALRDQFTTIALSRILYNGHYFSPEREFVTSSIPSSQRTVNGIVRLKLYKGNTIVEGRESSEGLYDAAQSSMDELGGFEPTDTTGFISIESIRLKKWAQSKAAKGQSGVTAKDVYGSS

SEQ ID NO: 3125 - protein, 444 aa, Agaricus bisporus
  var. bisporus
  strain H97 / ATCC MYA-4626 / FGSC 10389
MVQLSKVLGVIILARNGDRYNYYQDPYTYAGSNTETTALGEVESHRLGSLLRSTYFDSSSSSYIEGIRSDLVDNNEVKVRVKAGVEGTVVFDSAIALLQGLFPPNPKNKITLANDTTVVAPLGGYQYVPVETVEPGNDRSLESWTNCPAFQKHIKEFYASEDFKAKAKDAQPFFHAAKDFVFGRPTTLENAWNIYDFVNSQLIHNKTYAHRLPPTFVEQAHHFANYHENGVFSDKDIVGIGNIAGRTLLHTILSSLERIAFNGDPLQFMVIQTTYQPFISFFHQTGIIKEHPEMKGIPDYSSAIAIELRRGSPPDVRDFLRIKFKNGTHPHFKDVHVFGHHADIPLTEFIYRAENAAITSNKQWKEVCNGNSATFDVAEMVTGNDSTMRAMLTGGSTLVTLVCLFIITKLVRRYRQRAREARLRLDGEENINVNVPVMEKTRLI

SEQ ID NO: 3126 - protein, 480 aa, Agaricus bisporus
  var. bisporus
  strain H97 / ATCC MYA-4626 / FGSC 10389
MATANTPAFNKMLYAPLAEIDPEVKNIIDKETWRQFTGLELIASENLTSQATMEANGSILTNKYSEGLPGARYYGGNEYIDELEVLCRKRALTAFNLDPAVWGVNVQPYSGSTANFAALTALIQPQDRLMGLGLPDGGHLTHGYYTAKKKMTASSIYFQSYPYAITPDTNLVDYAALAAQAKVFKPRLVICGASAYPRDWDYGKLREICDKEGAFLMADIAHTSGLIAAQELDNPFEYCDVVTTTTHKTLRGPRAGLIFFRRDRPNAPDLEKRVNDAVFPACQGGPHNNTISAIATSLLQVSRPEWKAYAKQVIANARALGESLVANGYKLQTGGTDNHLVLMDLRPLGLTGSKVEKICDLMGITINKNAVSGDASAQVPGGIRLGTSALTSRDMKEEDIKVVADFLHRAVQLSLLVQKEAGSKLLKDFVRVATTPQEGKQGYAQVKQLRDEVRDFASKWPLPGVQTAGLQKPEGYHEDF

SEQ ID NO: 3127 - protein, 500 aa, Agaricus bisporus
  var. bisporus
  strain H97 / ATCC MYA-4626 / FGSC 10389
MPSIFTHQWDTPVYKGSTSINTGLFINGEFVDGVKNTTIDVVNPANGKLITKISEATEADIDIAVEAAHKAFETTWGLNCSGSKRGDMLYKLAQLMEKNIDDLSAIEALDNGKTFLWAKSVDLSLSISTIKHYAGWADKNFGQVIETDEKKLTYSRHEPIGVVGQIIPWNFPLLMLAWKIGPALATGNCIVLKPSEFTPLSALRMCALIQEAGFPPGVVNVVTGYGSTTGQAISSHMKIDKVAFTGSTLVGRKVMEAAAKSNLKNVTLELGGKSPVVIFDDADLEQSVNWTAHGLFWNHGQACCAGTRIFVQEGIYDKFLQKFTDKIKEIKLGDPFGLGIDQGPQVSQIQYDRIMSYIESGRAEGATVHVGGERHGNEGYFIQPTIFTDTTPDMKIVKEEIFGPVGAVIKFKDGKEVIKQANDSNYGLAAAVFSQDINKAIETAHAFKAGTAWVNCANTIDAGVPFGGYKQSGIGRELGEYALHNYTNVKAVHVNLNWKM

SEQ ID NO: 3128 - protein, 503 aa, Agaricus bisporus
  var. bisporus
  strain H97 / ATCC MYA-4626 / FGSC 10389
MPQTYTHTFDTPVYKGSVTFNTGLFIDGQWVDPVDGGDRIDVVDPCTGKVITTVAAGTSKDVDIAVAAAEKAYKTSWGLKVPGVERGKLLGKLADLVEKHSDELAALEALNVGKHFHVAKMADIPLAVNALRYYAGWADKVHGKTIETTENKMAYTRHEPYGVVGAITPWNFPLGTVSFKIAPMLATGNVVILKPSEITPFTALYLASLINTAGFPPGTVNIINGYGNTVGEAISRHSSIRAIGFTGSTLTGRKILKASAESNLKKVTLELGGKSPTIVFDDANLEQAIKWASMGIFFNMGQACVAGSRIYVQEKIYDQFLKGFTKTAEVLAGATGGPFEPGVQHGPQVSNLQFERVMGYIKSGKSEGAKVLIGGERHGDTGYFIKPTVFTEAKPDMKIMQEEIFGPVCSVVKFKTEEEVTEWANNTTYGLAASILTENVARAIRMASNIEAGSISINSGPSAEPNVPFGGYKQSGIGRELGQYALDTYTQVKAVHINLGQKL

SEQ ID NO: 3129 - protein, 543 aa, Agaricus bisporus
  var. bisporus
  strain H97 / ATCC MYA-4626 / FGSC 10389
MVAFRRGASYGRKYLSTAETFDGACLQEGVLLPQIHDQLWANLTTTFGSHDYQSKAITWLSEAIQVRTITNDAMGAIGVDTDWKEFTRFHEYLEKAFPLVYSNLKVTKVNTYGIIYEWKGASPGLKPILLAAHQDVVPVDENTIHQWHYRPFDGHFDGEKIWGRGASDDKCGLIGVLIALETLISHEYRPARGIVLASGFDEEIGGLRGAATLAPVLQELYKDGFAFVIDEGTGFGKKFGTNFAMVGTAEKGATNVEVKVASAGGHSSLPPDHTSIGMLSAMLTHLESNPSELEFSRAHPFYGTLQCFATHAENMPSDYRKLIIASATSDGAMRKLIETISQDHLLKNFIGTTQAINVIKGGIKANALPEQAAAIVNHRISVTSNLTETKGRYVWLLKDFASQFDLSFTAFGEVIAEGSKGSLTVGEPFHQGLEPAPITSSDKPPYRLLSGTIKATFNSHRGLTGVNNIAVVPGTMPGNTDTRFYWNLSPYIFRYNHQNFGDVLDSVPKGMHTVNEYTEADSFMEMIEFFTMLILNADESTHL

SEQ ID NO: 3130 - protein, 551 aa, Agaricus bisporus
  var. bisporus
  strain H97 / ATCC MYA-4626 / FGSC 10389
MASERQIEELPSYKYAYILTASACLGSVFHGWDVGLIGGILSLRSFQEYLGINTKNAVKKAILDGNIISVLQAGCFFGALGTGYLSSRFGRRPCLIASGIVYITGGLLQCTVGLGPSQAAALHVFYIGRFISGIGVGMVSTLVPLYISECVPRTIRGRCTGTLQFATNSGLMLGFWVNYSVSKNVPFGEMQWRIPLIIQMIPSLLFIIAMFFQPESPRWLVEHGKHKEAATVLARTGGKDVDHPSVVQTLEEIKQEFVASKQPSFLKQIRLVGESRAVALRCFIPPLVMFFQQWTGTNAINLYSPEVFRHLGIHGTSGALFATGVYGVVKVVSVALALTFAVERFGRKRGLIFGGIGQALMMFWLGGYSATHQDGTVSPASHVSIVALYLYGAFFSMGWGPLPWVVAGEVAPNHVRSFALSIAVGTHWLFGFVISKVTPIMLDRIKYGTFLLFGFCCMIVATWAYFCLPETSGFALEDIKYLFERDVIIRSLQDAPGGKIFLGGRRVESVASLKERRVGVAGEQGEKITGLNSELEDVSSKKSTLKETSSV

SEQ ID NO: 3131 - protein, 720 aa, Agaricus bisporus; identical to SEQ ID NO: 828
  var. bisporus
  strain H97 / ATCC MYA-4626 / FGSC 10389

SEQ ID NO: 3132 - protein, 1020 aa, Agaricus bisporus
  var. bisporus
  strain H97 / ATCC MYA-4626 / FGSC 10389
MSKRLSGIFTRQPSTSTGAGNNDDFVPPQTPKSMNNLRAQLKRGTISQPSAVAAVVDAVRHKNAIDDRKLLLEHALALISNMEEGSMATAAKNKIIQLFYSDLTHPASTSLGPKFAWRAPDGARNNPDLPDMGRAGTPYSRSVQQTHPLPADQLPDPGLVFDTLLRRESFVEHPGGLSAMMFSFAALVIHSVFRTSHRDVYINETSSYVDLSPLYGHNEDVQKKVRAYNGLGYLHPDTFGEDRLRFLPPAYIAKKLYEINERGTYKDPANLTPDKRGDQDEEIFQTARLVNCGWFGMIVFSDYFSAILGLVRYGNNWSLLPFDEIRQDDHTLYERGKGNVVSVEFNCLYRWHATTSKSDEEWTMQAFRKIFGPDAKPEDFTPEDFKKIAKQAITAKPDPSTWTIGGLERQADGSFRDEDLANVLQNATEDPAARFGARGIPASMRLHEIMGLEQSRAWGVCSLNEFRRFLGLKVAKCAEKLYGNIENLELYVGLQAEEAKPLMEGAGLCPGYTISRAILSDAIALTRGDRFFTHDFTPYNLTAWGFADCQRDPGAFGFGSTMGRLLLRTLPDHYSENSVYTFFPFMTPKSMHTNLENIGVLKQYDLDRPSVRPSSVTFSDYKDVAHILESTADFDVVYKEHASRVIKGSGFYPVEDEKARNDVINALSGSPKLVDSIGRYFYETTQKLILENSFTFVGGETFGIDLIKYVVREVPVHWAATDVAGIQLKTKENPCGEYTPTELFDILSDIYSFIFIDIEPSKVRVLQYKVEKHIKDLLDLIEIHLGVGNRFTINGIIGTVSSFFHKSKRSEEHHEIVKRIDELGYSTDQLANTILAIMVSSVGLSLTLTNIINLYLGSDHDDTLKKLARHDDPQVFTGFVYEGLRLDPAFQGYYRVATKDQTIGKNELKKGDRVFADIGSANLNEKMFSEPSKVDPSRSTSACIFGDGPLRFLGETLTVKITSQVLRAIYAYNNVRRAPGASGKLKRFTEGSHPQYHFAYLDRDFKISPWPTSLTIQYDA

SEQ ID NO: 3133 - protein, 1149 aa, Agaricus bisporus
  var. bisporus
  strain H97 / ATCC MYA-4626 / FGSC 10389
MNCDHHPSSSSYAELNHGAGAKWSKGLARQRLDNFLGGHFSDVNLSSVLFTHRLDGPDFVKLKVWSAPGLSKPSFEEAMKQKFRTVKKTNHWWKVSVTIPEYFKQYERVQFEFDPGCEAMIYTVDGIPLQGITGGFGGDRRVEYIIPQEAREQCYHEFVVESSCNGMFGVPWNGDTIQPPDMNRFFTLASADLVVPNQEAWRLLWDFQTLKELIDTLPGNTPLQNKALVVANEIMNLLKRGDVSSVAACRKKAEEIFGEGWESKGAGIYEEGPKNSNIWGIGHCHIDSAWLWPYSVTQQKVARSWSTQVDLMERYPEHRFTCSSAQQYKWLELLYPPLFDRVKEKVLEGKFHTVGGSWVENDSNMPSGEALIRQFLFGQRYFESRFGKRCDTAWLPDSFGLTGSLPQLIRGSGMKYFFTQKLSWNNINVFPHSTFNWVGIDGTQVLCHMTPVETYTAQATVGDINKGLTNHKNLESNDTALLVFGNGDGGGGPLPKMLENLRRIRAVTNTHRELPPVSMGHSVEEFFEDIEESTEAGKALPNWNGELYLEFHRGTYTSHGSIKKGNRHSEILLRDLEHVSTLASLYKSEYAYPKGKIDENWEKVLLNQFHDVLPGSAIGMVYNDAEKLYAEVKASGESLLDDALSVLFPDSLPLGLPKHKYSRSSYSRLIGYNMTFLPRWDIIKIPLQSANSALKAQIMQASDDGKEGYAVMTSGNGSQVGQVRSPSSALHAKLLPTSVYTNGSDHFVLRNSSVQLTISKGRITSLLDVKLNRELIAEGQTGGFVIFEDRPNYWDAWDVEIHHLQTARQLEFSDVTVLTQGPLRASVKAEIRYGQSLVTATISLDAIPATTKANSRSLFNFETVVDWHQRHEFLKFEVPLDIHNPNATYEMQFGYVQRPTHKNTSWDIAKFEVCGHKYADLSEFGYGVAILSESKYGFSCIGNVLRISLLRAATAPDAEQDQGLHQFSFALLPHEGSFYESDVPQAAYLYNSPLRVRVLPNGGDSVMRSLLESPFTLTGARNVILETVKRGEDDDFNASLTEPESGTATVVLRLYEAFGGHGKVQLNISRHLPIAKAFATNFLEDEEQELTIDRNSNGNNGDDDLTAPGCSMSLNFRGFEVKTIKLVIGAPPHTPFSPNTKESVSSTAL

SEQ ID NO: 3134 - protein, 143 aa, Agaricus bisporus
  var. bisporus
  strain H97 / ATCC MYA-4626 / FGSC 10389
MTYTISIRVYQTTPKGFFRPVERTNWKYANGGTWDEVRGEYVLTMGGSGTSGSLRFVSSDTDESFVATFGVHNYKRWCDIVTNLTNEQTALVINQEYYGVPERDQARENQLTSYNVANAKGRRFAIEYTVTEGDNLKANLIIG

SEQ ID NO: 3135 - protein, 172 aa, Agaricus bisporus
  var. bisporus
  strain H97 / ATCC MYA-4626 / FGSC 10389
MFSKLLFALFTMIMTHTAVAQSLWPQSGNFLIVSRTNGNQALAVRDGSTTPGANIIVTDPFSTQTGASVWHYEFDNMLINRRSRLALSVHKFNATSGVSIGTKVVQEQVNTSSTAMVQQWNYFAGSGQIHPSFAGDLCVTAGRQLNGGIATIERCVAGRVEQSWTVTRLPSS

SEQ ID NO: 3136 - protein, 259 aa, Agaricus bisporus
  var. bisporus
  strain H97 / ATCC MYA-4626 / FGSC 10389
MAVGKNNCRTSVSRRVRKVSRRRSSTPSPAKWYDIKAPSIFEVRNVGKTLVNKSVGLKNANDSLRGRVIEVSLGDLNKDEEQSFRKIKLRVDEIQGKNCLTNFHGMDFTSDKLRSLVRKWQTLIEAHIDVKTTDGYLLRLFAIGFTKRRPSQVKKTTYAQTSQVREIRKKMFEIMSREATSCDLKELVQKFVPEAIGREIEKASRSIYPLQNVYIRKAKILKSPKFDVSKLLELHGESTDETGTRVVKEFKEPAPQESV

SEQ ID NO: 3137 - protein, 314 aa, Agaricus bisporus; identical to SEQ ID NO: 599
  var. bisporus
  strain H97 / ATCC MYA-4626 / FGSC 10389

SEQ ID NO: 3138 - protein, 314 aa, Agaricus bisporus
  var. bisporus
  strain H97 / ATCC MYA-4626 / FGSC 10389
MLYQPIEPYETGTIKVSDIHTLYYEISGKKDGNPVVFLHGGPGGGTNASDRTFFNPDKYKIVLLDQRGAGNSTPSACLEENTTWDLVSDIEKLRAKLDIEKWHVFGGSWGSTLSLAYAQSHPDRIKSLVLRGIFTLRKSELRFFYQDGASHIFPDAWDEYLAPIPESEREDLISAYHKRLNSDDEDTRIKAATAWSKWEMWTSKLHVDPVHIAHADDSKFANAFARIENHYFVNGGFMRDGQLLEKQSVDKIRHIPTVIVQGRYDVVCPATTAYALKKVFPEATLHIVPDAGHSAREPGISKLLVEATDKFADL

SEQ ID NO: 3139 - protein, 413 aa, Agaricus bisporus
  var. bisporus
  strain H97 / ATCC MYA-4626 / FGSC 10389
MLLTLVPVVVGLLPFVAQAKVHKLKLQKLAPVSSNPQLEGSWLAEKYGAPAQPQAPLMGAGGTGRRIAHPSQQDDETLLWTQEHQVQGGHGVPLSNFMNAQYFTEIQIGSPPQTFKVILDTGSSNLWVPSVKCTSIACFLHTKYDSGQSSTYKANGSTFEIQYGSGAMEGFVSQDQLQIGDLTIKGQDFAEATKEPGLAFAFGKFDGILGLGYDTISVNHIVPPFYKMIEQNLLDERVFSFRLGSSDEDGGEAVFGGIDESAYKGKMHYVPIRQKAYWEVQLDKISLGGEELELENTGAAIDTGTSLIALPSDMAEMLNTQIGAKKSWNGQYTIDCAKVASLPELTFHFGGRAFPLKGEDYVLNVQGSCISSFTGLDINLPWGSLWIIGDVFLRRYYTVYDLGRDAVGFAESA

SEQ ID NO: 3140 - protein, 530 aa, Agaricus bisporus
  var. bisporus
  strain H97 / ATCC MYA-4626 / FGSC 10389
MSRFVRPSKYRHVFGQLAKKEHGLENVKVTNSAWDTNLISASGKYLSVNWNASGGGAFAILPLISPFHGINGFPHKLPDQLPLARSHSAPVLDTDWSPHNDSIVASGGEDGKAMIWKVEPSQFEGWNTEGWVPEDFDPVLRIDASPRKIGQVLFHPTAAQVLATVSGEYTIKLWDLAAPEDPRITLSGHGDSVQGLAFNTTGTLLATTCRDRKIRMFDPRTGGQAVRVTDGHSGIKGARVVWMGEHDRIATTGFSKMSDRQVSIWETGSLNNLKTMTIDQSSGVTMPFWSDNNILFLAGKGDGNIRYYEYESDNLFALAEYKSSDPQRGVCFLPRRALNVAECEIARAYKVVSSGIEPIAFIVPRKADGFQSDIFPSAPSLEPSLSASEFFSGKLAPANLINLGDGSITSGSQPSASPAPAPAPISSPPVSREPTVSVPAPAPVRAPSPTFAPAQRSASPLPSSSPPHRSTTSDIQMGSGEDTSSPLKEENSRLTTELRDAREKIRNLELQVESLRANARKAAQALQMDI

SEQ ID NO: 3141 - protein, 546 aa, Agaricus bisporus
  var. bisporus
  strain H97 / ATCC MYA-4626 / FGSC 10389
MVKTIAVLDESELQDGQMKEVDFDSGKVLLSRLGDRIQATSAWCTHYGAPLSKGVLVADGRVVCPWHGACFNVCTGDIEDAPALAAIHSFKTHVADGKIHVSAHPENTLKDNMRRYPGLLNEDTSFKKGLIIVGGGAGAFFAVDSLREYGYKLPITILSKEPHAPIDRTKLSKALITDPTGIILRTPADLKIKYGTTLRLGVEVTSIDPKKKTVTIDNADTLTYEKLILAPGGIPRRLPIEGADLENVFTLRGVEDAKKIDAAAQEGKRAVVIGSSFISMELVVAFGKRKLASIDVIGMEEFPFEAVLGKEVGGGQKKYHESQGIKFHMQTKVEKIVPKEDNPKLAGGVVVNGTTIPADFVIMGVGVRPATDFLKGSGIEIEKDGSVRVDEYLRVRTGADTENIYAIGDIATYPAPAGVEKRIEHWDVAGNHGRAAGKHICGKTVPFGTVPIFWSAQGGQLRYCGSSSKIDDVIVQGDPSQNKFIAFHVENGSVVAVSSMQNDPIVTKSSQLLKVGLMPTPEELRAGKDVMSIDISTKDALKNVTS

SEQ ID NO: 3142 - protein, 565 aa, Agaricus bisporus
  var. bisporus
  strain H97 / ATCC MYA-4626 / FGSC 10389
MSYPVKEIQTKPYEGQKPGTSGLRKRVKIFQQEHYTENFVQSIFDSIDAKGSTIVLGGDGRYFSQDAVQIILRIGSANGVSKFIIGKDGIFSTPAASNIIRKYKTTGGILLTASHNPGGPNNDFGIKYNVSNGGPAPENVTNTIFEKTKTISSYRVIDAPPLDLSKIGETTFGPTKVVIIDSVTDYLILLKEIFDFSLIKSFLQQHKNDFKVLFDGLHGVTGPYARAIFVETLGLAESSIQNCVPLPDFGGGHPDPNLTYAHSLVEAVEEGNIQFGAASDGDGDRNMIYGKGAFVTPSDSVAVIAQWADAIPYFKKGGVKGLARSMPTSKAIDLVAQKKGLEYFEVPTGWKFFGNLMDAGRLSICGEESFGTGSDHIREKDGLWAVVAWLNILAAANANSPNKLIGINDLLKEFYSIYGRSFFSRYDYEEVSSEGANSLVANLDQALTSGSLNNTEHVSASTSNKFVISGLYNFEYTDPIDHSVSKNQGHVITFSDGSRVVFRLSGTGSQGATVRMYVERYLAPNAPAEELNKSAAEGLKGLIEVALEVSKLKHYLGRDEPTVIT

SEQ ID NO: 3143 - protein, 574 aa, Agaricus bisporus
  var. bisporus
  strain H97 / ATCC MYA-4626 / FGSC 10389
MRISSAFLWTSLALSWGAYAQSSSVDAYLAAESPIAKAGLLANIGPSGSKSAGAKAGIVIASPSHSDPDYLFTWTRDASLVFAVIIDQYTLGLDTSLRSHIDNFVSSQKIIQQVSNPSGTISTGGLGEPKFNIDETAFTGSWGRPQRDGPALRANALITWSNHLLKQNNASYVTGTLWPIIKLDLDYIKNTWNQSSFDLWEEVSSSSFFTTAVQHRSLRQGAALATAIRETSVVADYTKQADNLLCFMQSYWNTAGYMTANTGGGRTGKDANTVLASIHTFDAAAGCDAATFQPCSDRALANLVAYVNAFRSIYAINSGVPSNIGIATGRYAEDVYFGGNPWYLTTLAVAEQLYDALIVWKNQGSITVTNLSKPFFSLFSSGISTGTFSSSSSTFNTLITGVQNYADSFVNVVAKHTPSGGGLAEQYSRNDGNPLSAFDLTWSYASLLTADGARNGVVPASWGAKGLTVPGTCSGNSGPTAHVTFNVNAETVFGENIFVTGSVGALANWSPDNAIALNADNYPIWSVAIDIPASTNVEYKYIRKFNGGVTWESDPNRRFTSPASGSSTLNDVWR

SEQ ID NO: 3144 - protein, 609 aa, Agaricus bisporus
  var. bisporus
  strain H97 / ATCC MYA-4626 / FGSC 10389
MVESAKTYDIIFAGGGAVACIIAARLAVADPSLKILVLEAGPHSRNNQDHEQPARYYPTLVRCGETFTPHVPKANPKLNGRLASTVTGRCLGGGSTVNFTVYCRAAASDYDDWEAVYGNKGWGSKSLIPLLRKAETYQGVTTNDTHGKAGPLKVSFAKADHNLANEWLGVTAAFDQDRGQIDDLNALYACDGYGRWARFINGKTGKRSDTASAYIYPILDTHKNLDVQVRKRVVRVIFEGKRAVGVEYVDDEGDHAHALQSPSVARASRLVVLCAGAFGSPAILERSGIGSTNILSKNDVQQIVDLPGVGEHLMDHNGIFPHYLAADYGDTLDDIWWGSEAEIKPLVDRWSKTGQGLLAHNGMDAGIRLRPTVDDLKEIGPSFTKRWNEYFANAPDKPIMLMAIITGHLGAAPTVPRQKLYNVCSYTAYPMSKGYAHITSGVNPYAVLDYDPCYLHEEADLHVLRWAYKHSREIARRMPAYRGELVTSHPKFPEGSEAAAKASNRPVPIDAPKIKYTEADDRAIDEHVKNIMSSTWHSCGTCAMKPREQGGVVDDRLNVYGVEGLKVADMSIIPGNVSANTYNTAIAIGEKAAVIIAQEFGIKGVAESD

SEQ ID NO: 3145 - protein, 614 aa, Agaricus bisporus
  var. bisporus
  strain H97 / ATCC MYA-4626 / FGSC 10389
MDAKKGMHPVNTTLRLQNIRRLMREGDASVDAYVVPSEDQHSSEYLAECDSRRAYISGFNGSAGCAIVTLTEAYLFTDGRYFLQAEKQLDSNWTLMKQGLPDVPTWQEFLYKKLPKNSKIGVDATLIAAQDAESLHKHLEPNGSKLVSVTKNLVDEVWSDRPARRLNPVIHLDEKYSGQSSADKIAKVREEMKKKKAKAMVVTMLDEVAWLFNLRGSDIDFNPVFFSYAVVTENKVSLFVNANQLDQGAHKYLDGVTDLHPYEEFLPTLNELAGGLQLDKENPIWVGDRASLAVTEAIGKDCYLIARSPLNDLKAIKNATELEGFRQSHIRDGVALARYFAWLEEQLENGVVLNESQGADQLRNFRSELDLFKGLSFETISSTGPNGAVIHYSPDPEDCAVIRKDQIYLCDSGGQYLDGTTDVTRTWHFGTPTKAEKNAFTRVLQGHIAIDTAVFPTGTTGFVIDSWARRHLWQDGLDYRHGTGHGVGHFLNVHEGPHGVGVRIAYNAVPLKAGMTLSNEPGYYEDGQYGVRLENIVLVKDVKLANNFANKGFLGFESVTMCPMHKKLMDMELLNVNEKKWVDNYHAQVWEKVSPLLKHDKRALEWLRRETAPL

SEQ ID NO: 3146 - protein, 993 aa, Agaricus bisporus
  var. bisporus
  strain H97 / ATCC MYA-4626 / FGSC 10389
MSNVEKEPGPQGTTPPEPEPQQPVKRKREYKDFGEDEEKPTHANVDMSTIELKAEDLYDKEKVDLETIVIEDVFKLLQCDENGLSPEEAVRRIELFGPNKLEQDEQNAFLQFLSFMWNPLSWVMEAAAVVAIILSNGEHRAPDWEDFVGIVLLLFINSAIGFYEERNAGNAVKALMDSLAPKAKVKRSGSWSEIESSDLVPGDMVAFKIGDIVPADCRLTEAINVSIDQAALTGESLPQAKKAGDQCFSGSTCKQGEAEGVVIATGSNTFFGRAASLVGQDDDTTGHLQKILAQIGAFCLVTIGIFVIAEIFTLYAGFRFAYRRGLDNILVLLIGGIPIAMPTVLSVTLAVGAQQLAKYKAIVTRITAIEELAGVTILCSDKTGTLTTNKLTIDRNTIRTYGPFSADDVVLLSAYASRTENQDAIDASVISALGDPSRARAGIKLLDFKPFNPVDKRTEITYLEESTGKLKRVTKGMTGIIIELCSRNKTDDVENKLEADVEEYASRGLRALAVAYEELDGDNPEAEGNGFELIGLLAIFDPPRTDTKQTIDDALALGVKVKMVTGDQLAIAKETGRRLGLGDHMYPAKVLKDGPAAGGRHASLDDMILDADGFAGVFPEHKYEIVKRLQGLGHLCAMTGDGANDAPALSRANVGIAVEGATDAARGAADIVLTEPGLSTIVHAIRQSRIIFQRMRNYSIYACAVTIRIVVCFAILAFAYRMDFPPFMILIIALLNDGTIMTLSVDRVLPSMHPDSWDLIEIFSFAIAYGLYLTGSTVALVNIIMETTFFQDRFGVRFTNNAYYPANANDPQVHMIVYLQVAIISQALIFITRSHGFFFMERPSVALLAAFCIAQLVSSIIAAYADWGFSAIEPISGGWIGIVWVWNIVWFIPLDWIKFAMKATVIKSIRRRRENKLAKEAAHGVPLTLTTSRATSMHESLYSNRVNFIKRAARRVGLGGKVSVQPEELQRFSSIQAQRVGATLARNPSRTPA

SEQ ID NO: 3147 - protein, 108 aa, Agaricus bisporus
  var. bisporus
  strain H97 / ATCC MYA-4626 / FGSC 10389
MYVECEIVSNLICDARSQLSTDEQKAIVAGLSDPNQVQASGIRAGGQKFLTIRADPERIYGKKQADGIIIVKTAQTVIVVEYAAPVQAPEATAHVEKYAQDHLISKGY

SEQ ID NO: 3148 - protein, 113 aa, Agaricus bisporus
  var. bisporus
  strain H97 / ATCC MYA-4626 / FGSC 10389
QPKAAASKTPAVKHKFVIDYSKPAADGVFDGADFEKFLHDRIKVEGKAGQLGDHVKITRDGNTKITVTSNIPFSKRYLKYLTKKFLKKNTLRDWIRVVASSKDNYQLRFYNIA

SEQ ID NO: 3149 - protein, 130 aa, Agaricus bisporus; identical to SEQ ID NO: 541
  var. bisporus
  strain H97 / ATCC MYA-4626 / FGSC 10389

SEQ ID NO: 3150 - protein, 142 aa, Agaricus bisporus; identical to SEQ ID NO: 543
  var. bisporus
  strain H97 / ATCC MYA-4626 / FGSC 10389

SEQ ID NO: 3151 - protein, 161 aa, Agaricus bisporus
  var. bisporus
  strain H97 / ATCC MYA-4626 / FGSC 10389
MSQAVPSEISPLAQLPPICSKLLEAKARKGLTFDQVAKVIGKDEVWVAAAFYAQAKFTADELRKVSEALDLPSAQALSEIGDHWWPNRGIGPTPPTDPVLYRLYEAVLVYGTPIKAVIHEKFGDGIMSMIDCKINVDRKADPKGDRVVLTIDGKFLPYARW

SEQ ID NO: 3152 - protein, 170 aa, Agaricus bisporus
  var. bisporus
  strain H97 / ATCC MYA-4626 / FGSC 10389
MGIQEFQVIGRHLPTESDPNPKIYRMRIFAPNEVVAKSRFWYFLRQLSKVKKASGEIIGVNVILEKRPLRVKNFGIWLRYDSRSGTHNMYKEFRELSRADAVKSLYQDMAARHRARFRSIHILRVVEVEKADDIRRPYIKQLLTPNLKFPLPHRIRKARSTFVAKRPSTF

SEQ ID NO: 3153 - protein, 189 aa, Agaricus bisporus
  var. bisporus
  strain H97 / ATCC MYA-4626 / FGSC 10389
MVRYAAAALATNPEKTAKARGEYLRTHFKNMREVAAALTGQKLTKAYAYLSDVKDHKRVIPFRHFSGGVGRTGQAKEFKTTQGRWPEKSIKFITRLLKNAESNAEFKNIDVDDLFIKNIVVQQAPKTRRRTYRAHGRINPYQGHPAHVEIILAASETEVEKATDKVVPSGLGGLNRRQVARKRIEAGRA

SEQ ID NO: 3154 - protein, 203 aa, Agaricus bisporus
  var. bisporus
  strain H97 / ATCC MYA-4626 / FGSC 10389
MATVTTLPKDISKLGQEIKLFGKWDTQDVDVKDISLADYIQVRHAVYLPHTAGRYAKKQFKKAQMPIVERLVDSLMMKGRNNGKKLLAVRIVAHAFEIIHLLTDQNPIQVLVDAIVNTGPREDSTRIGSQGTVRRQAVDVSPLRRVNQAISLLTVGTRESAFRNVKSIAECLADELINAAKGSSNSYAIKKKDELERVAKSNR

SEQ ID NO: 3155 - protein, 228 aa, Agaricus bisporus
  var. bisporus
  strain H97 / ATCC MYA-4626 / FGSC 10389
MSQPPILLYTSTTPNGYPISMHLDELKAVYSTFGGYEYEIQICGQGLRHLDERSKEDWFIKLNPNGRIPTIVDRSRNNFSVFETSAILLYLSQHYDPDFKFWFDPIKDADNYSEMLQWIFFAHGGIGPMQGQAHHFAMRAPEDIPYAKNRYIDETKRLYNVLEIRLKERDYLAGSGRGKYSLADLKTFPWVRIHAKAITPTLDEFPNVKAWVQRIEERPATVTGVKVG

SEQ ID NO: 3156 - protein, 244 aa, Agaricus bisporus
  var. bisporus
  strain H97 / ATCC MYA-4626 / FGSC 10389
MITFYDLTKKSPQTTWSPNPFKTRFSLNYKKLPYNIVNLEYLELEPEFKKVGIPASSTWADGRPLYSSPSIFDSSTNTGVADSYQIAQYLDKTYPDTPKLFPPGTEALQAAFYARFSELLGPFFPFLLPKVPGLLNPESAEYFNRTRAVRFGKPLADLEPKGQDRVEAWKNVEAAYNTLYGWLSQSKGPFFMGDTITFADFAVGGMIYATEVCIGKDSKEFKDLMTWNNGRWAEFRKSLEQYAK

SEQ ID NO: 3157 - protein, 265 aa, Agaricus bisporus
  var. bisporus
  strain H97 / ATCC MYA-4626 / FGSC 10389
MCFPSKRQKNNFADKSTDPKSVSDTNTKGEAKATEPVQAPEPIQAPEPTSSDPVSTFTLHSSTTMPRVAIVIYSMYGHIATMAEAVKAGIVKAGGKVDIYQVPETLSNEILVKMKAPAKPSYPVIQPEGLTEYDAFLFGIPTRYGTMPAQWKAFWDATGGLWAAGKLAGKYAGIFVSTGTQNGGQETTALTTLTTLTHHGIIFVPFGYSHAFAEFSSFETVRGGSPWGAGTYAGHDGSRSPVPLELTIAEKHGKSFWEIVSKVNF

SEQ ID NO: 3158 - protein, 246 aa, Agaricus bisporus; identical to SEQ ID NO: 507
  var. bisporus
  strain H97 / ATCC MYA-4626 / FGSC 10389

SEQ ID NO: 3159 - protein, 263 aa, Agaricus bisporus
  var. bisporus
  strain H97 / ATCC MYA-4626 / FGSC 10389
MSRTSYDRFLTVFSPEGRLYQVEYAFKAISGSGHTAIAIRGKDTAVVITQRKVPDKLLDASTVTHLFSITPTIGCVMTGLIADAHAQVARARSEAADFRYKFGYEITPDALARRIANINQVYTQRAAMRPLGISMILIGVDPEFGPQCFRLDPAGYFVGYHATAAGQKQQEAMNQLEKKWKKLDSGRGADEPAKAGQTLSRSEVIEMAIEIMSTVHATDYKPGEIEVGIVSAGEEEDLKTRGQWRVMGEAEIERHLLAYAEKD

SEQ ID NO: 3160 - protein, 289 aa, Agaricus bisporus
  var. bisporus
  strain H97 / ATCC MYA-4626 / FGSC 10389
MSDNSQGVAAALSGANPARTVLSSFLLCDRVALVTGAQRGIGLEMSLALAEAGAIVYCLDLPANADADWLKVQEYVTKLPDIAPGVNNKGRLEYVSGDVTDQQKMWDIAEDIVKKEGRLDICVANAGILRGFECLEYPAEEFRKLLDVNINGVLFTAQAAGRQMEKLDLPGSIIITASMSGSIANYGQHWVAYNTSKSAVIQMARSMACELGPKKIRVNTISPGYIYTQMTKDFLDPRPELKQQWSLQNPLHRIGRPDELRGATLWLASDASTYCTGSDIIVDGGHRAW

SEQ ID NO: 3161 - protein, 301 aa, Agaricus bisporus
  var. bisporus
  strain H97 / ATCC MYA-4626 / FGSC 10389
MPIATLPIPNSVRVALMVCDELPSHSNHGSMFERYRMWLQRSLPPNSKFILKMIAYDVRKQDYPTAEELRKFFDVVVVTASRADAAGQDSWIRRLTCFVQHVHNKSPHIRIYGNGFGHEIIGRALGGVVTDNGRWEYGWKPIKLTEFGKMVFGAKPFGLQQIHRDHVALDTLSDHFSSGSILLLGSTAKTANQGFVKVYQYCEECEFQGRIHGVHQHIHVMTVQGHPELTDFVVTKVVHHLAEEGILKEEAAKKYTGSESAEEPVSDENMPRLKWPGDDDGISVVGKAFWKMFGVKYHDDM

SEQ ID NO: 3162 - protein, 308 aa, Agaricus bisporus; identical to SEQ ID NO: 601
  var. bisporus
  strain H97 / ATCC MYA-4626 / FGSC 10389

SEQ ID NO: 3163 - protein, 323 aa, Agaricus bisporus
  var. bisporus
  strain H97 / ATCC MYA-4626 / FGSC 10389
MTTSLDQLKQTGTVVVSDSGDFESIDVYKPQDATTNPSLILAAANKPGYARLIDAATKYAKDKGGDLDAQVNNAMDRLLVEFGKEILMIIPGRVSTEVDARLSFDKEATKAKAKQLIALYESVGVSRDRVLVKMASTWEGIQAARELEKEDGIHCNLTLLFGFGQAVACAEAGVTLISPFVGRILDWYKKSTGKNYEGDEDPGVQSVKKIFSYYKQHGYKTIVMGASFRNVGEIKALAGVDFLTISPALLEELKNSTAPVPKKLDSTAKQVSIPKVSFVNNEAEFRWALLQEQMAFDKLHEGIKKFAEDGETLKEVLRKKLSA

SEQ ID NO: 3164 - protein, 344 aa, Agaricus bisporus
  var. bisporus
  strain H97 / ATCC MYA-4626 / FGSC 10389
MPQGSMKALWYSAPKQFDIRDVPIPKVGDDDVLLKVSVCGICGTDAHIDEGEFMAKFPLIPGHEAVGTVVEMGKNVKGFAIGDRCVADVGITCDTCFYCRRGNSLLCENFRACGVAEDGGFAEYIVYQQKKLYKIKNLTDEEATLLEPAACAVHGLDKLNPGVGIEVLLMGAGPTGLILAQLLKQNGASRIVIAANKGIKMDIAKNLNAADEYIELDRQNPGAQWQKLKDDNPYGFDVVVEATGVEKLANESINYVRRGGTLMIYGVYENKALVHWPPSKIFGDEIRIIGSFSQTYCFPRAVAYLDSGKINVKGMVTDIFKLEDYRLALEKMSSRGALKIAIKP

SEQ ID NO: 3165 - protein, 392 aa, Agaricus bisporus
  var. bisporus
  strain H97 / ATCC MYA-4626 / FGSC 10389
MSETPGEAVPAAQRGSWSSFLKSIASFSGDLSSLTAPPFILSPTSLTEFPAYWCERPDLFSAIADAKDPQARALAILRWFISTLKDQYTSRNELMGSEKKPLNPALGELFYAHWPDRNGRGQINLLVEQVSHHPPVTAYVIENKVKGVQLVGHNAQKTSFSSGSIIVKQIGHAVLTVGKEEYVITLPKLRIDGLWYGSPYVELTDTTYIIGGGFMSTIEYKGKGYFTGKSHTFKATVAPLPGMGGSSQEHVVEGLWHEKSKFTKGPFNGDVFHDVETTSKENATVIGGEADGSQGAFETRKLWNLVAKGIREGDYELASREKSRIENDQRQRRKDEAAAGTKWELKHFKHEDSDPLYERLGRLAKITPSEEDFYGFLVNWPEALTKPAGNDK

SEQ ID NO: 3166 - protein, 418 aa, Agaricus bisporus
  var. bisporus
  strain H97 / ATCC MYA-4626 / FGSC 10389
MDNNVPVLLQLPGENPSLKLEILPRGLTIHRLLVQDNGRENDIVIGPEKPEGHITQKYTNSIVGRYANRVPVGKHILNRNGIQSEFEAKANENPQVSLHGGPTGFDSVVWTVLGTEEKPLLFSNTEIERIHALPAKTFALFRLISPDGDQGYPGELLTEVLMALVPSTSGHSSITKLGHVVIAYRSKLADGKAGVTPVNLTQHWGFNMNASLSDRLGTEIATIKDHVIRIEADDIAKRDKLSLPTGDYTPVSSAPVYDFRKSKEIGKDFPEGGYDDYFRLNSSAIYPTPKHIRLSDLETWNSLDAILAQAPLNAASAVQLASEKTRIALDFFSNQRGLMFYTNDLADPAKGARKLIHGGSGISGHGDAYGPGTAVFLEFHDPLAAFLQPENRDADDTMITSEELYNNFVRLEIGFMNA

SEQ ID NO: 3167 - protein, 492 aa, Agaricus bisporus
  var. bisporus
  strain H97 / ATCC MYA-4626 / FGSC 10389
MTRIIVSLLAVSAALASPLSTAHNDFSSRSSLSLAPLVDEFHPHGTVNNSYIVIFKNDVPFDLIANHMSFLHDAHAEDPLVDDFAGVRQVYDGHLNGYAGRFTRNVVDRLRTMPEVAYIEKDQIVHTTEHVTQTGAPWGLARVSHRPELTFSTFTKYVYDSQAGQGVDAYVIDTGINVQHEEFEGRATWGKTVPQDEDEDGNGHGTHCAGTIASRKYGIAKHANVIAVKVLGSNGSGTMSDVVSGVVWAAREAKAKAVAAAKEFAATGKTKHKGSVANMSLGGGKSPALDDAVNGAVDTGLHFAVAAGNENRDACSSSPASAEKAITVGASTLGDARAYFSNYGPCVDVFGPGLNIKSTYKGGRSATAILSGTSMASPHTAGVLAYLLSIYPSKEFNPIFEKDELVSITSPVSQTSFSGIYAITHAALPQWISSFLPAPEFVDFITPIPGHPPTLTPTQLKKALIALSTPDMLDDLPANTVNLLLFNNATHS

SEQ ID NO: 3168 - protein, 505 aa, Agaricus bisporus
  var. bisporus
  strain H97 / ATCC MYA-4626 / FGSC 10389
MAHIATITIAATNKQIPVPTGLFINNEFVPSVEDSPEKILAINPATEEVICPVVSASPRDIDVAVKAARQAFQTTWGKNVTGFERSRLINKLADLIERDQQELAELETLNNGKPVKIARDFDIGDTIQCLRYYAGWADKIIGQSLEVDNKTKLAFTRNDPIGVCGQIIPWNYPINMWAWKVAPALAVGCTIVMKPSELTPLTALKLSELVREAGFPPGVVNTVPSYGHVGGAALAAHPDVDKVAFTGSTVTGRKIMEAAAKSNLKKVSLELGGKSPHLIFESADLEQAASWAALGICYNTGQDCTAGSRVYVQEPIYDRFIDLLTAKVKATIMGDGFDEISTGGPIISKGQYDRVWAYIEAGKQEGAKPILGGVKRTGKGFFVDPTIFTDIHRDMKIVKEEIFGPVLSVGKFKTEDEAISLANETNYGLGAGVHSSDANQCMRVSSSLEAGTVWVNQYNLLSNNVPFGGKKQSGIGRELGSHALAEYTSVKAVHWNFGEKVDWPL

SEQ ID NO: 3169 - protein, 539 aa, Agaricus bisporus
  var. bisporus
  strain H97 / ATCC MYA-4626 / FGSC 10389
MLTSRGAVARLSKRAFNSARQTNALFSSAALPRVALPAQSQQTAGLSRPQASSSNIPARSYATESKAIVGSVKTVIGAVVDVQFDTDNLPPILNALEVQDFHGGRLVLEVASHLGENSVRTIAMDGTEGLVRGTKVIDTGAPIQIPVGKATLGRIMNVIGEPIDERGPIKGVKLSPIHAEPPAFVDQATTAEVLETGIKVVDLLAPYARGGKIGLFGGAGVGKTVLIQELINNVAKAHGGFSIFCGVGERTREGNDLYHEMIETGVINLEGDSKVALVFGQMNEPPGARARVALTGLTIAEYFRDEEGQDVLLFIDNIFRFTQAGSEVSALLGRIPSAVGYQPTLSTDMGGMQERITTTKKGSITSVQAVYVPADDLTDPAPATTFAHLDATTVLSRGIAELGIYPAVDPLDSKSRMLDPRIVGKEHYEVATAVQKILQDYKSLQDIIAILGMDELSEEDKLTVERARKIQRFMSQPFQVAQVFTGYEGKLVPLKDTVRSFKEILAGTHDGLPESAFYMAGTIEDVKSKAEQLAKDMGN

SEQ ID NO: 3170 - protein, 519 aa, Agaricus bisporus
  var. bisporus
  strain H97 / ATCC MYA-4626 / FGSC 10389
MSSPAKPVYTTSNGAPVNEPYSAQRAGFHGPLLLQDFHHIDLLAHFDRERIPERVVHAKAAGAHGYFQVTHDLSDITSQSLFQGVGKKVRITARFSTVGGESGSADTARDPRGFAIKLRTEEGNWDWVFNNTPIFFIRDPAKFAHFIHTQKRNPQTHLKDPDAFWDYLGQNPESIHQMMILFSDRGTPDGFYQEHGYSGHTFKWCKADGSFVYVQVTCRADGGFKTLDDATATRLSGENPDYGTQQMFEAIEAGNFPSWTVYIQTMTPAQAEQFRYNILDLTKVWPHKEFPLRPIGKMVLNENPQNYFAEIEQVAFSPSHLVPYIEPSADPVLQSRLFSYPDTHRHRLGANYQQLPVNAPIVPVANFQRDGPMAFVNQGNRPNYQCSFQPLTYAGRPGHMDASVNDRERDARHENFINGAWRYLSVISELDFEQPRELWSRVWNDQERETYVKNVSGHFKNVKSAEVKARQLSVWAAVDQGLSDRIADAVGHPHVAPLKCISAAEVLNFRHNIGAGSNQ

SEQ ID NO: 3171 - protein, 734 aa, Agaricus bisporus
  var. bisporus
  strain H97 / ATCC MYA-4626 / FGSC 10389
MADQQPQPHILLVDSYCSFAYSLAALCKKAIPHSVLHVIKNDTHTIRDLLPVIRQFSAIVVGPGPGSPDIPTDIGVVRDLWKVADENLVPTFGVCLGQQSLGIEYGATIHRLHTVKHGQVSVVQHTGTEFFAGLPDLKVVRYHSLHIRPHAGGDIEELAWSEDEENGRVVMGVRHITKPFWAVQYHPESVLTDEGGLKVLENFWTLAHAWNQTNRPSFTPPVEIILPQSHIWPRISQRYSAHEFNKSLGSVTYKTIQVPDISIIDLCEYLGVHDESKRFVFLDSAAYPGQHSILACLGDASSQFTHYVHENFVEITTGTLTVQQELSGKDIWTWLDEYRESRKVAGGDARVPFWGGFAGYLTYEAGFGALDIPVPRKSNHRENNHPDVNLVWVDRSIVVDTATSKIWVQSLLPEDEQWIRETAVHIAGLPRASTIPNMPSADQVTVKFPDHDQYIEDIKRSKEYLFSGDSYELCLTGQTQICVPKEAVMPAWERYKLLRTVNAAPHAGYLRLHPTTFLSCSPERFLSYSRTPGAVCQLRPIKGTVRKLPHITREVAEEMLAGSRKEIAENLMIVDLIRHDLHNAVGERVSTKKFCGVEEYETLWQLVSVIEGSLSEGTSIEVDDSLGWEVLRRSLPPGSMTGAPKKRSVELLQGIEGRERGPYSGVFGYWCAGGGGDWSVTIRSCFLHDSEKGDGEEWTIGAGGAITALSDPDAEWEETKVKLNGVLRGFGASC

SEQ ID NO: 3172 - protein, 759 aa, Agaricus bisporus
  var. bisporus
  strain H97 / ATCC MYA-4626 / FGSC 10389
MAPLSHPSIVDGWFREISSQWPGQAMTLKVNKILHVEKSLYQDVLVFESETFGNVLVLDGVIQCTERDEFSYQEMIAHLPLASHPNPKKVLVVGGGDGGVVREVLKHDTVEQVVLCDIDEAVIRVSKQYLPHMSSLLSDSRVTVHIGDGFKFLSNNQNTYDVIITDSSDPVGPAESLFQKPYFELLHNALTPGGHISTQGECQWIQLSLIQDLKRVTSEIFQTTEYAYTTIPTYPSGQIGFMVCAKAPGRDLRTSIREVKNTKYYNKDIHRTAFVLPEFTRSVLEEGKDIRPKFGRAAKAVEAEAAGRKKKRVLLLGSGFVARPCAEYVVRNPENELTIACRTLSSAKALAESLPATTAISLDVNSTDALEKAIAEHDLVISLIPYTYHAAVIRAAIKSKTHVVTTSYVNPLMRELDAEAKAAGIVVFNEIGLDPGIDHLYAVKTINEVHAKGGKIKQFLSFCGGLPAPECADNPLGYKFSWSSRGVLLALLNTASYISNSQAITVTGAELMGHAKPYYISPAFAFVGYPNRDSTPFREWYHIPEAETVLRGTLRYQGFPEFIGTLVKLGWLDQTEKEWLKEGITWKQITKNLVGAKAQDDLTEAAIVDRINAKVQFSSASEAERIVSGLRWIGTLSDEPAQIRAGNLLDTLCARLEGLMKYEVGERDLVMLQHKFVVEWADGTTQILTSTLEAYGSTVPGGYSAMALTVGVPCGITVQLVLDGVLKEPGVHAPYDYEVCEKIRKVLEIEGLGMVEKVM

SEQ ID NO: 3173 - protein, 3931 aa, Agaricus bisporus
  var. bisporus
  strain H97 / ATCC MYA-4626 / FGSC 10389
MAVPNGHAVPHAIASRPLIVAQGRVRISVPVSTKTDEWIAAEVLRDEFIHAQSLDAADASSVIEDESEATVDLAAKFLAHVASNIDNDSQSTEARIRLLLNVLKHFTSSYLATKDIHSLCASYSIDTRKTVLSAYYRAVAALENKDSSSIPRQPESALLDAAKSGKASIFALFGGQGTNEVYFNELQSLYDIYQPYVTPFLESVLPDLIGLAEDEVDSSYYTHGLDVVSWLSDATKRPSIAYLASAPLSLPLIGLTQLIQYLVVCRVANLTPGQVRSRIAGATGHSQGILSAVVISASETFDDFTENSRKALRWLFYCGLRGQQAFPPVAVEPSLVQDTLDGGEGTPSPMLSVAGLPLKDLEVHIKKTNSHLPANSQLGVSLYNGPRAFVVTGPARALHGLVTNLRKVRAPSGADQSKVPFSQRKPVFSVRFLVVGVPYHSPYLKGVTDAVMDEDLEELWEPSDLKIPVYNTETGEDMRNMTGSITRSLCDQIYTAPIHWTKATDFPETATHAIDFGPGGLSGVGPLSARNFDGRGIRVILVGDSGKGDAELYDSLSVKYEDWWSKKFAPSLVRTSDGTIHLDTPMSRLLGKPPIMVAGMTPTTVKAGFVSAILNAGYHVELAGGGHYNAKDLRAKVAEIQSKLPSGVGLTLNALYINPRQFTFQFPLWQELRREGAPVEGFCVAAGVPTTEKANEIIEGLRTAGIKHIAFKPGSVDGLRQVVNIAASNPDFPIICQWTGGRGGGHHSYEDFHQPILSTYRSLRSHSNIVLVAGSGFGDAEDIWPYLTGDWSERFGVQRMPFDGFLFASRVMVAKEAHTSSSVKDLIVAAAGVEDEQWEGTYTKPTGGVLTVRSELGEPIHKVANRAVRLWKEFDNTVFSLPKEKRAAWLSERRDEIIEKLNKDFAKPWFGEKKDGSVAKELGDMTYEETVLRLVRLMYVSKQKRWIDRSLRNLTGDWLRRVEERFAGVNTTGNKPSLLQSYASLDDPSAFVESFFEAYPLATEQLLAADDVAYFLAISQRPGQKPVPFIPVLDVSFEVWFKKDSLWAAEDIDAVFDQDPERVAILQGPVSAKGSLVKDEPIKELLGNINSSLISKLLESRYGGDESSIPTIDYLAAEPFVPATLSNVARYERGSDVVYQFGSSLPSTEDWLAALGGSELNWLHALVTSETIVQGTSYIDNPIRRLLAPRPKQRIVVGYENSLPVSITAYGAARSYGAHIPGFKAVEIKFNQSSQLIDITMFEERRDVAVPLKLQFHYQPEQGYMPIHEIVDGRNQRIKDFYWKLWYGDNEVLPNVDIKEKLVGPEVTITAEEVEEFCAVVGNQGESFKNVRNDSVQAPMDFAIVTGWQAIMRSIFPADIDGDLLKLVHLSNGFKMVEGASPLKVGDICKSEARIVSVVNAPEGKTVTVKGHVYRDDQPVIEVVSSFLYRGRFTDYENTFETTEEPDYLVPLETDAEVGVLQSKQWFGWENESTPLLAGTALIFRIQSSVFFKDRGVFRNVSVSGDVFVRNQLKVLVKVGNVDFQQDDCQGNPVLSYLQRHGTPQGLPTPLANEGYTLRHVEGSTIFNAPLTNEPYSKISGDFNPIHVNPYFSDYASLPTTITHGMWSSAATRRYVENVVAQGHPDRVLAYNVSFVGMVLPNDELEVKLKHTCMRDGNIVVAIETTNSRGEKVLVGTAEVKQPTTVYVFTGQGSQEPGMGMDLYNNSPAARAVWDGADAHLLATYGFSISEIVRDNPKEKTIYFGGIQGQAIRQRYMDMTYDTLDKDGNTKTLPLFADIDNRTPRYTFSHPNGLLFATQFAQIALVVTEKSAFEDMRAKGFVQKDCAFAGHSLGEYSALASIADVLHISALVDVVFYRGITMQRAVERDSENRSNYAMCAVNPSRISKTFSDAALREVVDMIAVKTGSLLEIVNFNVEGQQYVCAGELVALQTMTNVLNYLKVKKVDIAQLTKQFPIEKVKQMLGDIITECNQRALDQQKSQGYIILERGFATIPLPGIDVPFHSRYLWAGVLPFRAYLSKKINPATLNPDMLVGKYIPNLIAKPFAVSREYAQIIYDQTSSPRLDKVLQKWEEDNWDSSENRQMLAYIILVELLAYQFASPVRWIQTQDLLFTQYKFERLIELGPSPTLTGMASRTLKAKFESSDDSVSCTRVILCHAKNTKEVYYQYEDEPEAPAEAAPDAPAPATAVASAAPVAVAAVAVAAAGPAASIEDAPIKAIDILLVIVAQKLKKRVDEVPLSKSIKDLVGGKSTLQNEILGDLQQEFASAPEKGEELSLEELGSALSTGFSGALGKYTTSLVARLVGGKMPGGFNASAIRSYLNKTWGLGPSRADGVLLLATTLEPPKRIASEAEAKTWLDGVVQTYAQRSGISLTAPGAAAGAVGGGGGATINSEEFLKFTADQDKFIQQHIELYNRYLKKDSRAGEIAYDREKVNTLALQAKIDSITREHGDSYLDGIQPRFDPLKARHFDSSWNWVRQDALLMYYDIIFGRLTTVDRDITARCIALLNRADPDMLQYMEYHINKLDPSKGDTYKLAKDFGQQLIDNTRDIIGKSPLYKDVTFPTAPHTEVTAKGDIVYSEIVRENVRKLEAYVEEMATGDGVAGSVNIQKVQDDVLKLWTVVKSLPEINQDQKNRIKSLYEGVVRSLQKGPDPHPRVQSTRSRRSSSQFLRPHNAGVANVTADNIPLLHLKRRVAATWEYSSNLTGVYLDILHEIATSGTTFEGKNALCTGVGKGSIGVEIVKGLLSGGAHVVITTSSYSRKTVEYYQSIFQTVGSRGSALTVVPFNQASKQDVEALVDYIYNNLNMDLDYILPFAGIPENGREIDGLDDRSELAHRMMLVNLLRILGCVKNKKANRRIVTRPTQVILPLSPNHGLFGNDGLYSESKISLETLFQRWASESWGEYLCLAGAVIGWTRGTGLMAPTNIVAHELEGYGVRTFSAKEMAFNILGLMHPLLFSITQVEPIWADLNGGMDRLPDLADITTRIRTNLLKKADLRRAITKDNAADFKVTNGVEAERLLQTIDVLPRANFRFDFPELESAESLSDVTQLRGMIDLEKVVVVTGFAEVGPWGSSRTRWEMEARGELTIEGYIEMAWMMGYIKHFNGRLKDGSLYVGWVDSKSGESVDDKDVKGRYEKDILAHAGIRLIEPEIFRGYDPNRKSFNQEIELIHDLEPIEVSEVEAQKFKLQHGDKCDIWAGEDGQWFAKLKKGACVLVPKAFKFSRTVAGQIPSGWHAGRYGIPEDIIAQTDRCTLWALVCTAEALNSAGITDPYELYKYMHPSEVGTSLGSGMGGATSMAKMFKDRRDEREVQNDILQETFINTTAGWVNLLLMSSSGPVKIPVGACATALQSLEIACDTILSGKAKVMIAGGFDDISEEGSYEFANMKATSNAETEFAMGREPTEMSRPATTSRAGFMEAQGTGVHIVMSAKTALEIGAPIRGILAFTSTSTDKAGRSVPAPGKGALSVAREVPSKHPLQILDVKYRSRQLAFRRTQISQWLDHEHVELQEEITSRKSEGENVDESYVASRVANLEKEAARQEKDAIAMYGMLEGSDPRVAPLRRALAVWGLNADDIGVLSIHGTSTGANEKNETQIWNDIFTTISRSRGNAVPIVAQKSLLGHSKGGSAAWQMAGLLQYVLSGVIPGNRNSDNIDSNFVDRRFLMFPSKTIYTDGIQAGVMSSFGFGQVGGTALVVHPRYLFGALEPSFYEQYKERNRTRALQSYKAMSDMMVKNSLVKIKENPPFTPENEREVLMNSMARVTCDPKTGEYSFKGKLPREAPLDLSNLKLVSDVMTAPSAATNSNIIGVGVDQELITSVPSHNPTFVARNFTEAEIAYCRAQPSPASSFAARWVGKEAVFKSLGVKSAGAAAVLKDIEILNDDAGVPSVRLHGEAQVKAQERGVANVLISLSHSETIAIAFAQASST

SEQ ID NO: 3174 - protein, 124 aa, Agaricus bisporus
  var. bisporus
  strain H97 / ATCC MYA-4626 / FGSC 10389
MSYVAKGEKEYDATGAPVPGAKIHKIRITLTSSNVKNLEKFSGDLINRAKDKQLHVKGPVRLPTKVLKITTRKTPCGEGSKTWDRYELKIHKRLIDLHASSEVVKQITSISLEPGVEVEVTISA

SEQ ID NO: 3175 - protein, 136 aa, Agaricus bisporus
  var. bisporus
  strain H97 / ATCC MYA-4626 / FGSC 10389
MPESNFKRFVEVGRVVLVNDGPLAGKIAVIAEIIDHNRAIIDGPTSGIPRQSFPYKHLLLTPLKLTKLPRAAGTGIVRKLVEQEGIVEKWDKSAWAQKRVMKEKRRSLSDFGRFKVMLAKKQRRDVVRKAVKKASA

SEQ ID NO: 3176 - protein, 147 aa, Agaricus bisporus
  var. bisporus
  strain H97 / ATCC MYA-4626 / FGSC 10389
MASQVNAVQTFGKKKACFTATAVAYAKEGRGLIRINGSPIGLVQPEILRLKVYEPVLVAGEDAFGILDIRVRVKGGGHTSQVYAIRQAIAKALVAYYAKYQDAYSSLELKKKLVAYDRSLLIADPRRMEPKKFGGGGARARRQKSYR

SEQ ID NO: 3177 - protein, 151 aa, Agaricus bisporus
  var. bisporus
  strain H97 / ATCC MYA-4626 / FGSC 10389
MGRMHAPGKGISSSALPYRRTPPSWLKTTSEEVVEQIVKLARKGLTPSQIGVTLRDSHGIPQVRFVTGNKILRILKSQGLGPSIPEDLWHLIKKAVAVRKHMETNRKDKDSKFRLILIESRIHRLARYYKTKQQIPPTFKYDSATASTLIA

SEQ ID NO: 3178 - protein, 165 aa, Agaricus bisporus
  var. bisporus
  strain H97 / ATCC MYA-4626 / FGSC 10389
MAPKFDPNEVKIIYLRATGGEVGASSALAPKIGPLGLSPKKVGEDIAKATSAWKGLRVTVQLTIQNRQAAVSVVPSASSLVIRALKEPPRDRKKEKNIKHSGNVALDEIFDIARTMRDKSLAKELSGTVKEILGTAQSVGCTVDGKPPHDVIEAIDAGEIEVPAQ

SEQ ID NO: 3179 - protein, 155 aa, Agaricus bisporus
  var. bisporus
  strain H97 / ATCC MYA-4626 / FGSC 10389
MADAQIEKAFQKQHLFQNAKARGGKKVVTRQKRWYKDVGLGFKTPSDAINGTYIDKKCPFTGDVSIRGRILTGKVLSTKMTRTIIIRRDYLRYISKYSRYEKRHTNLAAHVSPAFRVELGDTVTVGQCRPLSKTVRFNVLRVSRNKATAKSFGKF

SEQ ID NO: 3180 - protein, 158 aa, Agaricus bisporus
  var. bisporus
  strain H97 / ATCC MYA-4626 / FGSC 10389
MATTKTTKGKAAAKSAASKDNKAKAAKKAALQGAHSHSSRKTRTSVSFHRPKTLRLPREPKYERKSINHAPRMDQYRTIVSPLNTESAMKKIEEHNTLVFIVDVRANKRQIKDAVKKLYDVDAAKVNTLIRPDGKKKAYVRLTADADALDVANKIGFI

SEQ ID NO: 3181 - protein, 160 aa, Agaricus bisporus
  var. bisporus
  strain H97 / ATCC MYA-4626 / FGSC 10389
MPHSFGYRARTRQMFSRSFKEHGMIGLSTYLTNFRIGDIVDIKANAAQQKGMPHKFYHGRTGVIYNVTPSAVGVIVYKVVGNRYIEKRVNIRVEHIKHSKCRQEFLDRVKANHDAHVAARAKEERVDLKRKPAQPREARTVSTANNAPQTMRPVPYETTI

SEQ ID NO: 3182 - protein, 186 aa, Agaricus bisporus
  var. bisporus
  strain H97 / ATCC MYA-4626 / FGSC 10389
MGIDIAKHHVKKGQRTAPKSEDPYLLLLVKLYRFLARRTDSSFNKVILHRLFLSKTNRPPLSLSRIARETSKATDLDSKIIVQVGTVTDDIRLTEVPKLSIAALRFSRAAKERIIKAGGEAITLDQLALRSPLGANTILLRGVKTAREAYKHFGMGPHKHKKPHTISKGRKFEQGRGRRKSRGFKV

SEQ ID NO: 3183 - protein, 218 aa, Agaricus bisporus
  var. bisporus
  strain H97 / ATCC MYA-4626 / FGSC 10389
MSSKLSVSSVRGSVKELLAEANGEKKRKFTETVELQIGLKNYDPQRDKRFSGTVKLPHVPRPRMSICILADAADIDRAKQIDLEYMSVDDLKKLNKNKKLVKKLGKKYDAFLASETLIKQIPRLLGPGLSKAGKFPTPVSHAEDLNNKITEVRSTIKFQLKKVLCLGVAVGHVDMNDDQVLANVMLSINFLVSLLKKNWQNVKSLHIKSTMGKPIRLY

SEQ ID NO: 3184 - protein, 250 aa, Agaricus bisporus; identical to SEQ ID NO: 614
  var. bisporus
  strain H97 / ATCC MYA-4626 / FGSC 10389

SEQ ID NO: 3185 - protein, 287 aa, Agaricus bisporus
  var. bisporus
  strain H97 / ATCC MYA-4626 / FGSC 10389
MPVDRLEDKVVLRHPKGATVEVLYYGATVTSWKVQGVERLFVSANASLDGSKPVRGGIPVVFPCFGAPTHRDHMKLPQHGFARSEEWSFESIVLDNDVGVSVRLTLSPTARIASKFERNFKLAYVVTLAEHQLSTDLHVYNPSESSHDLEFQALFHNYIRAPASSVRIKPLQNLGYYDKTQQTDEGKALRRIESRAEVDVNIFTDSVYENSPGDYQVSWSGGEIDIRTKSLDNVVVWNPQEGGKKIADMEENGWERFVCVEPGYVRGFVKVSPGEKWIGQQTLTIKT

SEQ ID NO: 3186 - protein, 311 aa, Agaricus bisporus
  var. bisporus
  strain H97 / ATCC MYA-4626 / FGSC 10389
MPSLQFLPQPLTAAIVGCPFSGGQRRTGVDQGPIRLVEAGLVEQLKGLGWNVVFDGHHQFEEYNNLDDAPIGIMKNPRTVSQVNRSVAGVVMNHAKNGMLPVTLGGDHSLAMGTISGSLAVHPDACVIWIDAHADINTIETTDSGNMHGMPLSFLLGIGDKIQEFDWIKPVLKPERLVYIGLRDLDAGEKRLLREHNIKAFSMHEVDKYGIGKVVEMALDYVNPKRDLPIHLSFDVDALDPSVAPSTGTPVRGGLTFREGHYICEAIHETGLLVSLDLMEVNPSLAEAADADKTVAVGCSLVRAALGETLL

SEQ ID NO: 3187 - protein, 306 aa, Agaricus bisporus
  var. bisporus
  strain H97 / ATCC MYA-4626 / FGSC 10389
MEAELERMMMGRAAAARGDQTVPDNGEVIHISSLALLKMLKHGRAGVPMEVMGLMLGEFVDEYTVQVIDVFAMPQSGTTVTVESVDHVFQTRMVDMLKQTGRPEMVVGWYHSHPGFGCWLSSVDINTQQSFESLNSRSVAVVIDPIQSVKGKVVIDAFRLINPHTVISGREPRQTTSNIGHINKPSIQALIHGLNRHYYSIAVNYRKTDLEQSMLMNLHKRNWTEGLKLRDFRQHKESNEVAIKSMLTLSEAYNKSVQEESTLSADQLKTRHVGKQDPKRHLEEAVEKAMGDQVVQNLGTMLLAEL

SEQ ID NO: 3188 - protein, 311 aa, Agaricus bisporus
  var. bisporus
  strain H97 / ATCC MYA-4626 / FGSC 10389
MNSFVDQFSTHSPTAQLKRAQKLIAAEDDDYSDASWGSQAGPGGMIKGIPAFKVPAVADPTAFLRLHTDDHADPNCRIKIQHGTTTLAFRFKGGVIVAVDSRATAGSYVASGTVKKVIEINPYLLGTMAGGAADCQFWETYLGMHCRLHELRNRERISVSAASKYLSNLVYSYKGMGLSMGTMICGWDKTGPAVFYVDSDGTRLKGDLFSVGSGSTFAYGVLDQGYRWDLTDEEAQELGRRSIFAAGHRDAMSGNTCNLYHVKEEGWDFIGNYDISKMYYEGPGDVPGAPGGGYGYAIRTEGRSAANPPPS

SEQ ID NO: 3189 - protein, 312 aa, Agaricus bisporus
  var. bisporus
  strain H97 / ATCC MYA-4626 / FGSC 10389
MAANVPKIKFNNGEEIPAVGLGTWQSSADDVKNAVEHALKEGYRHIDCAWGYGNEQHVGEGIRASGVPRSEIFITSKLWSTWHSRVEEALDQTLANLGTDYLDLYLIHWPVPLNPKGNHPAFPLLPDGKRDVDHSWHLKDTWKQMEAVLKKGKVKSIGVSNFSKMKLEEILPSAEIVPAVDQLELHVYNPQHELVKYLKSKGITPQAYSPLGSTKSTLLTDADVVEIANKHNLQPADVLLGYLLAKEMVVLPKSVTPSRITSNLSGAIRALETLTKADVERLDGLAAAGKQNRFITPPWPIELGFDNWPKLL

SEQ ID NO: 3190 - protein, 344 aa, Agaricus bisporus
  var. bisporus
  strain H97 / ATCC MYA-4626 / FGSC 10389
MSYEKALSSFSEEEIIKEQEEITKFLEEPGTVAKFSEACKNIGQTAVSIDENFRIVQKGFATIVEKYGKDFPEVGSVYVPRWNGYMARWNGETGMLWSSRKLAAETAAALTDYGINLGLIADIQSPDDLEGAKLELQQYVEKHPVHIAKTVAEDFENLKTDIQGFSKDFMAYIEEQKQELTEDAERFEAEIKQLQETITKLNVEIVVAVIAIGCSFALGIVEGFLAIGPLLKLIADRIAAQRDLNTAQANLKATIEKQKALAAMQADFENLKPNIDDICTKLGVFADIWTFATDQSAAINTELQEGMEVLTRKKFQTKLHLLMAQIEPLKEGMRQYASQIVPPS

SEQ ID NO: 3191 - protein, 351 aa, Agaricus bisporus
  var. bisporus
  strain H97 / ATCC MYA-4626 / FGSC 10389
MSAPKARASPTSSVSDSHRNVVDHLSPGGVTEDVQPVGPKRTVQGMDKPHMITVQPLKRSEMQPSYAQDLGTGEVVHGVYGSLLQGLGSVLGLCGAVPCMPCPNPFREVNQGSVGLVTRFGQFYKSVDPGLVQVNVCTESLRIVDVKIQISPIGRQMVITRDNVNVEIDSVIYFQITNPYRAAFGITDLRQALIERSQTTLRHVVGARAVQSVVTEREAIAYEIAEIVGDTADKWGVSIEGILIKDIIFSAEISASLSSAAQQKRIGESKVIAARAEVDAARLMRQAADILASPAAMQIRQLEALQHMAKTSNSKVIFVPMQLQNDLANQFTGSSSGSGIKDAVQGEAEIE

SEQ ID NO: 3192 - protein, 348 aa, Agaricus bisporus
  var. bisporus
  strain H97 / ATCC MYA-4626 / FGSC 10389
MPKKPISYVRLGKSGLKISKIILGCMSYGDTRWNKWVIEDEEEVIRHIKVAYDAGIQTFDTANYYSNGASEVLLGKAIKKLNLPHDEIVVMTKLYFVAGREPGVNVSASGLNPDDEGYVNQHGLSRKHIFESVKRSLERLQLDYIDLLQCHRFDSETPIEETMQALHDVVQAGYVRYIGMSSCYAWQFHAMQNYAIANKLTPFISMQNHYSLIYREEEREMMPTLKYFGVGSIPWSPLGRGLLTRPLAQSKETTRSQSDNILPSYGGGEGTNEIVNRVEEVAKKRGISMAQVAVAWTLSKEVVSAPIVGTTSVKNLEDIIAGASVVLTPEEITYLEEPYKPQSIIGNA

SEQ ID NO: 3193 - protein, 358 aa, Agaricus bisporus
  var. bisporus
  strain H97 / ATCC MYA-4626 / FGSC 10389
MGVLDIVPAGVLTGDNVRKLFDYAKANKFAIPAVNVTSTSVANAVLEAARDIKSPIIIQVSQGGAAYFAGKGLANDKQQASIVGAVSAAHHVRLMAKAYGIPVVMHSDHCAHKLLPWFDGMLQADEAYFNDHGEPLFSSHMLDLSEEPKEENIKICEKYFKRMAAIGIWLEMEIGITGGEEDGVDNSNVDNSSLYTQPADVFDVYKALHPISPNFSIAAAFGNVHGVYKPGNVRLRPELLAKHQEYAREQIGSKDSQPLYLVFHGGSGSLAEEIKTAVDNGVVKMNVDTDTQYAYLVGIRDFIEKKKGYLMSQVGNPEGEDKPNKKYYDPRVWVREGEKTLSERVKVACTNLGNVNRL

SEQ ID NO: 3194 - protein, 361 aa, Agaricus bisporus
  var. bisporus
  strain H97 / ATCC MYA-4626 / FGSC 10389
MRLAAGFLLASFLFSGFSNGCPVSSTLSNSVDDVDDRVFVTMPTAALRPASGCFPGFNFKMPESPPASLTGWWCDWDTEYAFVGFSYEVSACQSLHTLKTEFMDIRQRFHGRYVRIYGTCDRKGFNDDVINAAWHAGIGVHALIWFGFDGDNKWKGRRDALFSTLHSNPYAKFVVRVVQFGSEPLFDGVLSSSSLAKEVWRAKSELAKLQIPVTVSDMAYSYQKDRASSHVIDAIDIIDAHILPFFSRDASTAKKSWPLVQQDLNWFLNNGQGKKIYLSQNGWPSKSYPGVEPNSDKAVANVQNEKDYFNLLDAHCSHFKSAPGGGIGWFAHIYSDNQEPGYGIYDTKGRLKFPFSPRVTC

SEQ ID NO: 3195 - protein, 377 aa, Agaricus bisporus
  var. bisporus
  strain H97 / ATCC MYA-4626 / FGSC 10389
MLTTSRSLLGFAQNTLKQGYAVRRYASAAPTAAFAGQKGSNGKYTVTLIPGDGIGPEISQSIKDIYTAANVPIQWEEVSVTPVLKGGKTVIPDTAIQSVKRNTVALKGPLATPIGKGHVSLNLTLRRTFNLFANVRPCVSIKGFKTPYDDVNTVLIRENTEGEYSGIEHEVIDGVVQSIKLITWDASERVARYAFHYAQSSGRKRVTAVHKANIMKMSDGMFLSACREVSKEFPDVAYDEDLLDRVCLQIVTNPRPFSDRVMVMPNLYGDILSDMCAGLIGGLGLTPSGNIGRDASIFEAVHGSAPDIAGKGLANPTALLLSSLMMLRHMNLYEHADRIEKAALSTIAEGKTITGDLGGEATTKEYTSTIIAKLGKA

SEQ ID NO: 3196 - protein, 384 aa, Agaricus bisporus
  var. bisporus
  strain H97 / ATCC MYA-4626 / FGSC 10389
MSVDTSAAQSPTIGVVQDKINVGILGATGTVGQRFITLLSSHPWFKIHALGASSRSAGKPYHSAASWKQTTPIPSSVRELIVHPCDPTEPHFRECTIIFSGLDAEVAGDIEAAFRTAEFAVFSNAKNYRRDPLVPLIVPLVNNPHLAMIPQQQALHNPPLKKGFIVTNANCSTTGYIIPIAALEKSFGPIEAIMVTTLQAISGAGYPGVPSLDIFDNVIPYISGEEEKIEWETLKILGGITENDDGLKVFDMHASHPLRVSASCNRVPVIDGHTECVSVRFARRPPPSPQQVREALAAYTPDAQALGCPSVPRHAITVHEEPDRPQPRLDRYYQEGAGVSVGRVRQCQVLDIKFVVLANNVSIGAATSSIINAELAILRDIVSR

SEQ ID NO: 3197 - protein, 363 aa, Agaricus bisporus
  var. bisporus
  strain H97 / ATCC MYA-4626 / FGSC 10389
MASGADVKVEFDPKDMPFRRLGPSGLRVPVFALGGWLTLGGTVKGDPVKEIIKTAFDAGINMFDTAEAYAKGESEREMGRVIQELGIRRTDIIISTKLFWGVRSGHNASGLSRKHIIEGTKESLERMGLDYVDVIFAHRYDVTIPMEEVVRAFNWVIEKGWAYYWATSEWTARDIEEAWHVADKLGLVGPIAEQCQHHMFHRERPEKEYDPLYRQYKMSTTTFSSLAGGLLTGKYNDGIPTGSRYDTHSTFFAKTIEALQSPEGQEKIRKVKELTKLAEQELDTTPGALALAWVARNTNTGCVILGASSAEQLRENLKAVKVIPKLTPEIMQKIEDILQNKPSPPDMYGRLPIDPLGREPLYI

SEQ ID NO: 3198 - protein, 438 aa, Agaricus bisporus
  var. bisporus
  strain H97 / ATCC MYA-4626 / FGSC 10389
MCEGDHEPQQSWNDAVLWHRDDKATPAPQDPHPERLYKPEVLKTIDDTINGLSEELRALSLDIHGHPELLFKEYYAHDTYTAFMRKHGWKVTEHLHLETAWEATFEHGQGGRVIGVNSEMDALPDIGHACGHNLIGIAGVAVSLGLRAALEKHNIPGKIVLLGTPAEEGGDGKAILLKEGAYKGMDACLMCHPAPGPLGSVSLTSCYAREKLIVEYEGHPAHSALSPWEGRNALDAAVLGYVNISALRQQLKPTTRVHGIFEAVDWAVNIVPAKARFICFIRAPTRSELLPTVERVLPCFHGAAQASGCEVKITHLSQSFDIRQNKALGDEVANIMLNKYGSIDYEWGIRYASTDFGNVSYDLPALHPSFSIPTVPNGGNHTHDFAKSAAMIEAHKQCLVMSIALAGAGLRVLTDDAFFTEVKKAFEEDKEIRKFKDA

SEQ ID NO: 3199 - protein, 436 aa, Agaricus bisporus
  var. bisporus
  strain H97 / ATCC MYA-4626 / FGSC 10389
MNPFGELNSQTTAQYLRTLPAIRERCLALYDLATQDKLLYFDYHPEKEADVVDFCLDIIKRDYNSDPNNIQPHGRWRHLDAGLPRIQPLLTTWSHLQIDIKEQSRRLIDLFLISVLLDAGAGNTWKYIEPGTNKTFNRSEGLGVASAHMFQSGFFSGVEGEPSAGLEKITVERTKEAMQVTSSNPMTGLEGRTSLLSNLSKALTSNPEFFGTEGRPGNLIDFLETQALPTTSNKKTIPLAALWTALLDGLNPIWPSRISLANIPLGDVWPSPTLAQSVSTTSQNRGTQESDILIPFHKLTQWMTYSLVEVFEKVLGWDVQGLDDMTGLPEYRNGGLLVDLGVLVLKPDMLPVNSESGLPTASAEHPAIVEWRAMTVIELDRIADRVRERLGLGKEELSLAQVLEGATWKGGREIAKMKRPGTGGPPIEIESDGTVF

SEQ ID NO: 3200 - protein, 467 aa, Agaricus bisporus
  var. bisporus
  strain H97 / ATCC MYA-4626 / FGSC 10389
MVSRTLLSRALRSAVRPARSYATVRNLGPLTEVTTLSNGLTVATESHSHAQTATVGVWIDAGSRAETDKTNGTAHFLEHMAFKGTGRRTQHALELEVENLGAHLNAYTSREQTVYYAKSFRKDVPKAVDIISDILQNSKLENAAVERERDVILREQQEVDKQLEEVVFDHLHAVAFQGQPLGRTILGPKKNILSIKREDLASYIKTNYTADRMVLVGAGGVDHNELVKLAEKHFSSLPISPNPISLGRLSHSKPSFVGSEVRIRDDDIPTANIAIAVEGVGWSSPDYFPMMVMQSIVGNWDRSLGLSTLNSSRLSHIVSQHNLANSFMSFSTSYSDTGLWGIYLVSENLMNLDDLVHFTLKEWTRMSTGATDVEVERAKSQLKASLLLSLDGTTAVAEDIGRQLVTSGKRLTPQQIETAVDAVSVDDIKRVASKYLWDKDFALAAVGSVEGLLDYNRIRADMASMLY

SEQ ID NO: 3201 - protein, 489 aa, Agaricus bisporus
  var. bisporus
  strain H97 / ATCC MYA-4626 / FGSC 10389
MATGDIGLIGLAVMGQNLILNMNDKGFTVVAYNRTVSKVDHFLANEAKGTKIQGAHSIQELASKLKRPRKIVLLVKAGSAVDDFIAQLVPHLEQGDIIIDGGNSHYPDSIRRAKELEAKGLLFVGSGVSGGEEGARHGPSLMPGGSPAAWPAIKEIFQKTSAQVNGDPCCDWVGETGSGHYVKMVHNGIEYGDMQLIAEAYDILKRGMGLSEDEIADIFLRWNKGVLDSFLIEITANILKFKDDDGEPVLAKILDKAGQKGTGKWTAIAALDSGTAVTLIGEAVFARCLSAIKDERMRASKVIAGPQKEPFKGDKKQFIDDLEQALYASKIISYTQGFMLMRETAQEMGWNLNYAGIAKMWRGGCIIKSVFLGDITAAYQKNPKLESLLFDDFFKKAVSTAQPGWRRINAQATLWGIPTPAFSTALAFFDGYRSEILPANIIQAQRDYFGAHTFRVLPGKENERFKAGEDIHVNWTGRGGNVSASTYST

SEQ ID NO: 3202 - protein, 521 aa, Agaricus bisporus
  var. bisporus
  strain H97 / ATCC MYA-4626 / FGSC 10389
MATPAKDLAQFTREEVAKHSSDDDQWVIIDANVYNISRFKRFHPGGLSVLLDPDVAGQDATEAFYSLHRHEVLERPAYQRLKIGTIAGEQSVIRWRVPGAISKVPYGEPTWLTDGYFSPYFSDKHRAFQKKIRQFMDTVVLPDALEREADGKRPSQSVFDKMAEVELHAMRMGPGKHLQGRTLMGGMVKPEEFDYFHELIITQEISRAVLRGYGDGLLGGKVIGLPPVLNFGSEELKARIVPDILAGKKFICLAISEAFAGSDVMGLQTTAVKTEDGKHWIINGNKKWITNGTFADYFTVGCKTEDGFTVILVERGPGIETSQIKTSYSTTAGTAYITFDNVKVPVENTLGEEGGGIFVILSNFNHERWVMCCASARGQRMIIEECLKWTTQRKVFGKPLNSQAVIRSKLAKMISRAESVQNWLENITYQMCNMTYRQQANKLAGQIAFLKSYSTSCGQDTARDAVQIFGGRGITQSGMGQFVEHYHRTIAFDALLGGAEDVLADLGVRQALRAMPEDVRL

SEQ ID NO: 3203 - protein, 534 aa, Agaricus bisporus
  var. bisporus
  strain H97 / ATCC MYA-4626 / FGSC 10389
MAYQAQEHVRRTFEQLLALLPEQERIRPQILLVAGEVTPYRNDTDREMLFRQESNFFYLTGCNLPSSALLASYQATPASSSTKPITTLFIPAIEEADIMWSIPPPDLVQARGLFDATNIEHPTSFPQAINALLKDAPNALVHTLPKNSPLFPQLPSQYLNQFSPNASPIDKYLLAALQRARLIKDAGELALIKKANEISSRAHETVMRVLGLAVKNKISREKDAGVTRPLLPGEWLIEKEAEAEAIFVASCRREGSIHQAYLPIVASAARAATLHYTCNDKDFAWGPVQPTDHLNNNSFTQTSHPNAAGQEIDPQVLLIDAGCEVNNYASDITRTMPVGNNGRFTPISGQVYDLVLEMQKAAFNMIKPGVHWDRVHLECHKVLVNKFIELGLFKNGTKEEILNSGVSAAFFPHGLGHSLGMDVHDAAEASRPANNETIPKENIGHEKLYPALRLRLPLEAGMVVTVEPGVYFHQHLIAPTRNSKYVDVEVLKKYEHMGGVRLEDVIVITQDGYENFTTVKSERNWVEGVCSGEL

SEQ ID NO: 3204 - protein, 533 aa, Agaricus bisporus
  var. bisporus
  strain H97 / ATCC MYA-4626 / FGSC 10389
MSVRAKSKVCLIVHDGWGIAAKKGLDGNAIEAADTTNMDSIANDHSFRTLHASGTAVGLTDGLMGNSEVGHLNIGAGRIVWQDIVRIDVAIKKRQFHKNSVLLETFERAKKGNGRLHLLGLISDGGVHSHINHLFALLETAKEVGVPHTYVHFFGDGRDTAPRSAAGYLKDLLEFMKKEDYGRLATIAGRYYAMDRDKRWERIKIAVEGLVNGVGEDSKGQDGAINTVEENYKKDVTDEFLKPIIVNGDEGRIKDGDTMFFFNYRSDRMREIATVFGQLEDVVDTKIPKDLEIATMSAYKVGFPFKVAFPPQKMDNVLAEWLSKQGLKQSHIAETEKYAHVTFFFNGGVEKQFEGEERHMIPSPKVATYDKEPKMSVLQVAEKVADVLRKGDHDFVMCNFAPPDMVGHTGVYDAAVEAVSATDKAVGEVYKAAEAAGYILLITADHGNAEQMKDLENGSPFTAHTTNVVPFIMSGDPKQLKFKEDDKNDEEEGALCDVAPTILDLMGVPQPEEMTGRSLLASGGKDAKKEDKK

SEQ ID NO: 3205 - protein, 617 aa, Agaricus bisporus
  var. bisporus
  strain H97 / ATCC MYA-4626 / FGSC 10389
MAGALQNAKRDLNKIRDEDRESRFGQVFGVSGPVVVAENMIGAAMYELVRVGHDELVGEVIRIENDQATIQVYEETSGVTVGDPVLRTGKPLSVELGPGLMGNIVDGIQRPLRSIQELSKSIYIPRGINTDALSRTIKWDFKPASFKVGDHISGGDIFGGIYENSLVDNHKVILQPKALGTITHIAEAGSYTVDDVILETEFEGKTTKHSMMQLWPVRAPRPVTEKLTADYPLLTGQRILDALFPCVQGGTTAIPGAFGCGKTVISQAISKFSNSDIIVYVGCGERGNEMAEVLMEFPQLTMEVGDRQEPIMKRTTLVANTSNMPVAAREASIYTGITLSEYFRDQGSNVAMMADSTSRWAEALREISGRLAEMPADSGYPAYLSTKLASFYERTGKVVCLGNPLRQGTVSIVGAVSPPGGDFSDPVTAATLGIVQVFWGLDKKLAQRKHFPSVNWSFSYSKYTKVLEPYYEREEPGFVELRTKTKEILQKEEDLAEIVQLVGKSALGENDKITLEVARMLKDDFLQQNGMSEYDRYCPFYKTSAMLKNFVAYHDAALKAVAQHDLTFAKIKDTTADIMFKLSQMKFESPSQGKEPIKQTLDSLYNEIQDKFRQIVE

SEQ ID NO: 3206 - protein, 635 aa, Agaricus bisporus
  var. bisporus
  strain H97 / ATCC MYA-4626 / FGSC 10389
MDPTTQSNYDKVATEHVEFDWRLDFENRIIQGSAVHQLTIKAENVHEAIFDTNDLTIDGVSIEGKATSFDLKPKHEVMGSALHVSLPSGLSKGAKLRVQIQYQTSPNSMALQWLEKEQTQGKQFPYLFSQCQPIYSRALAPLQDSPSAKITYSAKVKSVLPVLLSAIRVSPPADGPPHGGKIIGKDEIIYSYNQPVPIATYLIAIAAGNIHFRSFPQHEGKTWTSGIWTEPELLDAAYWEFSEDTTKFLAKEESLVIPYGFGVYDLLVLPPSFPYGGMENACLTFLTPTLVTGDRTLVDVVVHELTHSWFGNGVTHAEASHFWLNEGWTTYMERVLQQFLHSPAHRGFSYLIGNRALRDALEEYKDRPKYQRLIIGFEKGEDPDDAYSSIPYEKGANFLFYIEQTLGGLDVFLPYVKDYVSTFIGKSIRTEDWKSHLYGYFKDQPDKIKALNNIDWDAWFYGEGTELPVQLKFDTTLATQAYALAKRWDEARSTTDIPRLDFKETDLQKFDANQIVVFLEKLQSYSPLPSDLILHLGRLYGVSSTSNAEIRLRFYGVALQDASSPAAQHFAVEAAKWVIGDDGTGIIKGRMKFCRPTFRSISKVNHDVAVETFMKAKNYFHPIARKLIEKDLKLA

SEQ ID NO: 3207 - protein, 726 aa, Agaricus bisporus
  var. bisporus
  strain H97 / ATCC MYA-4626 / FGSC 10389
MSSLDALQPQDLAGLARPSAAVPNVAGDFAFTTISKYDFEEKKFNKTLVVFPVASTFTSAEIPLPKGEVFWLSGTTLAHVVEGDKDNLEIYAFEVCGGYDAATASDRPLDLSCNRVLIGTIPTKTATNFKYNARSRHLVFSDNVYDDYDLNTVNERDKLLASRGTTAMIYDSTYVRHWDTWVGPKKSALFCVALFLHPDYNWRMGPEFFSPMKGSSHHTPVEPFGGTDDFDVSPTHIVYTAKDPILPEAWHTKQNVYIVDIRGASKPRELTSGKQGATHNPVFNHQGDKVAWVELDEDGYESDRAKIVIYDLKVNVRYTLTQHWDRSVESLMFNMEGTFIYLTAGDQAKVKLFYLPVPPTPSESTTDPILDEIYTKPTELTSTGAVTGMYTMFTGRVLFSRSSLTSPNDAYLIQHLPRHLSDLTQPSERVAKGLKGDISKISGFTEAALREKWLHPGEEFYFAGANDKKIHGWAFKPRGWKEGDKKKWPVVLFIHGGPQGAWEDQWSTRWNPNAFTGQGYFVIALNPTGSTTFGRELTDAIKEDWGGKPFVDLINGWKYALDKYPEIDADRAVAAGASWGGYAINWIQSNPEFGFGFKALVCHDGVFDTQYNGFSTDEIFFFNHEWGGRPWEEKGKKLSTKFSPSNFVHKWSTPQLVIHSSKDYRLPETEGISAFQVLQQLGVPSRLLIFPDENHWVLKPENSVVWHEEIFRWFDQFVGEKKDESE

SEQ ID NO: 3208 - protein, 753 aa, Agaricus bisporus
  var. bisporus
  strain H97 / ATCC MYA-4626 / FGSC 10389
MPIRWTPGSYPKARRSDHVDTYQSATRGTVRVPDPYNWLEEHNTETDDWTSEQERYTRAFLDQIPDRDRLEQAFRASVDYAKFGAPTLHDDGRWYWSYNSGLQHQHGLFCPRCSVSSHSHCHLVVVYRSQDDTLPVFKDGSEPGEIFFDPNVLSDDGTVALTHFEFSKSGKLLAYGLSQSGSDESTLYIRPTDAPLNKRDDNQKLPDEIKHVKFSSVSWTPDSQGFFYQRFPAAQDQPSTNGINTGADENAMVYYHKIGTDQSDDILVHKDKDHPTWMFGITVTEDEKYLVLYTSRDTSRKNLIWIADLKKAKFGESILWQKLFDSFDAEYTYVTNDGPIFYFQTNEDASQRKLISVDVSADAVSPSIVIPERKDALLCDVTRVNKDHFVVQYKRNVKDEIYICDNNGRELERLYSDFVGTMSAHCRDTHSWLFVTMSGFNTPGTIAYYDFKRPEGQRLTPFRQTKVKGLNPDDFETRQVWYPSKDGTQIPMFIVRHKSTPFDGTAPCLQYGYGGFNISIDPFFSPMFLTFIQIYRGVIAVPNIRGGNEFGEDWHLGGSLKNKKNCFDDFIGATEYLVKNKYAGAGKVAINGGSNGGLLVAACVNRAPEGTFGAAVAEVGVLDLLKFHKFTIGKAWTSDYGNPDDPNDFDFIYPISPLHNIPDRVLPPFILLTADHFSPSNLSDDDRVVPLHSFKHAAQLQHMHSNNPYPLLLRVDKKSGHGAGKSVEKRIQEAADKWGFVAQSMELVWKHEK

SEQ ID NO: 3209 - protein, 783 aa, Agaricus bisporus
  var. bisporus
  strain H97 / ATCC MYA-4626 / FGSC 10389
MRCLLTASLVFATLAGSVYGHGRDSNSPLPRRKTLGFGPEHPHAVFNSNLHPLQTAGFVSEEPLDVARLFVTDLLGPSVSGGPSWKIRKDSYTDDNTGVTHVYIRQIVNGLEVADGDMNINIKDGRVLSYGNSFYNGPTPAPFSSTTAPEDLRHPQAEFCDQIPRHMPYAVPMPDGQVLLDAPSQSPVISHIAESNCAHPQLPASLTSDSSDFRPALLQFMLAATPNRELAQDITENYQKHIDDMLISDESHFAPGDEATVQFKVDNVPDAVNPAKARLAYIQLPSKLDGAMELQLVWKFEVEMQDNWYESAVTVSTPHRIISVVDWASDAPVPTPSPERKPATYKVFGWGVNDPECGERSVEKESFDGHASPAGWHAIPHEHDPSYISVRGQEKPGFWRNSTTTWGNNVLAQENWEGLNRFMDNYRPDGGEDRVFDYKYEPNETDKEDALAEAKAYINATVTQLFYTANLVHDIYYRYGFTEVAGNFQQYNFGRGGQQNDAVITNAQDGSGFNNANFMTPPDGQNGRMRMYLWNTAIPYRDGDLEAGIVIHEFSHGLSTRLTGGPANSGCLGWGESGGMGEGWGDFLATTIRSNRNYSDYSMGAWAANSITGIRHYKYSMDEDVNPSTYKTLDKPGYWGVHAIGEVWAEMLWVVSQGLIKKHGFSDTLFPPAPGPDGVVPRDHHFWRQDKDLLVPKHGNTLMVQLVLNGMKLQPCRPSFFDARDAIIEADRILTGGENVCLLWKGFAKRGLGFDAQVQGRTPWGGGIRTDGYAVHPDCRDEE

SEQ ID NO: 3210 - protein, 844 aa, Agaricus bisporus
  var. bisporus
  strain H97 / ATCC MYA-4626 / FGSC 10389
MGVKRPGVGSVGRSIDIQVNCYKAEAIDIPVYQYDVAIDPDSMPSRVNMEIFRQVQQDYANIFHKVLAYDGKKIAYATYQVPMGSTSRTFEVTLAPKNGGVTQKPGGRPPRVYKLKLSEAAIINTEVLRRYIAGSQSMNDAVSTSLAAFNTVLRMVPNLECVHNVRSFFNRKFGFEGIGGGIELWRGFFQSMRPGPGYLLLNVDIATCMMYRPGNLLEVCVDFFDNNVPARNLANYLANSDRERIRLGKFLSNLAVTVPATTKNKRRVIKGVAPRGADQITFDQDGKKTTVAKYFQQLGIRLQHPNLHCVEFRPGGALVPLELCQVQPGQIMRKQLPSDKTSKMVSFSTLKPPQRFQLIENGARDLQYGQSEYIRSFGLNINPTLMSLKGRILPTPKLQYGPGSKEPVVVPRFGAWNMAEKKLVRPMTVDRWLLVNLSRIFERDLQNIVRNLIQGFESTGITINHSPLIKPGDPQGNIPQILKSAGMEVFKQRGQPPQLIVIIMPDDGNAAVYSAIKHFGDIVMGVATQCLRPQKCRGANIQYWANVALKVNVKIGGINCTPERRAVPILSDPANATIIMGADVQHPAPGAEGRPSFTAVVGSVDQMASKYVAANALQVGRQELIDDLKTMVKDVLKLHMEYRTHQEKAKNPAPRKLIFFRDGVSEGQFEQVLRHELPLIRDACKEMKISPQITLCVVIKRHHIRFNPITEADRSQNCPAGTVVDTGITSPVEFDFYLQSHGGLLGTSRPSHYAVLYDENKFNADTMQSLSFALCHVYARATRSVSIPAPVYYADIVCARGKHHFPPEFAGRLSDDVSEAGSVESFRSQFMPLHDGQKKMMYFS

SEQ ID NO: 3211 - protein, 860 aa, Agaricus bisporus
  var. bisporus
  strain H97 / ATCC MYA-4626 / FGSC 10389
MPPSDFANADIDKIVDALTTDEAILLSAGVGFWHTHAIERLQIPAVKVSDGPNGIRGNHFFMGTPAKCLPSSTAMGATFDRDLLEEVGLKLLAREAKLRSASVILAPTCNIQRNPLGGRSFESFSEDPFLSGMLCSAYINGIQKGGIGATIKHFVGNDKEDDRTGYDSIIAERPLREIYLLPFMLAQKYASPWAIMTAYNRVNGIHVCENPELLQKILRDEWKSDVMIMSDWFGTYSVDVGLNAGLDLEMPGLNKWRTLESVNRSIQSRKVTAKKVKERARKVLELVKKCAQGAPEILDGDGLERTLDSDEDNALMRKFAAESIVLLKNDKKVLPLDRKSLKKVAIVGGNAKAAVLSGGGSAALKPSYFVSPYDGIVKALKEVNPNIEVTYSEGARAVKTLPTLDFDLFTESGQRGWTGSWHAHENDDSLVALPTPIKTQYVDETRMFISSSSPAGITKKWTLRMKGYLKPRERDCKFEFGLTAAGRAKLFVDGKLVIDNWTRQRRGVEFFGCGSEEETGVVELKAGVKHEIYVDFCNVRGPADGDETETIMDSNPGIRLGGAEVEDPDELLNSAVSIAKDADAVIIVVGLNGDWETEGNDRTTLALPGRTDELVQKVVAANPRAVVVTQAGSAITMPWVDQVSSLLHTWYLGNATGDAIADVIFGNHNPSGKLSLTFPKRLEDVPAHGYFHSEKGKVTYAEGLYVGYKHYQHRNIEPLFAFGHGLSYTSFNISDLRLSQPIVSGDQFDLKATVKLTNTGNITGSQVVQLYIGLPKTSELTHPRWQLRGFEKMRDVKPGESREVELVMDRLSVSYWDKEWVVENGAYDVRVAFTSEEGVGEGQELLGRFNVEKGFGWRGL

SEQ ID NO: 3212 - protein, 900 aa, Agaricus bisporus
  var. bisporus
  strain H97 / ATCC MYA-4626 / FGSC 10389
MLPLQVSRFTSLGARRCVVVAGQRRAAVQAVRSTTQTRNVQSVAQTDRDTIMRLLYSIGTKREVERHLRIFSSSSHPSQPAKFAVIKIGGAVLDDLDELALSLSFLYRVGLYPVVLHGAGPQLNVILEREGVVPDYIDGIRVTDAKTLSIARRVFLEENLKLVAALEALGTRARPITSGVFTADYLDKSKYGLVGKITKVDKRPLEASIRAGALPILTSLAESLDGQIMNVNADIAAGELAKELEPTKIVFLNDKGGMFHGVTGEKLDVINLDEEYEELMKQPWVKYGTKLKLREFKEMLDHLPRSSSIAVISASSLQKELFTDSGAGTLIRRGYRLFKYSSIERVGADRFRQVVHDRDPEVLSGHQSVTEVLNNLKKTPYTLYGDDPMDVVAVVSHPEGEVPVMTKLLSSRAGILNNVVDNVFNAIKKDHRKLFWTAPADDENRAWHFERADGSFTRAGKSLFWYGVQDVKEVEKIVEEFDKKGRIERNYLPVGPAAPPHKNVAAAAASGTRAYSTIARRLVGTQGKRGYATMAPEPVVQHTTQPKKVALIGARGYTGQALTTLLNAHPYLELSHVSSRQLVGRKLEGYDKSEITYSNLSMEDVERMEKDGEVDAWVMALPNGVVKPYVDAIDRGKKEGEKEGRKGSVVIDIGADYRFEEGWTYGLPELYGRSQIRTAKRISNPGCYATNAQMLLAPLVNLLNPASIPTVFGLSGYSGAGTVATTDSDGKPISLPKITPEALGGAVKPYALTDHIHEREAGFHLTDLISASASGTTNTAGKKVKVAFVPSVASWFSGIISTASVPLNRRVTAKEVVELFEEKYAKEKLVRVKKEVPVLGDVEGRHGVVLGGFQVHSEGERVVVVGGLDNLLKGAATQCLQNLNLSLGYEEYTGIPVDIE

SEQ ID NO: 3213 - protein, 1076 aa, Agaricus bisporus
  var. bisporus
  strain H97 / ATCC MYA-4626 / FGSC 10389
MSAQFHPKEDLVVSASMDQTVRVWDISGLRKGSPHQGGPGGMAGTSGPGSNHFETFDNFSTVKYVLEGHDRGVNFAMFHPTLPLIISAGDDRVIKIWRMSETKAWEVDSCRGHFNNVSSALFHPKHELIVSCGEDKTIRVWDLAKRTAIQTFRRDHDRFWYLAAHPNLNLFAAGHDSGLIVFKLERERPAFTVHQDTLYYVRDKYIRSYDFSSGSDIGLLSVRKFGSPYLPPRTISFNPAERSVILTISSDNGLYELSALPQSAQGEVKDSSADGKKGSGNSAIFVARNRFAALNKTTQLIEVRDLSNSTVKTIKPPVQTNEIFYGGTACLILSSTSSVVLYDIQQQKTIAELNSPPVKYVVWSNDGSLVALMSKHTITIANKTFSQHTLIHETIRIKSGAWDDSGVFLYSTLNHVKYCLAQGDHGVICTLDNPVYLTRVKGKTVHCLDRSARPRTITFDPTEYRFKLALLRNNYEEMLYIIRTSNLLGQSIIAYLQKKGFPEIALHFVQDTNTRFELAIECGNLDVAMETAREIDRPDCWERLAQQALKQGNHKVVEKAYQQTKNFDKLSFLYLATGSTEKLSKMQKIADARGDPMSRFHNALYAGDVAGRIAVLREVGLHPLAYLTAKGNGLDELAAEILEAAGLTEADIDDVPTFGASTLRPPPVVTSTENYNWPILSQGENYFDRALANGSLEGGVEPAYVNGDANAAASSALDAWARDEEIQDEIDPEEGGWELDADADEFKEDEAAEEVVEEEQELGAGAAPGVDETELWVRNSPLAADHVAAGSFESAMQLLNRQFGISNFAPLKPLFLSIYRSSHVYLSPVASLPPLKLHVRRNIGESAPSKVLPVAARSIQSVRSELAEGYRSVSSNKLTEAQATFRSVLQALLLVVIASDDEAKQWRDTVTSAREYLLGVSIELERRRVVEQEPDNLRRNLELAAYFTHCQLQPPQLQIALRSAIGAFAKANNQAHAARFAKRLLELNPDPKIAAQARQRIAAGDRNPRNTVEISYDEFTSFDICAATYTPIYKGSPSVHCPYTDAAYLPECQGKLDPLMELTEIGAPAAGLPAAW

SEQ ID NO: 3214 - protein, 103 aa, Agaricus bisporus
  var. bisporus
  strain H97 / ATCC MYA-4626 / FGSC 10389
MSGRGKGGKGLGKGGAKRHRKILRDNIQGITKPAIRRLARRGGVKRISGLIYEETRGVLKIFLENVIRDSVTYTEHAKRKTVTALDVVYALKRSGRTLYGFGA

SEQ ID NO: 3215 - protein, 101 aa, Agaricus bisporus
  var. bisporus
  strain H97 / ATCC MYA-4626 / FGSC 10389
MAKAKAAAPSGGKAAKKKKWSKGKVKDKAVHAVTLDKPTYDRILKEVPTFKFISQSILIERLKINGSLARVAIRHLKKENLIKPIVHHSAQLIYTRVTSSD

SEQ ID NO: 3216 - protein, 106 aa, Agaricus bisporus; identical to SEQ ID NO: 588
  var. bisporus
  strain H97 / ATCC MYA-4626 / FGSC 10389

SEQ ID NO: 3217 - protein, 137 aa, Agaricus bisporus
  var. bisporus
  strain H97 / ATCC MYA-4626 / FGSC 10389
MARTKQTARKSTGGKAPRKQLAAKSAARKTAAAAGGVKKPHRFRPGTVALREIRRYQKSTELLIRKLPFQRLVREIAQDFKTDLRFQSSAVMALQEAAEAYLVSLFEDTNLAAIHAKRVTIQPKDLALARRLRGERS

SEQ ID NO: 3218 - protein, 144 aa, Agaricus bisporus
  var. bisporus
  strain H97 / ATCC MYA-4626 / FGSC 10389
MGRVRTKTTKRASRVLIEKYYPRLTLDFHTNKRIIDEVSLVPSKRLRNKIAGFTTHLMKRIQKGPVRGISFKLQEEERERKDNYVPEISALDTTASGLEIDPDTKALLDALNFDSIQVNVVQPVTAQPERPRRERRNVPGAGRA

SEQ ID NO: 3219 - protein, 147 aa, Agaricus bisporus
  var. bisporus
  strain H97 / ATCC MYA-4626 / FGSC 10389
MPTRFSKTRKHRGNVSAGYGRVGKHRKHPGGRGLAGGAHHHRTNFDKYHPGYFGKVGMRHFHLTRNQYWRPIINVDKLWSLVPEEEKKGLTENSEVVPVIDTLQHGYGKILGNGKLPKLPFIVKARFVSEIAERKIKEAGGVVKLIA

SEQ ID NO: 3220 - protein, 178 aa, Agaricus bisporus
  var. bisporus
  strain H97 / ATCC MYA-4626 / FGSC 10389
MPPPKSKGGKMLALINWRLKVTINDGRALTGQMLAFDRHMNLVLADCEEFRRVRPKKKAGEETAPEQEMKRTLGLVILRGETVVSISVEGPPPVVDEDKKANNLPGGPGRGMPAGRGMGMMPPMGAPPLARPPMPFAPPGMPGPPPGFRPPGFPQGMPFPPPPPGFGGPPPGFQPPPQ

SEQ ID NO: 3221 - protein, 182 aa, Agaricus bisporus
  var. bisporus
  strain H97 / ATCC MYA-4626 / FGSC 10389
MFVLCDLDRSTSFVVELIVHQVILKLPSPSRQNAPKKVKVQKEEAVSLGPQVAEGELVFGVAHIYASFNDTFVHITDLSGRETISRVTGGMKVKADRDESSPYAAMLAAQDVAVRCREVGVTALHIKLRATGGTATKTPGPGAQSALRALARAGMRIGRIEDVTPIPTDTTRRKGGRRGRRL

SEQ ID NO: 3222 - protein, 196 aa, Agaricus bisporus
  var. bisporus
  strain H97 / ATCC MYA-4626 / FGSC 10389
MSVNNKILRTANAPTSPPDEIEIAVAQALIDLENNVPELKNELRALQISAAREVDVRGGKKAIVVFVPVPQLNAFHKIQARLTRELEKKFSDRHVVFIAQRRMLRKPTRNSRVKQKRPRSRTLTNVHEKILEDLVHPTEIVGKRTRVGVDGSKLLKVFLDSKDQTSLEYKLDSFSSVYRRLTGKEVVFEFPVVSQE

SEQ ID NO: 3223 - protein, 202 aa, Agaricus bisporus
  var. bisporus
  strain H97 / ATCC MYA-4626 / FGSC 10389
MSNPPPDDVEAELKPTATPGYNPGGSKSPEELAALDQEDESLARWKASLGIVPGTSATPAGPKLHVLTLELASSTLPSGKTISMDINNPQEMAAIKKNPIVIKEGVEYNVRMNFRVSGSIIPGVRYIQLVKRGGIKVDKFEKMLGSYGPRDEQYTVDFEPDDSPSGIIARTGTYNVVSRVVDDDGEIHANWEWQFKIGKEWA

SEQ ID NO: 3224 - protein, 194 aa, Agaricus bisporus
  var. bisporus
  strain H97 / ATCC MYA-4626 / FGSC 10389
METSFALIGKGYVIVAADTTSARSIVKMKNDEDKIKTVSPHLLMTYSGEPGDTVQFAEYIERNLRLYQIRNIYPLRPAAASSWIRRSLAESLRSRHPYSVNLLLGGYDTSLSEPKLYWIDYLGTVTEVPFAAHGYGSYFVLSLMDRYHDPEAPLEEGLETLKKCIQEVSKRLIVSPERYKVKIVDKDGVRDIDL

SEQ ID NO: 3225 - protein, 194 aa, Agaricus bisporus
  var. bisporus
  strain H97 / ATCC MYA-4626 / FGSC 10389
MVNLRSQKRLAASVAGVGKRKIWLDPAEQAEIGNANSRTHVKKLIKDGRVIVKPTTVHSRARTQMLLAAKRKGRHTGPGKRKGTSEARMPTKVQWMRRQRVLRRLLRKYRDAGKIDKHLYHSLYQKSKGNVFKNKRVLMEFIHKAKAEKNRTKILSDQMEARRVKNKAVRERRAARIAEKRQALIAIEHEDARE

SEQ ID NO: 3226 - protein, 216 aa, Agaricus bisporus
  var. bisporus
  strain H97 / ATCC MYA-4626 / FGSC 10389
MGISRTSRHKRSASGAQRAHYRKKRKFELGRQPANTRLGPKRIHEVRVRGGNIKYRALRLDGGNFAWGSESVTRKTRILTVVYNASNNELVRTNTLVKSAIIQIDATPFRQWYEAHYAQPVSKKSAKAQAAQAATDGATEEPKKLSNHAQRNLTERKKDAKIDPLLETQFGAGRLYARISSRPGQSGRADGYVLEGKELEFYLRKIRTGKQKHAHA

SEQ ID NO: 3227 - protein, 221 aa, Agaricus bisporus
  var. bisporus
  strain H97 / ATCC MYA-4626 / FGSC 10389
MSRSYDRALTVFSPDGHLFQVEYALEAVRKGTCAVGVRGKDVVVLGVEKKSVLQLQDPRTVRKVVMLDDHICLAFAGLTADGRVLIDKARVECQSHRLTVEDPVTVEYITRHIAGIQQRYTQSGGVRPFGISTLIIGFDPHDNKPKLYQTEPSGIYSAWKANAIGRSSKTVREFLEKNHKDDMTREESIKLAVKSLLEVVQTGAKNIEISVMEGYSKVTGQ

SEQ ID NO: 3228 - protein, 246 aa, Agaricus bisporus
  var. bisporus
  strain H97 / ATCC MYA-4626 / FGSC 10389
MTSIGTGYDLSASTYSPDGRIFQVEYATKAVENSGTAIGLKVKDGVVLAVEKLIHSKLSVPEANRRIQTIDRHIGLATAGLLADGRHIANRARDEATSYRDTYDAPSPLKNLAERLGLYTQAYTLYSSVRPFGISTILGAFDKEGPSLYVIEPSGVYFGYNGAAVGKGRQLAKTELEKLKLSELTTKEAVYEAARIIYLVHEDAKEKEFELEISWIGQETDNVHLPVPRELQQDAEAKAKAALETF

SEQ ID NO: 3229 - protein, 258 aa, Agaricus bisporus
  var. bisporus
  strain H97 / ATCC MYA-4626 / FGSC 10389
MLDSGSAVALSPIETSKRLAAYTAVDHHVKPEHTTIGIGSGSTVPYVVERIVQQGVEANKNRVFIPTGFQSKLLIIEAGLNLGDVDEFPSIDVTIDGADEVDKDLNCIKGGGACHLREKVLAEAAKTFIVVADYRKNSEYLGTTWAPGVPIEVVPVAYVRVLRHLKEVLGSPNATLRMALKKAGPVVTDNGNFVIDAPFDREKMMNSSKVLTQIKLLTGVVEVGLFCGMAKAAYFGNQDGTVAIRRADGTMEQVVAMQ

SEQ ID NO: 3230 - protein, 272 aa, Agaricus bisporus
  var. bisporus
  strain H97 / ATCC MYA-4626 / FGSC 10389
MSVFNATRLIGKTVIVTGASSGIGAATAVLFAKAGSNVILVARRQEILKQVADQCLAAHKESGLTQGGKFATVQLDVSDKTQVAGFLDKVPQELRDIDILVNNAGFVLGLDRIGDIKDSDIEGMFATNVFGLISMTQLLVREFKKKQAGHVINLGSIAGREPYVGGSVYNATKSAVRAFTGALLRELVNTPIRVTEIDPGLVETEFSIVRFRGDTSAAKKVYEGLEPLTGYDIAEEIVWAASRPPHVNIADVLVYPVNQASAVSTYRKPANM

SEQ ID NO: 3231 - protein, 277 aa, Agaricus bisporus
  var. bisporus
  strain H97 / ATCC MYA-4626 / FGSC 10389
MFRNTYDSDNTVFSPQGRLHQVEYALEAVKQGSAAVGLKSKTHAVLLALKRSTGELASYQQKMFRIDDHAGIAIAGLTSDARVLSNFMRQQAMSSKMLFNRAIPVNRLVSAIADKAQVNTQEYGRRPYGVGFLVIGYDESGSHLYEFSPSGNSYEYFAMSIGARSQSAKTYLEKHYEEFADASLEDLIRHGLHALRETLQQDKELNVNNTSIGLIGPRSEHEKKGVQPEGAFRILENEAIEPFLKTMVAKEDPPAPAPAASSSGPAASGSGDVQMSG

SEQ ID NO: 3232 - protein, 288 aa, Agaricus bisporus; identical to SEQ ID NO: 605
  var. bisporus
  strain H97 / ATCC MYA-4626 / FGSC 10389

SEQ ID NO: 3233 - protein, 304 aa, Agaricus bisporus
  var. bisporus
  strain H97 / ATCC MYA-4626 / FGSC 10389
MILLEPHNTIIQTTLLDKIAKPSTLDVQFVDFDGVRFHLTSGDKKTMILLSMNIRCWDELARYGAVDILKREYGALVLDQPENEYNVSLMIDLEQVPQDPESRDAFVMSIAMLKRNALSATFERAFQEQKELETSGGKAELMEIHYRDEEAIYVQASPDRVTVIFSTIFREETDRIFGKVFLQEFVDARRQPSIQNAPQVLYTNRDPPLEIRHIAGLRSTEDTGYVTFVLFPRHFSKPDVAAATISHIQLFRDYLHYHIKCSKAYMHSRMRARVTEFQKVLNRAKAEVATGEKKTVSGRTMVHR

SEQ ID NO: 3234 - protein, 312 aa, Agaricus bisporus
  var. bisporus
  strain H97 / ATCC MYA-4626 / FGSC 10389
MSVVPTPVNLALLICDELPAEFNYGTTTEIYDRWLSGSYPQGVLPRLNMMPYDVRERQEYPTAEELETIDAVMLTGSRDDAFGEDAWITRLLEYTKFIHTKHPRIRMFGICFGLQIISRALGGTVERNAKWEYGLTAINVTHMGKEIFGVERLYELQQIHQDHVPLPSLSNHFSTGSIYLLGSSIRTPNQSFVQLYERCNECELRGKCHEIHQHIRVLTFQGHPEFTDSIVTGLVRKWVKSGRIAEHDARVYFGEGNTPAHLLGKSDPEPMWPYEYDGINVVGRTFWKVFGVKYDDVTETDKSDGSADAGAV

SEQ ID NO: 3235 - protein, 315 aa, Agaricus bisporus
  var. bisporus
  strain H97 / ATCC MYA-4626 / FGSC 10389
MATAEEIRAQSYVGFDSITQQIEHKLLKRGFQFNVIVVGQTGLGKSTLINTIFASHLIDSKGRLQSDEPVRQTTEIQAVSHVIVENGVKLRLNIVDTPGYGDQINNEGCWDPIIKYIKDQHSAYLRKELTAQRERYIQDTRIHCCLYFVNPTGHNLRPVDVIVMKKLSDVVNVVPVIAKSDSLTLEERDRFKAKIREEVLYHNIRLYPFDTDEDDEEEVHLNESIREIIPFAVVGSENNVVIDGKSVRGRRNRWGVVNVEDPTHCEFVNLRNFLTRTHLQDLIETTAQIHYEAFRSKQLLALKDGVQQRPPQQAQ

SEQ ID NO: 3236 - protein, 356 aa, Agaricus bisporus
  var. bisporus
  strain H97 / ATCC MYA-4626 / FGSC 10389
MFSLSLSAVFLAASLARAQVTGTFPPTPLYSKHFPHPTDLPEKVDTDQGLIRGTQFGYNICNSTTEGPTSLCQTSYVNGIEDFCLWSTPTEGKPISDTEGETVAYCSKKGYGTRVMPAGTIKGLQVIKTPSYISYVGFIDQTLLGLPADDFGGELDPHGADLRGNPMGGVVYSKNFTSDGLPTQVPDWNLFIGGGGFCMKICDPADPNAARYCENRLDRIGCAYNLPSNAQTGTFEVCEGDNMEFPGVYTSNGATLTYAQPAESLGPITTVPYTPVVPSSSNCVTYTSAQIYTDLVAPSGATSSGASGAAPTAAGQSTSTATGRGAGSTDSPNDASALAVSGISLLGVVFASLFFS

SEQ ID NO: 3237 - protein, 357 aa, Agaricus bisporus
  var. bisporus
  strain H97 / ATCC MYA-4626 / FGSC 10389
MSQQQSASAAANDIQERIAAARREAESLKEKIRAKKETSADTSLRAMAAEVDPLPRIVMRPRRALRGHLAKIYAMHWAADRRHLVSASQDGKLIVWDAYTTNKVHAIPLRSSWVMTCAYSPSGNYVACGGLDNICSIYSLNNKDGGTNARGARELSAHSGYLSCCRFINDRQIVTSSGDMTCMLWDIEAGVRVIEFSDHTGDVMSLSLAPSNNNVFISGACDATAKLWDIRTGRATQTFTGHESDINAVSFFPNGDAFATGSDDASCRLFDIRADRELNTFTHDNILCGITSVAFSISGRILFGGYDDWTCNVWDTLKGERVGVLTGHENRVSCLGVSADGMALCTGSWDSTLRVWA

SEQ ID NO: 3238 - protein, 359 aa, Agaricus bisporus
  var. bisporus
  strain H97 / ATCC MYA-4626 / FGSC 10389
MAADAPPTVYKEAPILIEWDSLPEEDQFKQQEAMTKFLEEPGTIEKFLADCKKIGQKAAAIEVDFRTVLTGFSSFAANYGAYCPDVVTSYLPRWVAMMNRWTGGLLWSSRALAIETADSLTEYGRVLALIADIKTQSELEGAQNALRAYVDKHPISVVTQIVDGFKNLGIDLQNFSDDFAKYVGTFSVSSSATLTLEASIKSIIQCQATFADLNEKVQKSAMALGCSSVFGILPDIPVSSIGQYVVQRNEVQANLIKTKSGIINSTTDSIIEIIIRYYALLAMQAEFEQYKPNIVNICQDLSTFASVWAFATEQAIEINVALNEGMEVLTRKKFQLKLALLIVQIQPLREGLRTYAAQI

SEQ ID NO: 3239 - protein, 355 aa, Agaricus bisporus
  var. bisporus
  strain H97 / ATCC MYA-4626 / FGSC 10389
MSAYENAPSLTAWESLTEDEQIEHQEEMTKILEDPDTLKQFSEACKNIGQTAVAIDENFRTVQKGFNDLVEKYGADFPDVGRVYVPKWAGFMARWNGDTGMLWSSRKLAAETAASLTDYGINLALIADIQSQDDLEGAQMELKQYVEKHPVEIATRVSDQFKDLRNDIGDFSKDFTAYIEEQKQKLTEDAAAFEADILKYQAEIAELNEKIKIAGITLGFSFIFGVFSAIPAGFLIDFLVKRGKAQENLNQAQANLARTIAKQAALAAMQADFEKLKPNIDQICNDLGVFASVWAFATEQTTEINIALDEGMEVLTRKKFIVKLNLLIAQIEPLKEGMRQYATQITPPSSFADAE

SEQ ID NO: 3240 - protein, 370 aa, Agaricus bisporus
  var. bisporus
  strain H97 / ATCC MYA-4626 / FGSC 10389
MVSRLVLARLAPALRRPSASLLARRLPPSLRTYATADSEHSMTVREALNMAMEEEMMRDEKVFILGEEVARYNGAYKVTKGLMDKFGEKRVVDTPITEMGFAGLAVGAALQGLRPICEFMTFNFAMQGIDHIVNSAGKTYYMSGGNVPCPVVFRGPNGAASGVAAQHSQDYAAWYGSIPGLKVISPWSAEDCKGLLKSAIRDPNPVVFLENEMMYGVPFPMSQEAMRDDFLLPIGKAKVEREGGDVTIVAHSKMVTHSLEAADILAKEGVKAEVVNLRSIRPLDIDTIIKSVKKTNRLLIVEGGFPAFGVGSEICAQIVESEAFDYLDAPVERVTGADVPTPYATNLESMAFPDTPLIVKVAKRALYRTN

SEQ ID NO: 3241 - protein, 353 aa, Agaricus bisporus
  var. bisporus
  strain H97 / ATCC MYA-4626 / FGSC 10389
MTDSTSTKPMRQRMEEYVNNLQEHIVTTFEKLDPDAPPFKRDSWIRTQGGSGRSCVFACPTGDEAGTKSHQSILEKAGVNISVVHGVLPPAAIRQMRADHTSMPLPDRPEGLPFFAAGISLVIHPRNPHAPTCHANYRYFEITEPVNDNTTSPKILAWWFGGGADLTPSYLYESDAKHFHTSIKNACDKHGTELYSSFKKWCDEYFLIQHRNETRGIGGLFFDDLNSGPHQRLSSDSGIKRPVTPDEVFAFVKEVGDSFTSSYIPILEARHATPYTEHHRRWQLIRRGRYVEFNLIYDRGTKFGLMTPGARTESILMSLPETARWEYMSELGTEEGTEEAKLVQVLKEPRSWV

SEQ ID NO: 3242 - protein, 389 aa, Agaricus bisporus
  var. bisporus
  strain H97 / ATCC MYA-4626 / FGSC 10389
MTTRDEFKQAPHNVPGPIEVADEVLFANAHPSMSHVSPDFVPVFGDCIRMTREVLLTKSGQPFLISGSGTLGWDQVAANLVESGENALVLNSGYFGDSFKECLETYGANVAQLKAPIGRAVALSDLEKELRSGKNYKIVTVTHVDTSTGVLSNAKEIASLVRKISPETLVVVDAVCSVASEEIHFDNWDLDIVLTASQKGLGTPPGLSILVASERAMNVFKNRKSPPSSYYASWKKWLPIMKAYEAGSPAYFATPPVNLIYAYRASLNSIVLGDLSLEKRLKLHRAASRRVKDAAKKLGLRQLPESEGEAANGMTALYYPEGLAASDILPRLAKRNIVVAGGLHTEIKDKYFRIGHMGITAVNEERGDIETIVRALEEAVKEARAAKST

SEQ ID NO: 3243 - protein, 412 aa, Agaricus bisporus
  var. bisporus
  strain H97 / ATCC MYA-4626 / FGSC 10389
MSPLIINKAVPGAREFYPLNEPEIGTLWRPDCQDREVPKLFQPLTIRGITFKNRIWVSPMCQYSADNGHLTEWHLVHLGGFATRGVGAVTVEATAVVPEGRISPEDSGLWTDTQIDPLRRIVSFVHAQATKIGIQLAHAGRKASTHAPWIEEAAGRGTLSIATKEENGWPDEVYGPSTLSYKDGKYPNPKEMTESDINKVVDAFIASTKRAEQAGFDFIEVHGAHGYLIHSFLSPLSNTRNDAYGGQSLENRLRFICTLVQRLREIWSKPLFVRISATDWAEGPEKDSDGKWLQWGIEQSTILATRLQTLGVDLIDCSTGGNWASQKIPVAPGYQVPFAAQLKKALPDLLVGTVGLITEAEQAESFLKEGKADVILLARALLRDPHWPLHAARKLGVKIKPAGQYERAWAAL

SEQ ID NO: 3244 - protein, 419 aa, Agaricus bisporus; identical to SEQ ID NO: 842
  var. bisporus
  strain H97 / ATCC MYA-4626 / FGSC 10389

SEQ ID NO: 3245 - protein, 431 aa, Agaricus bisporus
  var. bisporus
  strain H97 / ATCC MYA-4626 / FGSC 10389
MSGQPQKTWTNDPWRPEDKWTPAPKDPHPERIYKPEVLKTIEGTIQGFSDELRALSLDIHAHPELSFKEYYAHDAYTKFMKEHGWNVKEHHHLETAWEATFEYGQGGRVIGINSEMDALDGIGHACGHNLIGIAGVAVSLGLRAALQKHDIPGKIVLLGTPAEESGNGKVDLLEEGAYEGMDVCLMCHPAPGPLGSISLSGSLAIQPILTEYEGHTAHASLSPWEGRNALDAAILAYNNISALRQQIKPTHRIHGIFEGQDWAPNIIPDKAKFTCLVRAPTRAEMKETATRVYPCFEAGGLATGCKVTITPVGEIWELRQNKALSDEVANIILNHHGSIDYGWGISGASTDFGNVSYALPSLHPGFAIPTVPNGGNHTREFAKAAATVEAHKQCLIISIALAGTAIRVLTDDTYFEEVTRIFHAHNWRILM

SEQ ID NO: 3246 - protein, 427 aa, Agaricus bisporus
  var. bisporus
  strain H97 / ATCC MYA-4626 / FGSC 10389
MASSGLDVTKARSHFPALRSGYIFADNAGGSQASQEVIDRISDYLSNTNVQLGADYSVSVESTRRVLVQGPTEVAKLFNARSPDEIVFGSSSTLNLENLARGLEQDIQSGDEFIVTGEHEANAGVWKKLAKRRGAVVKVWHAKPLNPENPYSVSLQIDDLLPLISSKTRVVAFTACSNILGSIVPVKQVNQAIRAAAKSKGAKKVQISVDCVAYAPHRQIDVQDWDVDFCVFSFYKVYGPHISGLYVRHSILQTSVNSIVHHFLKVDDVAYKLQPGGPGYETVYGTTGVVSYLLSLTPASNLQASWDAIALHEQTLVEPLIQYLTEPKQWARGVRIVGDAAVNLTRVPTICFVVVGDRAIKSKDIVEVFDKKGGIGIRYGHFYAYTLVSELTPKLNVDDGVVRISLVHYNTIEEVNRIIEILKEVLV

SEQ ID NO: 3247 - protein, 436 aa, Agaricus bisporus
  var. bisporus
  strain H97 / ATCC MYA-4626 / FGSC 10389
MARHSFTALNSNFVVDAQYRMVKELGQGAYGCVIAAVHSSTGEGCAIKKITNINTKRILTKRCLREIKLLRHFRGHKNITCLYDMDIVFRSDGNFDEVYLYEELMEADLHAIIRSGQPLTDAHFQSFIYQTLCGLKYIHSANVLHRDLKPGNLLVNADCELKICDFGLARGYSPGGGTSRAAGNQGFMTEYVATRWYRAPEIMLSFANYTTAIDVWSIGCILAELLGGKPIYKGRDYVDQLNQILHYLGTPPEETLRRVGSPRAQDYIRSLPIKPRVPFSTLYPRANPLAIDLLGQMLHFDPIKRIGCEQALNHPYFAVWHDPADEPVCPSTFDFSFEEEDTIEGMKKLIVEEVRSFRTEVRNQAKASSQIRRQDSLPIPSREEIINSPVQEHAPPHGATSGFTMSSMGQRPASPVYDDPSADLERELASTHLGKR

SEQ ID NO: 3248 - protein, 457 aa, Agaricus bisporus
  var. bisporus
  strain H97 / ATCC MYA-4626 / FGSC 10389
MPSLRLGDTAPDFEAETTTGNIKFHEWIGNSWAILFSHPGDFTPVCTTELGEVARRAPDFQKRDVKLIGISANGLEDHHAWVKDINEYGSKFGHTDVRFPIIADGDRKISTLYDMLDYQDATNRDAKGLPFTIRTVFVIDPKKTIRLMIAYPASTGRNFDEIIRVVDSLQLGDKHRITTPVNWNKGDDVIVHPSVTSEEAKVLFPEHTVHKPYLRTTPLKDAGKLVQIEHALAAVSQGTTSLGIKATNGIVIATEKKTSSILIDDSVVDKVAVICPNIGIVYSGMGPDFRVLVTRARKSAQAYWKIYNEYPPTRVLTQDIANVMQQATQSGGVRPFGVSLLVAGWDINRGPSLYQVDPSGSFWAWKASAIGKNMINAKTFLEKRYNDDISLEDAIHTALLTLKEGFEGQMTEKTIEIGVVTVPTPQELESSAVGPNTRPKPTFRKLTEEEVRDYLAL

SEQ ID NO: 3249 - protein, 477 aa, Agaricus bisporus
  var. bisporus
  strain H97 / ATCC MYA-4626 / FGSC 10389
MSGFRFLNLVRPFLPILPEVSSPDRKVPFNQKVLWTAVTLLIFLVCSQVPLYGIMSSDSSDPLYWMRVILASNRGTLMELGISPIVTSGMIMQLLAGANLIDVDFSLKEDRALFSGAQKLFALIISLGQATVYVLTGLYGQPKDIGAGVCLLLIIQLVAAALIVILLDELLQKGYGLGSGISLFIATNICESIVWKAFSPTTVNIGRGPEFEGAIVALFHLLFTWNDKGRALREAFWRERLPNVMNLIATIVIFVVVIYLQGFRIEIPVKSNRFRGQRGSYPVKLFYTSNMPIMLESALTSNVFIVSQMLATRFPANLLVRLLGVWEPMEDSPQLRAVSGVAYYMSPPHTMKEAILDPIHTAVYILFIISACALFSKTWIEVSGSGPRDVAKQLKDQQMVMAGHREGSMYKELKRVIPTAAAFGGAMLGLLSVAADLMGAIGSGTGILMAVTIIYSYWEIGMRESGGPEMAALGDLL

SEQ ID NO: 3250 - protein, 493 aa, Agaricus bisporus
  var. bisporus
  strain H97 / ATCC MYA-4626 / FGSC 10389
MSSSAYLLPFDLSAEQKPVQGTKDVVAQALWSSTPSGDKPPKVGTTRTFFNHPNGMTTTISSLGDKFKDKKGNERRELVRKAVGSGIKDLKAYDGVKEVAVDASADPHAAAVAAHLALYKFSLKTTPPDRFNPNNKEAIPEQLSIKPLEQSKEWETGRVYAEAQNWARTLMELPANMVTPTNFAERVKKQFEGIPNVEIFVRDEAWAEKKNMNTFLSVTHGTSEPAKLVEIHYKGAANKSDRPLALVGKGITFDSGGISLKPGANMKLMRADMGGAATVVSAAWALATLQVPVNMITVTPLTENMPGPSATKPGDIIYAMNGKSVEVDNTDAEGRLILADAVYYTATEHNPHTLIDVATLTGAMVVGLGEHFSGVFSTSTELWEKLQAAGEVEYDRFWRMPLDDDYLPQIHSSNADLQNTGGAPGGSITAALFIKAFAEGCEPKDDKPATLNWAHIDIAGTMDATRPGPYQEKGLTGRPVRGLVAYVRGLANN

SEQ ID NO: 3251 - protein, 494 aa, Agaricus bisporus
  var. bisporus
  strain H97 / ATCC MYA-4626 / FGSC 10389
MMSIDHLKKRYETAGQGHLLKFWDGLSPADQKSLSAQLEALDIERVNRIYKKAIVTEAASNDSAAQAEAIEPLPRDATDSIVGNSEKQQEWRQIGLDAVSRGCVGVLLMAGGQGTRLGSSAPKGCYDIGLPSHKSLFQYQAERIARLQRVAELENGKQAGSVIVPWYVMTSGPTRRDTEEFFIKNSYFGLNAADIIFFEQGTLPCLTMEGKVLLDTPSRIAVAPDGNGGIYAATRSPLSPGKPDSVLSDLEKRGILYLHAYCVDNCLVRVADPVFLGYGIQKQADCAAKVVPKASPTESVGVVARRGNKYGVVEYSEISKEQAERRDSETGELAFRAGNIANHFYTTSFLKRVESFEDELAFHIARKKIPHVDLESGQPVKPSKPNGMKLEMFVFDVFPFTERFAVLEVERREEFSPLKNAPGTGSDDPDTSRRDLLAQHHRFLERAGASIKPGVTIELSPLVTYDGEGLQAVKGKTFTKSGIIGSIEELDVLV

SEQ ID NO: 3252 - protein, 482 aa, Agaricus bisporus
  var. bisporus
  strain H97 / ATCC MYA-4626 / FGSC 10389
MSDNKKQEKDFTAEVDALLPEADKIAKSGKLQEALDKLFVLEKQTRNAADLASTTRLAKAIIQYTYDARNHALLNSSIQTLSKKHGQLKAAIQAFVEQAIEWLPEIKSRDGVEKWLELVETLRGVTEGKIFLETPRARVTLLLSHHHEGLAKEASNPQKSKESLQTASDLLSDLQVETYSSMERREKTEFILEQMRLLIAVARIKDDEQGKGKDGKDTLGGGEAEWVKVRVGGRKVNEQFLAEKENEDLKLKYYDLMMQHALHSSAYLDVAKYYYKVWETPSIKEDVNGKGKTALEHIVYYVVLAPHNNEQSDMLHHLYVDPALAKLELHYNLVKCFVTKELMRWPGIQSIYGSFLRKTPVFKVEKQWEDLHTRVIEHNIRVIAEYYSRIKLERLRSLLDLSLKQTEEILSRLVVSGTVWARIDRPAGIVNFRSKRSAEEVMNDWSSDMQKLLGLVEKTWMGMNAAQAAQARVKAATATSSS

SEQ ID NO: 3253 - protein, 533 aa, Agaricus bisporus
  var. bisporus
  strain H97 / ATCC MYA-4626 / FGSC 10389
MSLSRHINAEEIIEKSKDHPQIKFANAARRHGPANTSHWNRDEDVAGLSKYTIPPKGVSSRSAYQLLHDEMALDGNPTLNLASFVHTYMPEEAKKLMVENISKNIVDQEEYPAAQLIHNRCISMIADLWKAPKDAKPIGTATAGSSEAIMLGGLAMKKRWQEARKAAGKDYFHPNIVFGSNAQVALEKFARYFDVECRLVPVTEEHDFVMNPHDALQYIDENTIGVMVILGSTYTGHFENVQLMSDLLDNLQQRTGLDIPIHVDAASGGFFAPFAYPHLKWSFEIPRVVSINASGHKFGLVYVGIGWVLWRDESLLHKDLIFELHYLGSTEYSFTLNFSKPAAPIIGQMFNFLNLGVDGFKRIAVKDLRNARMLSRALNGTYFKVLSSIHLPVHEDRGDDVPEHYRSGLPVVSFRLSDEFKAANPQVEQKWIQTLLKTKGWIVPNYNAPEGTEDVEILRVVVRESVSEDLVERLIVDIVEITESLQGSEGNLMATTSNSAVHHPEKHHGRPDPENFGKSHKPAKKQAGFSRQC

SEQ ID NO: 3254 - protein, 582 aa, Agaricus bisporus
  var. bisporus
  strain H97 / ATCC MYA-4626 / FGSC 10389
MSSSKGPDPILLTLFANRFMSVAEAMGRSLQQTSISTNIKERLDFSCALFAPDGDLVANAPFIPIHLGAMSFAVKYQMKLHGSSLKEGDVLMANSPVAGGSHLPDITIITPVFAPNSKEIIFFTASRGHHADIGGILPGSMPPTSVNIFQEGAEIESFKIVDGGIFDEKGLIEYMVEKPSQYPGSSGCRNIRDVQSDLKAQIAANHKGIQLIHAIVEDYGLETVQEYMYHIRNNAETSVRNLLKDVAKRAGSNILSAVDYLDDGSPISLRVEINETEGSATLDFAGTGSEVRGNLNAPISVVHSAVIYCMRAMLDMDIPLNAGCLVPLDIKIPKKSLLSPSRTAAVCGGNVLTSQRIVDVVLKAFHACAASQGCTNNLTFGTGGKDKDGKAEAGWGYYETIAGGSGAGPGWHGTDGVHTHITNTRIGDVEILERRYPVLLHRFGIRTGSGGTGKWHGGDGVQREIEFLEPMQVSILSERRTRQPYGMEGGNSGMMGKNTWIKKLREGDGDLDNNNETGTRDINIGGKATVFMGKGDRLLIETPGAGAWGVAEEDGRKKDFVHVRAWEPRGSIADRAAAQAAF

SEQ ID NO: 3255 - protein, 600 aa, Agaricus bisporus
  var. bisporus
  strain H97 / ATCC MYA-4626 / FGSC 10389
MAAVADGPVLDLAEKHPEVVDDKVNARDEVSSEVDEVDDVHAGLEFPTEEERLTLRRVADALPWTAYLIAFVELAERFSFYGSQVVFTNFIQQPLPPGSHTGAAGLIGQAGALGLGQKAATGLNTFYQFWCYITPLYGAYIADTRWGRYKTICIAVGIALVGHIILIIAALPGVIEKKSAVGAFVVGMIVTGLGTGFFKSNISPLIAEQYKRTKIFVITTRHGERVIVDPSLTVSRMYMYFYLFINIGAVIGQISMTYAEKFVGFYLAFTLPTVVFLLCPFVLYFGRHRYNRTPPTGSVFSTALRLWKLAARGRWSLNPMQTLRNMRADDFWENVKPSNIKVEDRPKWMNFDDLWVDEVRRGFKACAVFLWIPLYWLTYNQINSNLLSQAATMNTHGLPNDILSNIDPIAIIIIIPICDLLVYPGLRRLGINFSALKKITGGFFTGALAMTWAAVLQHFIYKTNPCHYSAATCKDAEGNAIVSPLNVWLQTGAYFLIAVSEIFASITGLEYAFTKAPTNMRSLVMSAFLFTSAIASAIGEAFVSLSTDPLLVWNYGSMAVIAAIAGALFWLSVRRLDRDEDKLNNLGSGHMEPVRRDKEM

SEQ ID NO: 3256 - protein, 625 aa, Agaricus bisporus
  var. bisporus
  strain H97 / ATCC MYA-4626 / FGSC 10389
MLSRALSRAHRPFLATKAAVRTQSSWSSGKYPLIEHEYDAVVVGAGGAGLRAAFGLAEAGFKTACITKLFPTRSHTVAAQGGINAALGNMTEDDWRWHMYDTVKGSDWLGDQDAIHYMCREAPNTVIELEHYGVPFSRTKEGKIYQRAFGGQSLKFGKGGQAYRCAAAADRTGHALLHTLYGQSLRHDTNFFIEYFALDLIMQDGECVGVIALNMEDGTLHRFRSHKTVLATGGYGRAYFSCTSAHTCSGDGNAMVARAGLPLQDLEFVQFHPTGIYGAGCLITEGSRGEGGYLLNSEGERFMERYAPTAKDLASRDVVSRSMTLEIREGRGVGPEKDHIYLQLSHLPPDILHERLPGISETAAIFSGVDVTKEPIPVLPTVHYNMGGIPTRYTGEVITVDENGQDKIVPGLYAAGEAASVSVHGANRLGANSLLDIVVFGRAAAHHIRDTLTPGKPHKDIPQEAGLESIEFLDKIRQSDGPEPTAKIRLDMQKAMQTDAAVFRTQETLDEGVAKMRQIYNNFEKVGIKDRSMIWNSDLVETLELRNILQNAIQTITAAAARKESRGAHAREDFPERDDATWMKHTLSFQPDISTPDVVLKYRNVIDKTLDENECKPVPPFKRVY

SEQ ID NO: 3257 - protein, 612 aa, Agaricus bisporus
  var. bisporus
  strain H97 / ATCC MYA-4626 / FGSC 10389
MLRLISPSSRHLLRYSSPHHRKFPQQFRAMSAEQPTGSHQDPVTGEMISKQELKRRVASRAKEARKAEKVSAAPPDGAKQKVEAKSREDDLSPNQYYELRSRHVQHLKQTQNPNPYPHKFHVSMSITEYVEKFGPEGVVAPGSKLQGPVVSLAGRIHNIRASGAKLKFYDLHGEGTKVQIMASQQDDEQPEKYIETHEHFRRGDVVGVVGVPSRTKMGELSISPSSMTLLAPNLHQLPSSHFGLKDQETRYRKRYLDLILNDNTREIFIKRSKIINYIRRFLDNKGFMEVETPITSLLAGGATAKPFVTHHNDLDLDLYLRIAPELYLKELIVGGLDRVYELGRVFRNEGIDLTHNPEFTICEFYMAYADYEDLMDITEAMIEGLVKYLTGGSTKLIFHPDGNKGQEGARQLELEFKRPWKRYDMISTLEEKLGVKFPPGDQLHTDESNKWLRELLVKHNVDCSEPRTNARMLDKLVGEYIEPLCISPAFIVGHPQVMSPLAKWHRSRPGLCERFEGFLCGKEICNAYTELNDPFEQRLRFEEQTRQKNQGDDEAQGVDEVFIDALEHALPPTGGWGLGIDRLVMFLTDSTNIKEVLLFPAMKPIENPPAAS

SEQ ID NO: 3258 - protein, 662 aa, Agaricus bisporus
  var. bisporus
  strain H97 / ATCC MYA-4626 / FGSC 10389
MADTHIGVATHPVAPRVAQGTKTPHVGPDIHAYRAAHAQTVGDGSDEWWAKIARETLHWDRPFKTVRSGGFGTGDVVWFPEGGLNASYNCIDRWAYKNPNKTAIVYEADEPGEGCEVTFAELLREVSGIANVLKSFGVKKGDTVSIYLPMTWQGVAAFLACARIGAVHSVVFAGFSAEALRDRILDCKSRVLITSDEGRRGGKTIATKAIVDSALTKCPVVEHVLVLKRTGSNVPWTAGRDKWWHEEILKVPSYCPPEVMSSEDPLFILYTSGSTGKPKGVVHTTGGYLLCAALTNKYVFDVHEDDRFACMADIGWITGHSYIVYGPLANGVTTTVFESTPVYPSPSRYWQTVEKHRLTHFYSAPTAIRLLRRLGAHHVENHDLTSLRVLGTVGEPINPEAWHWYNDHVGKKQCAIVDTFWQTETGSIIVTPFPGAIETKPGSATVPFFGIEPAILDPTSGKELEGNSVEGILAIKNPWPSIARTIYQDHKRYLDTYMQPYPGYFYTGDGAARDEHGYIWIKGRVDDVINVSGHRLSTAEIESALIMHPGVAETAVIGTADDLTGQAVYSFVTLKPEFKYNQDDESSLTKELVLQVRKIIGHFAAPKKIFIVPDLPKTRSGKIMRRIMRKIIAGEGDQLGDLSTLAEPAVVDVIKQKVAAST

SEQ ID NO: 3259 - protein, 675 aa, Agaricus bisporus
  var. bisporus
  strain H97 / ATCC MYA-4626 / FGSC 10389
MSPSVRHPTRTQSRTLLSSLSILFLAALAVLCFFPVAAHAEETHPEYGSVIGIDLGTTYSCVGVQRGGRVEIIANDQGHRITPSWVSFTDDERLVGDSAKNAYHSNPQNTVFDAKRLIGRKMNEPEVKRDMKHWPFKVTEKNGKPSISVEHKGEERQFSAEEISAMVLGKMKETAEAYLGHKVTHAVITVPAYFNDAQRQATKDAGTIAGLHVLRIINEPTAAAIAYGLNKGSGESQIIVYDLGGGTFDVSLLSIDDGVFEVLATAGDTHLGGEDFDNRVIDYFVKSYKKKTGTDVSKNLRALGKLKREVEKAKRTLSSQQSTRIEIESFEDGNDFSETLTRAKFDELNMDLFRKTMKPVEQVLKDANVKKDEIDEVVLVGGSTRIPKVQQLLKEFFNGKEPSKGINPDEAVAYGAAVQGGILSGAEGTDGVVLVDVNPLTLGIETTGGVFTKLIPRNTVIPTKKSQIFSTAADNQPTVLIQVFEGERSLTKDNNLLGKFELNGIPPAPRGVPQIEVTFEMDANGIMKVSAADKGTGKSEGITIKNEKGRLSQEEIDRMVADAEKFAAEDEANRKKIEALNSLSSFVYGLKNQVTDSEGLGGKLDSDDKQTILDAVKEATEWIEENGSTASVEDLEEKLAEVQGVVNPITTKLYEGAGADGPSGDDDFEFDHDEL

SEQ ID NO: 3260 - protein, 780 aa, Agaricus bisporus
  var. bisporus
  strain H97 / ATCC MYA-4626 / FGSC 10389
MGGKGKAPETSARLRKRQDNGTSSYSGSVTSESVQNDEHVAEIFQSPRSRSQVEQMLDTPSASMVVVAILTTIAFALRFYKISHPDQVVFDEVHFGKFASYYITRQYYFDVHPPFAKLLFGLAGWFVGFDGEFTFDNIGDNYTLNNVPYIGMRALPAVLGSLTIPIVYAIMKESGYSTIIAAFSASLILFDNAHITQSRLILLDATLIFFMALTIYAYVRFRKLRYREFTTEWWVWLVLTGVFMACTWGSKVNGILTVACIGIAVLIDLWDILDHKKGTTMDYFYQHFIARAIGLIVIPFVVYLTFFYIHFSILVQSGSGDLYMSPAFQETLAGNEMLLNSAEIRYHDIITMKHKDTKVFLHSHAENYPLTYEDGRISSQGQQVTGYAHDDTNNFWQIIPTKAIPETGPGRVVHNGDVVQLLHVNTQTYLLTHDVASSLMPTNQEFTTWPKDDYKRYNDTLFAVNLIDSDSASWKTKSGYFRLVHVPTKVSMWTHTTPLPEWAFKQQEINGNKNSVEKTAIWFVNEIVDTDDPEGLDNRLEERPSKKPKSMNFLRKFAELQLLMLQHNAGLTGSHPYASTPINWPFSLTGISFWTENDSQKQIYLVGNLLGWWACVVGLSIYIGILGADLIARRRGLDPIADPVRNRLWNNTGFFMLVWAVHYLPFFLFSRQLFIHHYLPSHLASAMIAGSVLSFILSDTINFPISLRGPKTRPQTTQYADVGTKGVVTTVIFSLVMFVMFSYMAPLTYGSPGLTGEEVNSRRLLSTWTLHFAAKKTYDA

SEQ ID NO: 3261 - protein, 814 aa, Agaricus bisporus
  var. bisporus
  strain H97 / ATCC MYA-4626 / FGSC 10389
MADPSGAPPQPGPDDVSTAILRPKKSPNRLIVDEATNDDNSVGTLNPATMELLGLFRGDTIIVRGKKRRDTVLICLSSDDVEEGRIQMNKVARNNLRVKLADLVNVHQCLDIKYGKRVHILPFDDSIEGLSGNIFDVYLKPYFLEAYRPVRKGDTFLVRGGMRTVEFKVIETDPSEFCIVAQDTVIHTEGDPVKREDEESNLADVGYDDIGGCRKQMAQIRELVELPLRHPQLFKSIGIKPPRGILMYGPPGTGKTLMARAVANETGAFFFLINGPEIMSKMAGESESNLRKAFEEAEKNSPAIIFIDELDSIAPKREKTNGEVERRVVSQLLTLMDGLKARSNVVVMAATNRPNSIDPALRRFGRFDREVDIGIPDPTGRLEILRIHTKNMKLADDVDLERIAADTHGYVGSDIASLCSEAAMQQIREKMDLIDLDEDTIDAEVLDSLGVTMENFRFALGTSNPSALRETVVEVPTVTWDDIGGLEKVKLELQETVQYPVEHPDKFLKYGMSPSKGVLFYGPPGTGKTLLAKAIANECNANFISIKGPELLTMWFGESEANVRDVFDKARAAAPCVMFFDELDSIAKARGGSSGDGGGAGDRVLNQILTEMDGMNQKKNVFIIGATNRPDQIDSALLRPGRLDQLIYIPLPDEVSRISILTAALKKSPVAPEVDLNFLARKTHGFSGADLTEICQRAAKLAIRASIDADIRAEREKTARQEAGEEVMEEEVEDPVPMITREHFEEAMQYARRSVQDSDIRRYEMFAQNLQQSRGFGNNFKFPESGDSAAGGAPGAPAGNAGFQQEDADDDLYA

SEQ ID NO: 3262 - protein, 834 aa, Agaricus bisporus
  var. bisporus
  strain H97 / ATCC MYA-4626 / FGSC 10389
MKIAVATSGGDSAGMNAVVRAVVRSGILKGCEMWVVREGYEGLVRGNSQAVQNEGDLINAAAQSAAMDGAAIMKDADHVPDQNLTHNLRFGDGELLKDGTAESVGGRTLKGRYIVRVGWDDVRGWYSQGGTLIGTARSASFRAREGRLAAAHNLVKEGINALIVCGGDGSLTGADIFRSEWPSLIQELRDEGTISEEQLQSHTHLRLCGLVGSIDNDMSLTDLTIGAPTAVHRISEAIDNINSTAYSHSRAFIVEVMGRDCGWLAILAGVAGGADFIFIPERPPKVNPWEDDLCAEIKKHRALGKRKTIIIVAEGAQDLDLKPIRAEYIKDVLTERLGLDTRVTTLGHTQRGGPPCAMDRILPTLQGVEAVEAILESKPGTPTYMIGIQENKITRVPLMQAVEATRNVARLIKSKDFDNALAARGSDFLGYYEAFGSVSSLFDESSKLPLELRMRIGIIHTGAPAGGMNTATRAIARYCIRQGHIPLAIHNGFRGLLDGNVNELNWLSVDAWSPRGGSELGTNRCLPSMDIGAVAAQFQAYDFHGLVIIGGFEGFQSLLQLEQGRKHYPAFHIPMTHLPATISNNVPMTEYSLGSDTSLNTLVTACDAIKQSASASRDRVFVIETQGGRCGYIATMGALATGATLVYTPEDGISLDMLRQDVKFLRTRYAFDVKGKREGRIIIRNEASSDIYSTPVLTKMFEEEGGHLFDARSASLGHTLQGGVPSPMDRVHAVRLSIKCMQFLEVHHRESVAQGHKRNNADGDTAAVITIQSSSLKWVPVQEVYRHADMKNRRGKDTWWAGIKKLAENLGAKPQFLGLHTSSFESPRPSDLTL

SEQ ID NO: 3263 - protein, 1117 aa, Agaricus bisporus
  var. bisporus
  strain H97 / ATCC MYA-4626 / FGSC 10389
MLPVVIPLTMALSTFVLRILSPAFVLFTSLSLLSLRPSSPGSSSPITSVVVANIIPRRAAILSLLSIVSISYFLDGAAFVVYVVYEKVWPHHTGIEINSLLGVAAFAGLAALGAWKDVHGAPVWTLRRIKLVVALALLLDLALVVLLGLRIQQTRNENIPHIPETPPHVPVKDLLHFAFPAFRVLLLIPLLASLSSPRVVYASVETQDSDATLANDSTFLLPSDAGNTLSAGDPSVIAPKASKYGTFRDPRSNLQASAPATRPTTPAPSTVQTVQDKPESKAEISLEPDWSEIWRRLKRLTPYLWPSKSRYLQLLASFCVCILLVERVVNVAVPLILGLLVDILEGRSSLSPWIILLGFVCLRFLQGSGGLAAIRDSLWAPVMQYSDREMSQLSFDHILNLSFAWHTRRKTGEILRVLDRGAAINHTLELILFNIIPTFIDIFIALIVFCILFDWQIAAVIFLVMIAYVIEIFSVYASVTLTRYRTRVRRQMNDRDVITRGIHTDCLLNYETVKYFSGEEHEGERYREAIREYQALEYKVIIYLNLLNLVQNFIITLGLLGGSFMVAYRITQHPEDGSRKFVSFITYLTQLYGPLNQLGYIYRSVNQSLVDTERLLALLNEPSEVNDKENAPDLAVTSGEIEFDNVSFSYDYRTTALNGVSFKVPKGSSVALVGESGSGKSTILRLLYRFYDLREGEGRILIDGQDIRDVTQRSLRQAIGVVPQDPILFNSTIGYNIGYGKIGATPEEIEEATKSAQMHDRIMSFPDGYNTKTGERGVRLSGGEKQRVAIARTLLKNPPILLLDEATSALDTSTEKDIQKALQNLVQGRSSLSIAHRLSTIISADLILVLKEGQVVEQGTFKELLAYDGLFASMWADQVSATEDPAVSLAAGSVDRGVVLENSEDDERPVQEQISKDAFIIPSQGSHIVPSPKPLSVVDLPSSESALQKDDKAKTTEGVSFPSAEPYDVSEDRTTVAEAPPQPDVSSPPLAFPTSPEPERDDQGSSIRVAPAVTFGADVNSSRIGTPDLDSEPKRKRISSQNFQRLARRISVSAKRQGSSMIPSSMIPTIPGLMKRDSSPRVSVDDSNQRDVDSATGSIKGDDKGKKKKDKKDKTRK

SEQ ID NO: 3264 - protein, 1154 aa, Agaricus bisporus
  var. bisporus
  strain H97 / ATCC MYA-4626 / FGSC 10389
MSSTAIREYDAKLLLAYWLERAPPVAPHAQIKTNFQYPAARVAQISWDPATNTITPDTQIPSWVNNSKLVAKPDQLIKRRGKAGLLALNKSWPEAKQWITERAGKPQKVEAVTGTLNNFIIEPFLPHPSNTEYYVCITSQREGDRILFTHEGGVDIGDVDAKALILDIPVIAPFPTREDIASTLLKHVPAEKKDTLVDFLIRLYSVYVDLHFAYLEINPLVVLDAVNGGEPAIHYLDMAAKLDQTAESICGPKWAIARDLSVYEGGGSATTTKGSKVSADRGPPMVWPAPFGRDLTKEEAYIQKLDGSTGASLKLTVLNPEGRIWTMVAGGGASVVYSDAIAAHGFAHELANYGEYSGAPTEGQTYEYAKTIIDLLTRGNSRPDGKILIIGGGIANFTNVAATFKGIIRALKEYRNQLINHNVKIFVRRGGPNYQEGLKAMRLLGESLGVPIRVFGPDTHITEIVPLALGVDISQSRTASDDGLKSVQPGTPPPQVAAVGVTEDSVGTIHPDGGRTQPKDHIVHFEAGKASKRPWFRPFDAETRSFVYGLQPRAIQGMLDFDYSCGRATPSVAAMIYPFGGHHIQKFYWGTKETLLPVYTSLKDAVAKHPEVDVVVNFASSRSVYSSTLECLEFSQLKAIALIAEGVPERHAREILWKAKEKDVLIIGPATVGGIKPGCFRIGNSGGMMDNITSSKLYRPGSVGYVSKSGGMSNELNNILSLVTNGTYEGIAIGGDRYPGSTFIDHLLRYETDPDCKMLVLLGEVGGIEEYRVIEAVKTGKITKPIVAWAIGTCAKMFTTEVQFGHAGSMANSDMETADAKNRAMRDAGFIVPDTFEELPRVLRETYESLVRSRVIVPKKEVEPPVIPMDYKWAQELGLIRKPAAFISTISDERGQELLYAGMRISEVFKEEIGIGGVMSLLWFKRRLPSWATKFIEMVLMLTADHGPAVSGAMNTIVATRAGKDLISSLASGLLTIGSRFGGALDEAASMFSQAHDTGLTPREFVDSCRKANKLISGIGHKIKSVNNPDLRVELVKEYVIKNFPSHTLLDYALAVEKVTTSKKDTLILNVDGCIAVCFVDLLRDSGAFAPDEADEYIKIGALNGLFVLGRSIGFIGHHLDQKRLKAPLYRHPADDIFINMADVSQPRVLGRMQ

SEQ ID NO: 3265 - protein, 1107 aa, Agaricus bisporus
  var. bisporus
  strain H97 / ATCC MYA-4626 / FGSC 10389
MNDTMEVLDEKANGALMQDIEEIIPVTNHEAFVLKHMPDLGHDVKDFKVFTWHLANWKKLDKKLTGPEFDCGGHKWRILLFPFGNSNAPPNDTVSVYLDYAEPKKSPEGWHACAQFALVISNPNDPTIYTVSHAHHRFIAEECDWGFTRFSELRKLFSIQEPQSRPTIEDEAADITVFVRVLEDPTGVLWHNFVNYDSKKETGYVGLKNQGATCYMNSLLQSLFCTRYFRKAVYQIPTEEDIPTESVPLALQRVFYHLQSSDQPVGTTELTKSFGWKSLDSFLQHDVQEFNRVLQDKLEAKMKGTKAEGAIAKLFVGKMKSYIKCVNVEYESSRIEEFNDIQLNVKGMKDLHESFKDYVAVETLDGENKYHAEGYGLQDAKKGIIFESFPPVLHLQLKRFEYDIQRDAMVKINDRHEFPFEIDLSEFLDPAADRSQPWIYKLHGVLVHSGDLHGGHYFALIKPDAESRWLKFDDDRVTPVTDKEVLEENYGGEAINGLPPALQRNQVRAMKRFTNAYMLVYIRQSALIDVLPPFTEEDTPPHLKRRLDEERLQLEAKKREREEQHLFLTAKVITDETFARHEGFDLATFDEKNWPASDLPTFRVLKTETYSTFKNRVAQHFNFPENQIRLWVLVNRQNKTVRPDTHIPENEPALTVEVIRNNMAARQNDLRLYLDVIPDPSKPEPPAQSIMIFLKHFDTSKQTLYGLGKVYVLRNAKVGDLVPVINERMRWTPGTPLKLFEEIKPGMIEQMKPKFTFAQSEIQDGDVICFQIDLPEKEIHDYDAQGLYSNPLQFYDFLQNRVMIIFKPKYDEPDHDHPEFSLILSKKHNYDIMATKAGEYLRHDPIKLRFTTTHAGNGSPKSVLRRSLNQSISEIMGPNYINPSTTVILYEKLEVSIVELETKRSLKVIWTGVHNKEEATHPFLLPKTSPVHELADHLSKLVTLTPNGSHKIRIFEVSKDGKMQKEFTGSEMIGNIPDPVELFAEEVPKEEVEADESDKVIGVFHFSKDLTRTHGVPFKFVVKRGEKFIDTKKRLQERIGVTDKEFAKYRFALIQASTFKQPSYIEDGTDDTIYEHQFAPEDVLGLDHFDKSGRARTGGEKAIVIRG

SEQ ID NO: 3266 - protein, 1789 aa, Agaricus bisporus
  var. bisporus
  strain H97 / ATCC MYA-4626 / FGSC 10389
MSARPGRISQEGYSSASPSADTHLHDPFSSANGHGRRGYYDTESDIDYTRRDGYRETYASDGSSPALNEPGYYDNNPAYDMYPPQDTDSDGDVYQRYNVPPSSESLGPQGRVPFPDASTPTFLESSVPGASRDSYPAWTPENNIPLSKEEIEDIFLDLTQKFGFQRDSMRNMFDFLMQLLDSRASRMPANNALISLHADYIGGHHANYRKWYFAAQLDLDDAIGKTQNPGLNRLKSTRGKQQRPSEKTLLSALERWRQAMNNMSQYDRLRQIALYLLCWGEGAQVRFVPECLCFIFKCADDYYRSPECQSRVDPVPEGLYLRSVIKPLYRFIRDQGYEVMDGKFVKRERDHDEIIGYDDVNQLFWYPEGIARISLRNKTRLVDLAPALRFMKFHEIDWERAFYKTYYEKRSFGHLIVNFNRIWVIHISMFFYYTAYNTPRIYLPPGGSAAMTWSATALGGAVATVIMILATLAEFSYIPTTWNNTAHLTRRLIFLLITLALTCGPTVYIAIVEHNGGGGSVALILGIVQFFISVVATVLFAVFPSGRMFGDRVAGKSRKYLASQTFTASYPALDKSKRFGSILLWLLVFACKFAESYFYLTLSFSLPVAVMVGMKVQGCNDRIFGDALCTNQAAFTLTIMFIMDLVLFFLDTFLWYIIWNTVFSIARSFTLGLSIWTPWKDIYTRLPKRIYAKLLATQDMEVKYKPKVLVSQIWNAIIISMYREHLLSINHVQNLLYHQVDTGAGGRRSLRAPAFFVAQGDKGKKPEFFPPGSEAERRISFFAQSLTIAIPEPLPVHAMPTFTVLTPHYSEKTLLSLREIIREEDQNTRVTLLEYLKQLHPVEWENFVKDTKILAEESAMFNGNNPFANEKEGGSKVDDLPFYFIGFKSAAPEFTLRTRIWASLRAQTLYRTVSGMMNYSKAIKLLYRVENPEVVQMYGGNTDRLEQELERMARRKFKFLVSMQRYSKFNKEEHENAEFLLRAYPDLQIAYLEEEPPRKEGGDPRIFSCLVDGHSEFVPETGRRRPKFRIELPGNPILGDGKSDNQNHAIIFYRGEYLQLIDANQDNYLEECLKIRNVLGEFEEYAPPAQSPYLQWGLKDFKKPPVAIVGAREYIFSENIGILGDLAAGKEQTFGTLAARSMAWIGGKLHYGHPDFLHGLYMNTRGGVSKAQKGLHLNEDIYAGMNAFGRGGRIKHTEYYQCGKGRDLGFGTILNFQTKIGTGMGEQMLSREYYYLGTQLPIDRFLTFYYGHPGFHIHNMLVILSVHTFITTMVFLGTLNSNLRICQYTPSGQMIGGQGGCYNLVPVFEWIDRCIISIFLVFMISFLPLFLQELVERGTWKAVFRLAKQFGSLSPVFEVFSTQIYTHSILSNLTFGGARYIATGRGFATTRIYFSILFSRFAGPSIYLGFRTLIMLLYVTLTFWTNWLIYFWVSIVALCIAPFLFNPHQFVFTDFVIDYREFLRWMCRGNSRSHNNSWIGYCRLSRTMITGYKKKKLGHPSEKLSGDVPRARWRAVIWSEIIFPVCFAILFVVAYMFVKSFPDEDGNFGPSGLVRIAVISLGPIVFNAAVLLVLFIFSVFLGPMLDPVFPKFGSFMAFVAHALGTLGMIAFFEFLWYLERWDASRVVLGVIAVIAIQRAIHKILISVFLTREFKHDETNRAWWTGRWANRGLGSHLMSQPAREFIVKIIELSLWSSDLILGHMILFMLTPPILVPYFDRFHATILFWLRPSKQIRAPVYTNKQRRQRRWIVIKYGLFYVFVIALFIALIAIPALLHDRINIDCSFCQSL

SEQ ID NO: 3267 - protein, 89 aa, Agaricus bisporus
  var. bisporus
  strain H97 / ATCC MYA-4626 / FGSC 10389
MASSTVNVVRYTALFSGVLYGWYHRRTVQAENQKHQIEHAIHNRERLIAEARDAWKRKQDALKDTTVVTDPEDPRFDLDKLIAKWEESS

SEQ ID NO: 3268 - protein, 123 aa, Agaricus bisporus
  var. bisporus
  strain H97 / ATCC MYA-4626 / FGSC 10389
NGGRNKKGRGHVKFMRCSNCSRCVGKDKAIKRFTVRNMVESAAVRDINEASVYPEYVIPKLYIKIAYCVSCAIHSHVVRVRSREGRRNRAPPPRIRWKDGKKVNPAVAAAEDAKAAAAGGAKA

SEQ ID NO: 3269 - protein, 138 aa, Agaricus bisporus; identical to SEQ ID NO: 542
  var. bisporus
  strain H97 / ATCC MYA-4626 / FGSC 10389

SEQ ID NO: 3270 - protein, 120 aa, Agaricus bisporus
  var. bisporus
  strain H97 / ATCC MYA-4626 / FGSC 10389
MLAERMAKHKVDCWLINTGWTGGKFGSGKRCPLKYTRRIVDAVHSGELAKCEYENFGTFNLSIPTALEGVPRELLNPSLAWKDKEAFNKEVRKLGSMFQRAFALYEKDVEPKVREAGPQI

SEQ ID NO: 3271 - protein, 135 aa, Agaricus bisporus; identical to SEQ ID NO: 576
  var. bisporus
  strain H97 / ATCC MYA-4626 / FGSC 10389

SEQ ID NO: 3272 - protein, 147 aa, Agaricus bisporus
  var. bisporus
  strain H97 / ATCC MYA-4626 / FGSC 10389
MAPKPASTAGKAPASTASKAPAKSAEGAKAAKKTSKPVATGADGEKKKRKKVRRETYSSYIYKVLKQVHPDTGISNKAMAILNSFVNDIFERIATEASKLASYSKKSTISSREIQTSVRLILPGELAKHAISEGTKSVTKFSSAGSK

SEQ ID NO: 3273 - protein, 147 aa, Agaricus bisporus
  var. bisporus
  strain H97 / ATCC MYA-4626 / FGSC 10389
MALRRITRELNDLGRDPPSSCSAGPTGENMFQWQATIMGPGDSPYSGGVFFLSITFPTDYPFKPPKVSFTTKIYHPNINANGSICLDILRDQWSPALTISKVLLSICSMLTDPNPDDPLVPDIAHLYKTDRARYEATAREWTRKYAM

SEQ ID NO: 3274 - protein, 140 aa, Agaricus bisporus
  var. bisporus
  strain H97 / ATCC MYA-4626 / FGSC 10389
MASRLFLTADCLFCKIIKGDIPSLKLIETEFSYSFLDINPLSKGHALIIPKYHGEKLTEIPDEYLNDTLPIAKKIAVAQGVKEYNILQNNGALAHQVVGHVHFHVIPKPSAEEGLGIVWNHTTPPSEELKKVFEEIKSRL

SEQ ID NO: 3275 - protein, 145 aa, Agaricus bisporus
  var. bisporus
  strain H97 / ATCC MYA-4626 / FGSC 10389
MGSNKPRGLQAARKLRDSRRENRWADKLYKKRALGNVFKTSPTGGSSHAKGIVLEKVGVESKQPNSAIRKCVRVQLIKNGKKVTAFVPNDGCLNFVDENDEVLISGFGRSGKAKGDIPGVRFKVVKVSGVGLLALWKEKKEKPRS

SEQ ID NO: 3276 - protein, 149 aa, Agaricus bisporus
  var. bisporus
  strain H97 / ATCC MYA-4626 / FGSC 10389
MKLEIDSFSGYRIYPSKGRLFVRGDSKVFRFSSAKTQSLFLQRKNPRKIAWTQVYRRMHKKGITEEVAKKRSRRTVKHQRGIVGADLATIAARRNQTAAVRQQARLAAITKAKTEKKEKEAKKAKPTRQAAPSGPKVSKQQMKGGKGGR

SEQ ID NO: 3277 - protein, 159 aa, Agaricus bisporus
  var. bisporus
  strain H97 / ATCC MYA-4626 / FGSC 10389
MSSTAWTMSLEDRKRLIEAAFEAKNGTYSPYSKFPVGAALMAADGSIIKGANIENASYGATICAERTALVKAISEGVRSFVALAVTSNVKSAISPCGICRQFIREFCSLDMPILLVPGDYPQAGKSEPGYSEGGVRDTTLGELLPMSFGPEDLELPRRK

SEQ ID NO: 3278 - protein, 147 aa, Agaricus bisporus
  var. bisporus
  strain H97 / ATCC MYA-4626 / FGSC 10389
MLISKQNRRIIYENLFKEGVLVAKKDFNAPKHEDLDVPNLEVIKALQSLTSRGLVKMQFSWQWYYYVLTPEGVEYLREWLHLPAEIVPATYKKAARPTRPAGIRSGGEGAYRPPRGDRDDYRKKEGAPEGFSQKTQYAGVGRGGPRE

SEQ ID NO: 3279 - protein, 167 aa, Agaricus bisporus; identical to SEQ ID NO: 501
  var. bisporus
  strain H97 / ATCC MYA-4626 / FGSC 10389

SEQ ID NO: 3280 - protein, 168 aa, Agaricus bisporus
  var. bisporus
  strain H97 / ATCC MYA-4626 / FGSC 10389
MLLYEDILTGDEMFSDAFPFKEIDDVVFEVDCKMISVKAGVDVNIGANPSAEDQEEALEEGTSQVNNVVQSFRLQTTSFDKSSYKTYLKSYMKAVSAKLKESNPERASAFEKKAIEYVKKVLANFKDYEFYTGGGMDPDGMVALLNYREDGVTPYLTFWKDGLKIVKL

SEQ ID NO: 3281 - protein, 180 aa, Agaricus bisporus
  var. bisporus
  strain H97 / ATCC MYA-4626 / FGSC 10389
MPAYHSTFNELPDTRQVGNLAVLPFRTRIRGPAPIGDPSQYDIIDETLDLFRANSLFRNFEIKGPADRTLIILILYVSDCLAKLGSQRATPSQIEAGKLLNTLSVDNFAIPGDATFPLNAHYAAPASRANSEYLRGYLTQARQELAARLAEKLYADGTGKPSKWWMSFQKRRFMNRSLGS

SEQ ID NO: 3282 - protein, 202 aa, Agaricus bisporus
  var. bisporus
  strain H97 / ATCC MYA-4626 / FGSC 10389
MTIYYLLTFLLLAAEMVTFCVLVSPLPFYVRKRVLTLLTTSTFVSRIAYGLKISFIFVGILFADALQRMYRITVEAESAKSTSSGAIDARSESNLHARKFYSQRNVYLTGFCLFLSLVLIRTFQIMRDLIQTQEECGQLKKKANGKQPEDNKEVADLKKKLAERESEYGILKKQAGQNAKEYDRLATEYNKVSGQTSDKRRD

SEQ ID NO: 3283 - protein, 207 aa, Agaricus bisporus
  var. bisporus
  strain H97 / ATCC MYA-4626 / FGSC 10389
MSSNAIDFPFAHEDVVQKTVDDVRTLSNMSAAADQGVHDVNHSSKTLAERYKDDITALAVLPPRVDEFAKSFNDILWAGRTSATHGVSRITDFVDVTVVGIVEDIKTPEDRDEAVIELNAIAGQKSKPVDGFPGATRRLDGIWNTHRLMPPTSRRSLRKQLISRRQSSLLPCQSRLQKGSGSPQSIRVQHLNGCNYICGAIAVLISV

SEQ ID NO: 3284 - protein, 211 aa, Agaricus bisporus
  var. bisporus
  strain H97 / ATCC MYA-4626 / FGSC 10389
MAEGSNYDYLFKVVLIGDSGVGKSNLLSRFTRNEFNLESKSTIGVEFATRSINVDGKTVKAQIWDTAGQERYRAITSAYYRGAVGALLVYDIAKHATYVNVTRWLKELRDHADTNIVIMLVGNKSDLKHLRAVPTDEAKTFASENGLSFIETSALDASNVESAFQTILTDIYRIVSAKSLESSTSNIEPPKESISVGITQDTKQQQGKTCC

SEQ ID NO: 3285 - protein, 220 aa, Agaricus bisporus
  var. bisporus
  strain H97 / ATCC MYA-4626 / FGSC 10389
MATHALLQALRANKPAFGAWLTSPGLFHARTLAKSSPYLSWIAIDCEHGIIPLVPGAAESTVAIESAGVSPLIRIPATGATGSTSWQIKNALDAGARGVIVPMVSNADKAREIVGDCKFPPKGRRGFGSPFTHTTWGMNVPQYLESANENILVMVQIETKEAVENVREIAQVDGIDVLFIGPYDLSISLGYPPPSPDPHPDIEQVIQKILKEAHDAGKKW

SEQ ID NO: 3286 - protein, 221 aa, Agaricus bisporus
  var. bisporus
  strain H97 / ATCC MYA-4626 / FGSC 10389
MLSIARTALRSRTILTRGLAARAASVHTLPPLPYAYDALEPHICEEIMKLHHTKHHQTYVNGLNAAEEAYAKTDDIKAKINLQSALKFNGGGHINHSLFWKNLSPTSEHGGKLGDGPLKDEINNAFGSIDEFKKKFNAATAAIQGSGWGWLGWNSSTQQLEIVTTANQDPLLSHIPIIGIDIWEHAFYIQYKNVKPDYLNAIWNVVNFEEAEQRLLAAAKK

SEQ ID NO: 3287 - protein, 240 aa, Agaricus bisporus
  var. bisporus
  strain H97 / ATCC MYA-4626 / FGSC 10389
MDHIDFNRLKTGEVNLGTSIMAVQFQNGVVIGADSRTTTGSYIANRVTDKLTHVHDRIYCCRSGSAADTQAVADAVHYQLQMYTQMSGGPPPVHTAAALFQRICYENKDGLSAGIIVAGWDKEAGPSVYNIPLGGGLFRQPWAIGGSGSTYVYGYCDATYKEGWGRDETVDFVKNTLALAMSRDGSSGGVIRMCVITEEGVERLFVPGNELPKFWEGAEVLGHAKKINQAEGLAPMVVEA

SEQ ID NO: 3288 - protein, 220 aa, Agaricus bisporus
  var. bisporus
  strain H97 / ATCC MYA-4626 / FGSC 10389
MSFPTDPFEQLHYNMVRAHQTFKLGYDAILKNLENNQEAIKSDLPNFLGYCQAWVISIDTHHDSEEEIVFPFLNQKMDFEPEKEAHKVIHKGLSDITAIVTQFKADPSKFDPDHLKENLVKLKDPLFEHLDIEVEHIKSSKLKEVGFGDAELKDLNQRLDKYAQSHGDPFLVVPYMRSHTPPELKNVWPPMPWVLRKVVIPYVLAWKHSGYWKYAPYSVS

SEQ ID NO: 3289 - protein, 251 aa, Agaricus bisporus
  var. bisporus
  strain H97 / ATCC MYA-4626 / FGSC 10389
MPRQFFVGGNFKMNPIDRATEASLVGGLNKATLDPTTEVVIAPPAIYLISVKASVRPDVAVSAQNLYPKDSGAFTGEISPKQLVDAGIPWVILGHSERRTIFHESSEFVAQKVRAALDSGLKVILCIGETLQQRESGETGAVNEAQLKPVIAAIKNEEWKNIVIAYEPVWAIGTGKVATSTQAQDTQAEIRAVIRKSVSATVADEVRIIYGGSVTANNCKELATQPDVDGFLVGGACLKPEFANIVNARLA

SEQ ID NO: 3290 - protein, 249 aa, Agaricus bisporus
  var. bisporus
  strain H97 / ATCC MYA-4626 / FGSC 10389
MSYGGNYGSGGGFPPPAGRPTQGGGYGGPPGGGFGGSPGGGYGGPPGAGYGGASGYGGGFSAPQQSHGPPPGADPQLWNWFTAVDTDRSNHITAPELERALINGDWTPFDLDTVKLLMTIFDTDRSGTIGFNEFSGLWKYIKDWQNVFRHFDRDRSGSIDGGELQQALHQFGFNLAPPMIELVQKKYDVKASATQMPGAPVPGISFDRFVRACVVVKQLTEAFQKLDTDRDGWVQISYDQFMQTVLSLP

SEQ ID NO: 3291 - protein, 242 aa, Agaricus bisporus
  var. bisporus
  strain H97 / ATCC MYA-4626 / FGSC 10389
MFLTRSEYDRGVNTFSPEGRLFQVEYAIEAIKLGSTTVGIKTPDGVILGVEKRVQSPLLEASSIEKIMEIDNHLGCAMSGLTADARTMIDHARVTAQNHAFTYDERIKVESVTQAVCDLALRFGESVHDEEAMMSRPFGVALLIAGIDEHGPQLFHTDPSGTFVRYEAKAIGSGSEAAQSELQDKWHKQMTLKEAQVLTLRVLKQVMEEKLDQHNVQLAQVTKDKGFEILDEARLQAVIEEM

SEQ ID NO: 3292 - protein, 268 aa, Agaricus bisporus
  var. bisporus
  strain H97 / ATCC MYA-4626 / FGSC 10389
MSVYRSPGFDFSNSNRNNFLLNKGVPLPKATSTGTTIVGCVFKDGIVLGADTRATEGPIVADKNCEKIHFITEGIRCCGAGTAADTEFTTALISSNMELHALQSGRKPRVVTAMTMLKQTLFRYQGHIGAALVLGGVDPTGPQLFTIHPHGSTDKLPYVTMGSGSLAAMAVFESKWSANMERQEALDLVILAISAGIFNDLGSGSNVDACIITADGTEMLRNVDMPNQRVQKERDYKFRRGTTAWTKEDVRKFVVEETVTGTDEMDTS

SEQ ID NO: 3293 - protein, 265 aa, Agaricus bisporus
  var. bisporus
  strain H97 / ATCC MYA-4626 / FGSC 10389
MEQQQKAPADIRNVAQFLRSGGSGIKVRVGALDGKRLDYFKGKSAVKALLSPAYAKLKNVPKVATETEATTILSAVNAFAFYLRVQRGGPTGTSSSSPKALQIIREQVFRPDEYYAWFYEGSQWTTYAGGILMVAIMLAGVMFPLWPSIMRLGVWYLSIGMLGLIGLFFAIAIVRLIFYIVTVVTASPGIWIFPQLFADVGFVESFIPLWEWDVPKKKSKKKKGEKKEKGKSKNGSASPAIEVVESSDSQPFRGARVEEVPDEDA

SEQ ID NO: 3294 - protein, 252 aa, Agaricus bisporus; identical to SEQ ID NO: 481
  var. bisporus
  strain H97 / ATCC MYA-4626 / FGSC 10389

SEQ ID NO: 3295 - protein, 266 aa, Agaricus bisporus
  var. bisporus
  strain H97 / ATCC MYA-4626 / FGSC 10389
MDHFPTNWGNPRKETFDACSTYPLPHRATNDTQDAFSSGVQHTQQPIVTGTSVLALKYKDGVMMAADNLASYGSLARFKDIQRLHPVGKYTVIGAGGDMSDFQYIQKFLEQLIIEEFTSQDGHDLGPAQIHEYLSQVMYSRRSKINPLWNSLLVGGFKDGKSFLSYVDLLGTTYSATTLATGFGAYLAQPILRKEVEGRENELTEEEAIRVMESCMKVLYYRDARSLDKYQLAVITADGVKISESRHLSTTWSFAEGIRGYGAQTQ

SEQ ID NO: 3296 - protein, 273 aa, Agaricus bisporus
  var. bisporus
  strain H97 / ATCC MYA-4626 / FGSC 10389
MAFATQASRLIVPLGIAAAVVQASLYDVPGGYRAVMFDRFAGVKSQATGEGTHLLVPWLQRAILYDCRIKPRNISTTTGSKDLQMVSITLRVLSRPDVEHLSKIYQSLGMDYDERVLPSIGNEVLKSIVAQFDAAELITQREVVSSRIRADLLQRAGEFNIKLEDVSITHLTFGKEFTQAVEAKQIAQQDAERAKFIVEKAEQERQAAVIRAEGEAEAASTISRALDKAGDAFVALRKIEASKAIVQSLANNPNVTYIPSSGGGVLLNVPTNK

SEQ ID NO: 3297 - protein, 268 aa, Agaricus bisporus; identical to SEQ ID NO: 506
  var. bisporus
  strain H97 / ATCC MYA-4626 / FGSC 10389

SEQ ID NO: 3298 - protein, 289 aa, Agaricus bisporus
  var. bisporus
  strain H97 / ATCC MYA-4626 / FGSC 10389
MDGQEALRRIARQFRAAGGGGPGGPGKGLFAGSGLLIALVVGGYALNASLFNVDGGHRAIKYSRIHGVKPDIYSEGTHLVLPWVERPVIFDIRAKPRSIASLTGTKDLQMVNITCRVLSRPFQSNLPQIYRELGQDYDERVLPSIVNEVLKSVVAQFNASQLITQREHVSRLVRENLTQRALRFNMVLDDVSITHVAFSPEFTHAVEAKQAIQEKQSIIVRAQGEAQSAELVGEALRKNKGFLELRRLEAAREIATHLSTSGNKVMLDSQGLLLNIAGDDAKDLLKNTK

SEQ ID NO: 3299 - protein, 342 aa, Agaricus bisporus
  var. bisporus
  strain H97 / ATCC MYA-4626 / FGSC 10389
MNTEEISTNIITLTRHVLNDGLRLGDAATGDLTLLLTAISFTSKFIATNVRKARLINLVGLAGETNVQGEEQKKLDVLSNDIMVNALRASGKTAVLVSEELEDAIIIEDPYKGKYCVVFDPLDGSSNIDAGVNIGTIFGIYKIKDGSTGSVADVLRPGSEMVAAGYIMYGSSANLVLSTGQGVNGYTLDAALGEFILTHPNIQIPPRGKIYSFNEGNAMYFYSPVNAYLKSIKYPTAPKTPYSARYIGSMVADVHRTLLYGGIFGYPSDKKSKNGKLRLLYEAFPMAFLTEQAGGIATTGTSRILDIVPSGIHDRCPVFLGSRDDVLDLMKFYKEVPAEGTN

SEQ ID NO: 3300 - protein, 342 aa, Agaricus bisporus
  var. bisporus
  strain H97 / ATCC MYA-4626 / FGSC 10389
MSFPSTVEAITIPKVGGVEVIEKTTRPFPEVKPGDVVIKVEYGGVNFIDTYFRSGLYPLEKLPAILGKEVAGTIAALPTDPAVLNDETFKKNAFAVGGKVAVADFMGTHATYISVPWKLALPVPASISTRVAAAATLQGITAVSFFEEAYKVKKGDTILVHTIAGGLGLLFAQLGRRIGATVIGTTSTPQKAELAKSRGADHVIIYTKEDTVQRVLQLTNGQGVDAIFDGVGKTTFDSNFKMIKRKGTIVSVGNASGAVEPFSLLKLIEKNVKLLRPTMSKYVFTAEEAFYYGQQVWKLVDNGELKINIFKEYPFTAEGAREAQQDLTGGKTTGKLLIKIAD

SEQ ID NO: 3301 - protein, 340 aa, Agaricus bisporus
  var. bisporus
  strain H97 / ATCC MYA-4626 / FGSC 10389
MPVVIPPRKNERSKKLHSKVVIIGSGPAGHTAAIYLARANLSPLMFEGFMANGFAAGGQLTTTTDVENFPGFPTGILGPELMEKFREQSIRFGTRIITETVSKIDLSSRPFRYWREMQEGDEPETADTIIIATGASAKRLGLKGEQTYWQSGISACAVCDGAVPIFRNKPLAVIGGGDSAAEEATYLTKYGSHVYVLVRRAELRASKIMANRVLKNPKITVLWNTVAVECQGDGDLLNNLRIKNVQTGEERDLAVNGLFYAIGHEPATAIVRSQLQTDPDGYIITVPGTTETSVKGVFAAGDVQDKRYRQAITSAGSGCMAALEVEKLIAEEEELGEIDM

SEQ ID NO: 3302 - protein, 366 aa, Agaricus bisporus
  var. bisporus
  strain H97 / ATCC MYA-4626 / FGSC 10389
MSHSVHSMSSQKTEIPKVQKAAIVQKSGARVEVRSNVPVKQPEELAPGECLVKMHCTGVCHTDLHAAMGDWPIPTKAPLIGGHEGVGEIVAIGENTTHSPVKIGDRVGIKWIAYSCLECEPCRKSFEQNCENVQISGYTIDGTFQQYVVSYVHCVTPIPEGLDSAAAASLLCAGLTVYRALKYSETGPGDWIVLPGAGGGLGHLAIQYAKYMGRRVIAIDGGEEKRKLCLSLGADHWIDFKTCKDVTAEIKRVTGGKGAHATVVTTASSSGYSQAIDYLRPNGRLMAVGLPAKATLDADIFWTVYKSITIHGSYVGNRQDAIECVDIAATGAVKVHYAEKHIDDLEDVYSALNEGTIAGRIVLALN

SEQ ID NO: 3303 - protein, 372 aa, Agaricus bisporus
  var. bisporus
  strain H97 / ATCC MYA-4626 / FGSC 10389
MPFSALNSASKVPNVPGGPARSAEEFWAALLVSAGLVLAGGVFAGLTLGLMGLDELHLRVLATSSDDPKEKKNAQKVLKMMRKGRHWILVVLLLGNVIVNESLPIFLDSALGGGVAAIVISTAAIGSVIPQAVSVRYGLAIGATCSPLVLGMMYLFAPIAWPIAKLLDFILGANEQHTYKKAELKSFLQFHRTGEEPLRDDEIKILNGVLELNSKNVETIMTPLKDTVVLSADAVLDHKAVEAILLSGYSRIPVHEPGNPLAFIGLLLVKKLLNHDPSKRLPVSALSLSILPEAYPSINCFQALDYFQTGRAHLLLISLTPGKAGGAIGVITLEDIIEEILSEEIVDETDRYEDNQHKRRAKRATTAAIMRG

SEQ ID NO: 3304 - protein, 383 aa, Agaricus bisporus
  var. bisporus
  strain H97 / ATCC MYA-4626 / FGSC 10389
MVMTGNAGVYDPRRVLEHADFKVLQKGEKPVPGANIAAFYNPAHEIHLVQKPRPKPGPGQVLLHVRATGICGSDVHFWKHGRIGDSMVLSDECGSGHESAGEIVEVGEGVTQWQPGDRVAIEAGVPCSQPSCDACRLGRYNGCPDVVFFSTPPYHGTLTRWHLHPAQWLHRLPDNVSFEEGSLCEPLSVALAGIERAGLRLGDPLLICGAGPIGLVTLLSARAAGAEPIVITDLFQSRLDFAKKLIPGVRTVLIKKELTAKEQAEEVKKAAGCQLTVTLECTGVESSIHTAAYSLKFGGKLFIIGVGKSEQILPFMHLSVNEIDVGFLYRYANQYPKAIRLISSGLVNVKPLVTHRFALEDAIDAFHVAADPTQGAIKVQIRD

SEQ ID NO: 3305 - protein, 368 aa, Agaricus bisporus
  var. bisporus
  strain H97 / ATCC MYA-4626 / FGSC 10389
MSNPKPFVLRWGIISTGRIAGDFVEDILLDPKTRDVVDVIHKVVAVGSRTAGKAQEFIDAKAGGDKNIKAYENYADVYADSDVDAVYIATPHTFHYEEALAAIEARKHVLIEKPSTATSAELRHLLQIAEQKKVFVMEAMWTRFLPLTQEVLKVIDEEDLGRPITLHADLSGDFHIDKLSLEHRILNPRLGGGALLDLGPYVMVWAIICIFEHSSNHNSRPTSISGLMLKSPLTGVDTNTSFTLNFPDAQAILTASINVNSISSFGCNVRYERGTVNISSPLYCPKEFTVKHHDKTGRTIRHVTRFGDYVGGGWHFQADEVARCIRDGKKESEIWSHQKMILVMEVFDEVRRQGGYVFPPGVEKVVSV

SEQ ID NO: 3306 - protein, 407 aa, Agaricus bisporus
  var. bisporus
  strain H97 / ATCC MYA-4626 / FGSC 10389
MATQSSSPAYKRLLEQHDDDVVIVSAIRSAMTKGKKGGFKDTKPDYILSQVLRSVYSRVNLDPKLIEDISVGNVLPPGGGASAARMAALYAGIPNTTAINTVNRQCSSGLTAVSQIANEIKVGQINIGIGAGVESMTNGFGSRAAPEISDSVLENQEAEDCLIPMGLTSENVAKDYNIPRQVQDEFAAKSFQKAAAAQKAGKFKDEIVPIKTTIVDPKTEKEVEIVVDADDGIRDGVTAASLSKLKPAFTKDGCTHAGNASQVSDGAAAVLLARRSVAKKLGLPIVGKYVNSAVVGVPPRIMGVGPAFAIPKVLDLVGLSKDEVDFYEINEAFASQAVFSIQHVKIPFEKVNINGGAIAMGHPLGCTGARQISTGLSVAKQTGGRVFVTSMCIGSGMGMAAVFVSEH

SEQ ID NO: 3307 - protein, 394 aa, Agaricus bisporus
  var. bisporus
  strain H97 / ATCC MYA-4626 / FGSC 10389
MKAVVALGFLAPSVLAATVPNELFSSLVPQKILATFNDLPNPTQYPQYTDQQAGDWQYFNPNTWTSGFFPSTLYALNTRRTLCGATSRNGLGIANWLELGREASRALIPLETKNSQGHDVGFLSFPFVEELAVNPNSETAVTAINSFAKLLANRFNPTVGCTRSWDAPDPDFQVIIDNMMNLEVLFHSAELTNNDTLRTIGKKHADTTMINHIRQDGGTWHVLHYNTFTGAVTAKRTAQGFADSSTWSRGQAWGIYGYATMFKLTGKAEYRDTAVRLADYFLDHIPNDGIVPWDFNAPSPKPADSSAATIAANGLLLLSQLETTPSLKEKFSNAAIELLDKITDLAWNPSWQSLLSNGTVNAPARNQLTGTVYGDYYFVKAGNELISMGLASCT

SEQ ID NO: 3308 - protein, 406 aa, Agaricus bisporus
  var. bisporus
  strain H97 / ATCC MYA-4626 / FGSC 10389
MTVYQATASAPVNIACIKYWGKRDTKLILPTNSSLSVTLDQDHLRSTTTSRADPSFTNDRLWLNGKEEEIKEGGRLWTCIREMKRLRKEEVEDKSSSEPKLSTYNVHICSHNNFPTAAGLASSASGFAALVSSLSHLYSLPVSSSTLSLIARQGSGSACRSLFGGFVAWQMGSNPSGSDSLALQIAPQSHWPDIHALICIVSDDKKGTSSTSGMQRTVETSSLLHHRINTVVPHRMETISKAIQEKDFDTFAKVTMADSNQFHAVALDTEPPIFYLNDVSRAIIALVVEYNRLGVEEGKGYRAAYTYDAGPNAVIYAKKENVKEILELVVEYFPQREGAFKDAFGLFGGGGKVGGKLPMGFNENVAKRFEVGAVKGLIHTRVGDGPRKLGDGEGLLNDEGLPKSLA

SEQ ID NO: 3309 - protein, 380 aa, Agaricus bisporus
  var. bisporus
  strain H97 / ATCC MYA-4626 / FGSC 10389
MSLAPVNDGIGIANLPNQRHKIVAKRGAHFTLMVVGESGLGKTTLINTLFSTELSPPKNYNRRHHKQLDKLTEVEIIKAELEEKQFKVKLTVIDTPGFGDYVNNADSWTPIVEFIDDQHEAYMRQEQQPQRNEKTDLRVHACLYFIRATGHTLKPLDIEIMKRLGTRVNLIPVIAKADTLTQNDLQTFKQRIREVVDAQGIRIYSPPIEPDDESADLARVLIDSMPFSIIGSTEDVKTADGRTVKGREYLWGVAEVENENHCDFKKLRSLLIRTHMLDLVSTTEDIHYENYRQQQMETRKFGEPKPKKLDNPKFKEEEETLRKKFTEQVKAEEARFRKWEQHLIQERDRLNKDLEEAHSAIKQLEAELDNLNYGRGTNRR

SEQ ID NO: 3310 - protein, 407 aa, Agaricus bisporus
  var. bisporus
  strain H97 / ATCC MYA-4626 / FGSC 10389
MLARHIFRVQKLSRGFATHAESFTGLPATLHLKTGQSFKGKSFGAPHSRFGETVFSTSITSYTESMTDPSYRGQILVFTTPMIGNYGVPHNEAPYDSQDVGVVLESKGVQCAAVIVGDVAERFSHYNAVESISSWCKRHNVPGITGVDTRAITTLLRDQGTTLGRVAVGPDACLPAPAASEYWDPITENLVDQVSTKVPYELNPTGDIRVAVLDFGAKANILRSLVRRGAAVTVLPWNYDFNAIRDQYDGLFLTNGPGSPSHCMEAALNLRKTIQQWNKPIFGLCMGHQIIGMAAGLEAYRMTFGNRGHNQPVLALASSGSIKAGRVYVTSQNHQYALKLQDTFPAGWEPFFINCNDSSVEGIKSTAESGKNVIGVQFHPESSGGPLDTIEVGSVIAGKSYQILTPS

SEQ ID NO: 3311 - protein, 387 aa, Agaricus bisporus
  var. bisporus
  strain H97 / ATCC MYA-4626 / FGSC 10389
MRFSLRPSRSSNRNGRPMSPIRRRKLLLSYVPDWLLTIVLAGIFFSLDKVEGYRRVFALEDTSLRHPYAVHERVPNIALYFICFVAPFLLQPVVNVFTIRSWWDLHNSSLGLILSLALTGSVTQFSKITVGRPRPDIVDRCQPPIGATDPEFGLSSWEICTQPDNGILRDGFRSFPSGHSSMSFAGLGFLSFYLAGKLHLFDKRGHTGKAWLSLAPFCCAALVAISRTMDYRHHWHDVLVGSLLGTVMAYFSYRQYYPPLESELSHRPFSPRIKREDDELIPTHNHHPSGSNFPFVQAPTTSTQGNGQYTATNNDEYELDGTVLRPHTEPLEEIWKRDGPGVSDTDQSPSYEGGEQVYQANTAPSLPPIRTSSPPQAYVYEPRAQPV

SEQ ID NO: 3312 - protein, 402 aa, Agaricus bisporus
  var. bisporus
  strain H97 / ATCC MYA-4626 / FGSC 10389
MAAVAVKSPVAPAGIKQYYQAKIESAELLINQKTQNLRRLEAQRNALNARVRLLREELQLLQEPGSYVGEVVKVMGKNKVLVKVQPEGKYIVDIDSDVEVSALKATLRVALRSDSYTIHKILPNKVDPLVSLMMVEKVPDSTYEMVGGLDKQIKEIKEVIELPVKHPELFEALGIAQPKGVLLYGPPGTGKTLLARAVAHHTDCKFIRVSGSELVQKYIGEGSRMVRELFVMAREHAPSIIFMDEIDSIGSSRGESGSGGGDSEVQRTMLELLNQLDGFESTKNIKVIMATNRIDILDSALLRPGRIDRKIEFPPPGPEARVSILRIHSRKMSLQRGINLRALAEKMGQCSGAEVRGICTEAGMYALRERRQHVTQEDFEFAVAKVLKKNQEGNTSVNKLFS

SEQ ID NO: 3313 - protein, 396 aa, Agaricus bisporus
  var. bisporus
  strain H97 / ATCC MYA-4626 / FGSC 10389
MAGINAGDEKLVFESSEAVSVVATFDDLALKEDLLRGIYAYNFEKPSAIQQRAILPITQGRDVIAQAQSGTGKTATFSISILQSIDVTVRETQALVLSPTRELATQIQSVVLALGDYMNVQCHACIGGTSIGEDIRKLEYGQHVVSGTPGRVFDMIRRRSLRTRNIKMLVLDEADELLNKGFKDQIYDVYRYLPPATQVVLLSATLPYDVLEMTTKFMTDPIRILVKRDELTLEGIKQFFVAVEKEDWKFDTLCDLYDTLTITQAVIFCNTRRKVDWLTEKMRASNFTVSSMHGDMVQKERDAIMAEFRSGTSRVLITTDVWARGIDVQQVSLVINYDLPANRENYIHRIGRSGRFGRKGVAINFVTVDDVRILRDIEQFYSTQIDEMPVNAAELI

SEQ ID NO: 3314 - protein, 407 aa, Agaricus bisporus
  var. bisporus
  strain H97 / ATCC MYA-4626 / FGSC 10389
MASFAARSASQVLRASRRTSAAVARADLKPQAASYSLLARTASAKVILNPTFQTVRGVKTLDFAGTKETVYERADWPLAKLQDYFKNDTLALIGYGSQGHGQGLNARDNGLNVIVGVREGGESWKQAMEDGWVPGETLFPIKEAIHKGTIIMNLLSDAAQSQTWPELAPLITPGKTLYFSHGFSVVYKEDTKVVPPKDVDVILVAPKGSGRTVRTLFKEGRGINSSIAVWQDVTGKAKEKAIAIGVGIGSGYMYETTFQKEVYSDLYGERGVLMGGIQGLFLAQYQVLRKNGHSPSEAFNETVEEATQSLYPLIGQKGMDYMYNACSTTARRGALDWAPIFEKANVPIFEKLYESVRNGTETRKSLEYNSRTTYRQDLAKELAEIDNQEIWRAGKVVRSLRPDYKPE

SEQ ID NO: 3315 - protein, 416 aa, Agaricus bisporus
  var. bisporus
  strain H97 / ATCC MYA-4626 / FGSC 10389
MSLSNKLSITDLALTGKRVLIRVDFNVPIQDGKITNPARINAALPTIKYALDNGASKVILMSHLGRPDGKAISKYSLKPVASELEKLLKKPVFFLHDCVGPDIEKAVLEAPEGAVVLLENLRFHIEEEGSAKNEEGKKIKADPSKVTQFREQLTRLGDVYVNDAFGTAHRAHSSMVGIKLPQRASGFLVKKELDYFAKALENPERPFLAILGGAKVSDKIQLIENMLDKVNCLVIGGGMAFTFKKTLQNVAIGNSLFDKPGSEKVAGIVEKAKKNNVEIVFPVDYVVGDKFDANANHKIVTDDEGVPDGWMGLDVGPKSNELFRQAVLKAKTILWNGPPGVFEFPAFAKGSKVLLDATVEAVQKGATVIVGGGDTATVVANHDAEEKLSHVSTGGGASLELLEGKTLPGVAELSNK

SEQ ID NO: 3316 - protein, 403 aa, Agaricus bisporus
  var. bisporus
  strain H97 / ATCC MYA-4626 / FGSC 10389
MSTESPFKISVPDEQISLLKKKLELVRHPDELEEAGLDYGVPLKDMQRFAAYWKDGYDWKKHEAQLNEELPQFTRDIEVEGFGSLNIHYVHKKSTVDTAIPLIFVHGWPGSFLEVRKILPMLIEESSDHPSFHVVALSLPGFGFSEAPKKKGFAISQFAEVCHKLMLALGYNEYVTQGGDWGGIITQRISTLYGGKHAKARHTNFPTAPPPHPLHNPYNFFSNMLARYTPEEKAGLARMEWYYKESSGYYAKQSTKPQTLGYSLADSPVGLLSWIYEGLVNWTDNYPWTDDEVLTWMSIYWFSRAGPAASVRIYYEFTKSGGTLMTGGELGVPTGYSYFPKELVQFPRSWLKNKRLVFESRHEKGGHFASVEHPDLLVGDMRKMFGKGGPAFGVVPSHNGFKQ

SEQ ID NO: 3317 - protein, 426 aa, Agaricus bisporus
  var. bisporus
  strain H97 / ATCC MYA-4626 / FGSC 10389
MLASSLTRRSAASLNRNALRSVSVWSAVPAGPPDPILGVTEAFKADKNSRKINLGVGAYRDENGKPYVLPSVQKAEEVINTSKLDKEYLPITGLAEFTQRAAHLAYGAESVPLNNNAISAAQSISGTGALRIGGAFLARHYPTSKAIYLPTPTWGNHIPLFKDSGLDVRGYRYFDKSTVGLDFEGLKSDLRAAPEGAIVLLHACAHNPTGIDPTPEQWATISQIVKEKKLFPFFDMAYQGFASGSTDRDAHAVRLFVKDGHQVALAQSFAKNMGLYGERVGAFSLTTTDPEEKARVDSQLKILIRPLYSNPPCHGARIANTILGNQVLCDQWKGEVKGMADRIINMRERLYNILTHDLKTPGEWGHIKSQIGMFSFTGLTAPQTQVLAEKAHVYMTSNGRISMAGLNGSNIEYFAESVDAAVRGKL

SEQ ID NO: 3318 - protein, 446 aa, Agaricus bisporus
  var. bisporus
  strain H97 / ATCC MYA-4626 / FGSC 10389
MASYLARSFVRRFHVSARRSALSQFNMPAMSPTMSEGGIASWKKKEGETFASGDVLLEIETDKATIDVEAQDDGILAKIIAPDGSKNVQVGAPIAIVAEEGDDLSGAASLAEKASKQASAAKEEASPEPPKEEKPAPPPTPSSKPAPETKAELPTGDRIFASPIAKKIALERGIPLAQVKGTGPNGRIIRSDVESFSPAAATTSQPAAAESTADYVDIPLSNMRRTIGARLTESKQSRPHYYLTVDINMDKVLKLREVFNKTLTEKDKTSKLSVNDFVVKATSCALADVPEANSAWLGEVIRQYKKADISVAVATPSGLITPIVKDVGSKGLATISAETKTLAKKARDGKLSPSEYQGGTFTISNLGMYDISHFTAIINAPQSCILAIGSTQATLVPAPEEERGFKTVQIMKATLSSDHRVVDGAIGARWLAAFKGYLENPLTFML

SEQ ID NO: 3319 - protein, 430 aa, Agaricus bisporus
  var. bisporus
  strain H97 / ATCC MYA-4626 / FGSC 10389
MARLAPIICDNGTGFSKIGFAGNSDPSFVFPTAIATRGSPSQTSRAPAVPAKPGHLASKRGVEDLDFFIGDEALANAKTPGYGVHYPIRHGMIDNWDYMERYWEQTIFKYLRAEPEDHYFLLTEPPLNPPENREQTAEIFFESFNIQGLYIAVQAVLALAASWTSNKVTDRTLTGTVIDSGDGVTHVIPCAEGYVIGSAIKHIPIAGRDISQFVLNLMRERGEMTNVPPEDQLRVAGKVKENYSYVCQDIVREFRKYDEDPSKYFERYEGEYSVTKKKYGVDVGYERFLAPEIFFNPEIYSSDFLTPLPDIVDDVIQSSPIDVRRGLYKNIVLSGGSTMFQHFGNRLKRDLKQLVDRRLDTSALSSGSSMKSSGVEVEVISHKRQRYAVWFGGSLLASLPDFYTSCHTKAQYDEIGPSICRRYQIFGSAT

SEQ ID NO: 3320 - protein, 460 aa, Agaricus bisporus
  var. bisporus
  strain H97 / ATCC MYA-4626 / FGSC 10389
MSQQERTRVAIVGAGIVGLTLAIALNAFDKERKLAIDIYENASELAEIGAGINVWPRTLAIFKQIGVEDALIPLLDHIPDLEPRIIFGIRKGDEKNGYQVYDTMNNGGALRVHRAHLQNTLIQHLPLPGSKVTEINSICGFHLGHNLIDYSHHSSSGQGPLTLHFSDGKPSRTCDILVGADGIKSTLRHLFLPRLPNPEKYLNCYEPKWKGLLAYRGLVPKEKLEAVSPGHRALTHPGLMYSGKSAYAVVYPVSNGKFINVVAIVHDNPTNSTVWPGPWRMDVTQSEFFEVYKGWDEEVLDLIRCVDKPTKWALHALDHLDVYAKGRVFLMGDAAHAMLPHLGAGAHVGMEDAYILASLITHSSTPIWPSTQHVGEIANIYNTMRIPRAVSMSNSTDEAGYLCNLENPGLEEFKVGDHIPKELLIQTARTMEKKWAWTTTYADEDRIKAISLLEGPRAVL

SEQ ID NO: 3321 - protein, 463 aa, Agaricus bisporus
  var. bisporus
  strain H97 / ATCC MYA-4626 / FGSC 10389
MAEQPTKAKLWGGRFTGKTDPLMHEFNQSLKYDRRMYDADVRGSVAYAKALSRAGILTQDEMEKIIHGLSSVGKEWMDGIFQVKEDDEDIHTANERRLTELIGPLGGKLHTGRSRNDQVATDMRLWLLDEVRDVEQGLRALIRVMIERADQEKDYLLPGYTHLQRGQPIRWPHLLLSHAFSFRSDLERLQQLIPRISVLPLGCGALAGNPFAVDREFLAKELGFQHVAENSLWGVGDRDFIVEFLQWSSLTMVHISRMAEDLIIYSTAEFGFVTLSDAYSTGSSIMPQKKNPDSLELLRGKSGRIFGNMAGFLMTYKGLPSTYNKDLQEDKEPLFDAVDNVSASLKIAEGVIATLTVHPERMRQALTMDVLATDLADYLVRKGVPFRETHHISGRAVALAESRGCQISDLSFGDYKTLSEKFSEDIHKVFDFEASVERRESIGGTSRKMVERQVQVLRDVLAK

SEQ ID NO: 3322 - protein, 473 aa, Agaricus bisporus
  var. bisporus
  strain H97 / ATCC MYA-4626 / FGSC 10389
MSPIKVTKICCIGAGYVGGPTCSVIALKCPHIRVTIVDLNQARIDAWNSDDFNLPIYEPGLEDVVRQARGRNLFFSTDVDKAIEEADLIFVSVNTPTKKSGVGAGFAADLNYVELATRRIATIARSNKIVVEKSTVPCRTAESMRTILEANSKPNCRFDILSNPEFLAEGTAMTDLFKPDRVLIGSLQTPEGVSACQSLAQVYANWVPKECILTVGLWSSELSKLAANAMLAQRISSINALSAICEATGANIDEVSNAVGYDTRIGPKFLKASVGFGGSCFQKDILNLVYLSESLHLPEVAAYWRQVVDMNEYQKRRFSQRVVDTLFKTITGKRIAVLGFAFKADTGDTRESAAITLIKDFLSERAFVNVYDPKVVHEQIWMDLQEASPLVPLDNIKKQVTISPSAFEAAQGADAIVIATEWKEFRDIDWERLYKGMNKPAFVFDGRLLVDAEKLTKIGFKVTTIGRPSPLLT

SEQ ID NO: 3323 - protein, 486 aa, Agaricus bisporus
  var. bisporus
  strain H97 / ATCC MYA-4626 / FGSC 10389
MTSLADFSALIKGDVIVPGHAEYEKSLKRWAVNAEKKAAVVVFIKDEADAAAAILYARENDLPIAIRGGGHSPAGASSIDGGLVIDLSRYLTGVKVDPKKKLAYVGGGAIWETVDKTAIEHGLATVGGTVNHTGVGGLALGGGFGFLTGEHGLVVDNIVQVTLVSANGTIYTVNEKENTDLFFGIRGGGCNFGVVTELVLALHSQRRTVFTGPLIFPVIHLERVVEFAEEWYANIRSNEAMFLVLDGKPGTAPNIICHVFYNGSEEEGRSRFKGLYEIGPVMDMSKEIPYETVNSLQNSIIVPGSGVYWKGVAIPGPSYKPIANTYAKVQEISKSGTFSTLAVYELLPLQKINSVPLNTTAYRRSTNPNCLLSLNWPRDLNSQALVDEARSLTHQLAACVAGGASELEDEKSRPYANYGMNVYPLILYVIDDIGCMLDAEGDARSQEEVKKIAHVAFGDNYPALQKIKKIYDPDNIFNRWFSIIPA

SEQ ID NO: 3324 - protein, 486 aa, Agaricus bisporus
  var. bisporus
  strain H97 / ATCC MYA-4626 / FGSC 10389
MLHPAAPEAAVRLLKFVNASPTPFHAVNNASLRLEKAGFQKIKETDNWDHFVPGGKYYFTRSESINAISAVLTKNQAALVAFTLPKKWAPGAGLSIVATHVDSPNLKIRPISKRSKVGYLQVGVETYGGGIWHSWLDRDLSIAGRVVVAEQSGAFKSKLIKIDRPVLRIPTLAIHLDRNVNDNLKFNQETEFIPVLGMMESQLNAGRASDSDNDEPRKEPTTEASSIQDKHHPALLSLLSEELSVSPEKIHDFELSLYDTQPSVLGGIDNEFIFSPRMDNLFSSFCAVEALVEHPTSDLFPQVKGNVNAITLFNHEEIGSVSTSGALGSLLPMLLNRLSPTPQTYAQSVAQSFLLSCDMTHAVHPNYTSKHEDKHRPIINGGMVIKTNAKQRYATDAISSFIAKKMIERHGGKVQEFEVRNDMGCGSTVGPLLSQIGIRTVDVGAPMLSMHSIRETAGTHDVQASIDLFKSLFEGYPELNNNLTVD

SEQ ID NO: 3325 - protein, 504 aa, Agaricus bisporus
  var. bisporus
  strain H97 / ATCC MYA-4626 / FGSC 10389
MVFCAISGEPPQDPVVSLKSGHVYERRLITKYITENGSDPITGDKLEESDLIELKASPKTAPPRPPTQSSVPALLHTLQNEYDAIVLETFSIRQKYNSVRQELSYALYAQDAATRVVARLIRERDAAREALANIQASMGITPSAGAENGDVEMVEGESAEGLPAPVVAKIDETHASLSATRKKRKPPTDYASAAEVKTYAAKHTIPSLHSASPAGITSLVVSRLNPSQFLTGGNDKIVQLYDRSTDKVLASLKGHSKRINHVALREREGEQTLLLSAGADKIAKIWSQDSASGEYIANYTLRTHKGEISGLAVHPTSTLAVYSSLDKTYSVHDLTTFSQVFRSAPSEEALTSLAVHPDGTLIAIGTPASTIQIYDIRTCAIAATLTPSGGTPFTVNTLTFSENGYHMLAPDSVSSVSIWDLRKTRSTHSIPLGDDFKVTNVAYDHSAQFLGVAGNNGARIFAHKTWEELVRVEEGSEISGLAFGEQGKEIWTATGREIRIWGSP

SEQ ID NO: 3326 - protein, 528 aa, Agaricus bisporus
  var. bisporus
  strain H97 / ATCC MYA-4626 / FGSC 10389
MRLSSFQRLSTSLLYNSARSSVSIPNLFPYRFTLRMASSQTAVFGLKDSSLIKFQGYIDGKWVDAKSGETIPVTNPATDELLGAVPDMNVAETQEAIAAASAAFPKWSALSAKQRHDILIRFFQLMREHHEDLGRLITLENGKTLAEAKAENAYSASFLEWFAEEAVRTYGETIPSAIPGSRNVVIKQAVGVVSILTPWNFPSAMITRKLGAALAAGCTAVVKPPPETPFSALALAELSRRAGVPDGVFNVVPTLKYVNEVGKEMCQSKAVKKVSFTGSTNVAKLLYGLSSTTLKKVSLEAGGNAPFIVFDDANLDDAIEAALICKFRGSGQTCICANRIYVQSSIYAEFASRLADRVAKFKLGNGLESGTTHGPLIHNRAVEKVVRHVEDAVSKGAQILVGGKRQGDTSFFYPTVLSDVPAEAAINKEETFGPLAALIKFETEEEVVKMANDSDVGLAGYFYSRDVGRAWRVAEKLEVGMVGANSGVISQAVVPFGGVKESGLGREGSHGISEYLNTKLIVFGGIGA

SEQ ID NO: 3327 - protein, 502 aa, Agaricus bisporus
  var. bisporus
  strain H97 / ATCC MYA-4626 / FGSC 10389
MSNTEASQAGGAPSRVTLHLGHLPKKTDIKAPWPRTPTRVDPNNPPWPAYRGYHEYSFAHATMQSRLPTILGKAIEDAIRTLNDQAEEERVVDLSESIERMGGLMTDLSGNAKLRPIIDDSEADVALWNKEIAKYFQGKDFMNAPWLFAEAYKYRRLHECFSVSKFWKDYDVFYRQKCDTFSRSADAVFELSMRFAEPFKIAEGLSNQEELEAERLMFLELTQVCLWGNSTDLSLLINMSEEQIKALQSTGGDHLAATEKNILGNDLGRLWETVKELRQKTGGRIDFVLDNAGFELYCDMVYADFLLQSGLANQIHFHGKRFAWFVSDVTRKDWNWLLNTMVYGQLFPKASEEELESLRRLGRRWKQYEKEGKWVYEQHPFWCTGYTYWDLHSEAPDLFFHLSKSDLVIFKGDLNHRKLTYDCAAPASTPFDVAIGPMASAAGAPRIASLRTIKSDVVVGLGSEGDDVAEKLDETEPGWKISGKYAVVLLSDGRPGEKVRFA

SEQ ID NO: 3328 - protein, 546 aa, Agaricus bisporus
  var. bisporus
  strain H97 / ATCC MYA-4626 / FGSC 10389
MSLSRFPRPRHISSPARPFSTSARASAGLSPLARPVATEISAKWKGTSMTGGTTKNFIGGQFAESKTDKWLEAVDPSTQTLLSKVPQTTSQEFEQAVDAASHAFKSWSRTSVLTRQRFVLELQHLLRQNADAIAASIVLEQGKTLADAHGDLLRGLQVVETAASATTTLLGDKIEVSKDMDTYVRKVPLGVCASIAPFNFPAMIPLWTIPMAAVTGNTLIVKPSERDPGAAMIIAELCQRAGLPDGVLNIVHGQVPTVNAICDHPAIKAISFVGGDRAGKHIFDRGTQNGKRVQSNMGAKNHAILMPDANKNFALNSIVGAAFGAAGQRCMAASVAILVGEAQNWLPELKERAQKLKVSGGFEQGADLGPVISPQSKERITSLIASAEQEGGRIALDGRSITVPGYPDGNFVGPTILEADTNMKCYQQEIFGPVLVVLKADNLDDAIEIVNNNRYGNGTAIFTQSGATGRKFENEVQVGQIGINVPIPVPLPMFSWSGNKGSVLGDIGFYGKSGINFYTQNKTITSLWRAEDAVGNRASTAMPTHN

SEQ ID NO: 3329 - protein, 564 aa, Agaricus bisporus
  var. bisporus
  strain H97 / ATCC MYA-4626 / FGSC 10389
MPPLRAARLLTALALFSCGAQAISQVTRNGRYLYNADGSRFYIKGIAYQPQGFVIASDDNAFGEPTGFEDPLAQPDDCKRDIPFLQELSVNVIRAYSVNSSLNHDECMSALSNAGIYTIIDLSLPMNGSVDRSAPSWSGNLLDQYLETIDVFSKYDNVLAYNVGNEAITSNTTSVAPFIKAAARDVKAYLNSKSSSSLVAYAQIDGAENFRENVADYLSCDPTGQNSPSTAIDLFGLNNYEWCGDSTFEGSYAGLTSQFADYNVVAYFSECGCVSQPPRLWTEMDAIFSSQMSDVWSGSIAFSYFPAESVDGQYGMVTISSDGSTVQTSEDFDRLKQHYTAVSPPNSPSKDSAGASSYPSCPSSSDTFAASTTLPPTPDFAACSCLENALSCQFRPATSNYSAIVGELLDESCSLLGQSGGNCDELGANGQTGTYGRVSSCDPTIKLSYAMTSYYELNNRDAQACSFAGNGTVNSGSPASSASAAASSCITNAAAVFTPTLPAGGSNPGGSSGNGNGNGNGNGGGSSGNGDDTEPNSALVDAKPLLGVAAMIITSVVGGILTVV

SEQ ID NO: 3330 - protein, 537 aa, Agaricus bisporus
  var. bisporus
  strain H97 / ATCC MYA-4626 / FGSC 10389
MEAVPPYVGSSEVHHYPPAEPTNKFPELFPSHVGYAGATPTGAEPAIVATAPAWPLHSGAPQLVVPTQLMDSSKDGKGKGKKSKFNMLEKWGNLSPWYSVKRGAFGLDSGPETPDTCRTTGLHFLHRHGARYPTEWSEYGGPAKLARKIHESTQNWTGSGLLTFLNDWTYKLGAELLTPFGRQQLFDLGVTMRVKYGYLLQNFTESDTLPVFRTESQDRMLASAMNFAIGFFGWPHEDKYQQSITIEADGYNNTLAPYKTCPNAKTQSKAERAVWYLTRWADKYLNEAQKRIAKDIKGFDLTIEDVYTMQQMCAYETVALGYSKFCELFTEEEWEGFNYSLDLYFWYDSSFGSPLSRVLGVGWIQELVARLTHSPIAIHNTSTNSTLDDNSVTFPLDQSLYVDATHEVVVLHVITALNLTNFAEQGPLPYTHIPKDLKFHSSELAPFATNVQFQLLECTSVPGPQIRIIINDGVVPLTSIKGCPEQEDGMCPVDTFVEAMKEIIRDTDWNWGCHGDWDVPPGTEWNTTTGEPPKRGD

SEQ ID NO: 3331 - protein, 552 aa, Agaricus bisporus
  var. bisporus
  strain H97 / ATCC MYA-4626 / FGSC 10389
MTRFLLPLLLLGFTSFTGVNSFSPVIGPQGVNFWNLDKQEARERGASSRRDLPLEISARAFEEFEPQWFEQPLDHFDESNPHTFKQRYWVSKRHYKARQGAPVFVLDGGETSGANRLPFLDTGIVDILARATEGLGVILEHRYYGESIAVENLTTDALRWLNNEQAAADSANFMAKVKFNGIEEDLTAPSTPWIYYGGSYAGARSAHMKILYPDLVYGAIASSAVTHAAVENWQYMEIIRKAADPKCSHHLENSIKIIDSILLGHSKFFKSHLKGLFGLANLTHDDDFASTISSPLGSWQSKNWDPEESSVRFDQFCEALNAPVHGHGISAKATDLPFGDPARMVEVADGLTLDLSILNYGAYIKNNTASRCRTTLDDCFGTYDDSKYQQTGLDEDWRLWMFQVCTQWGYFTTTPPDPKQPRILSRLITLPHESKICQQAYLPGDFFQVPPLPNVTAVNMLGDFDIVADRLMFVDGEVDPWRPDTPHSDGAKPRDDTILRPFKLIPGAVHHWDENGLADVTQEPVVIQDIHAEEVAIIEQWLADWKPPTKKD

SEQ ID NO: 3332 - protein, 592 aa, Agaricus bisporus
  var. bisporus
  strain H97 / ATCC MYA-4626 / FGSC 10389
MPDNVDAEFLFPTPSPPPSSLSPYHSPGISPASTQALIAALTENHKRWHIFFNDKGFHNHTSHHLLAIWGLGVDAAIIKAAYENDLKTQRPAFKSPEPITEGNYEKHLGDEKFYDAYVNFFTDYARKNGTRDMLQTFIFSKKYNTEQMGMLNRFLSGLVHPMIHTGYGAEFNLPGMLIEGIAQACVHKTNVTELLPQSFFDSVLSIPETVSSTFLGGATQRIAQFAAQFAQGRSSSSSNDVHALTILARVMADSRLSLPDDLDTGNVIQKTIAKHSQLIREYVSQWTIDVSKAGEIERKVEEIAWTNVVMYGIAGWTWAQQVKQGSEGEFNADFFLMHLVTSAAFIPSLLARLDSVQHQVLLLRSYFAVCLSWYIARARPKFDVRAFFLSSTATPHPLPIHALPTPHEDALQGSDKIQTQVPDPWLPLVSTTIVHPDEHLPKTIRALASWASKFGSTPAGTFGGPSSGSSAEPAASKNAIKTELPGAEYLDGTLFVRVAGLTVARVELVRVKRRLSFGIGRDSLRMLEGRRKATIEHVFLGPLDVSCRSFSFFGVPFVAALVSCCTIPCRSRMNESMHPTSFGPQKRQGSHE

SEQ ID NO: 3333 - protein, 613 aa, Agaricus bisporus
  var. bisporus
  strain H97 / ATCC MYA-4626 / FGSC 10389
MMSSVSSRDKKESQDHDVELQPRLELANNVQARIQNPLYGIPREKLLQQVDDFTREYGFEDRSELFRKAAILAQSPKKFEEMPELTEDEKEAIRRETTHRWSQPRALYMTVFICSLAAAVQGWDQEGSNGANLSFPEEFGLTSQGDLGDWIVGIINAGPYMASAIIGCWLGDPLNYYLGRRGTLFWCGIFCTISVIGSGLAQTWPQLFVCRLLLGLGMGPKATTAPVFAAENVPANVRGGLVMSWQLWTAFGILLGVTANLILYQVGPIAWRLQLGSAFIPAVPLTIGVWFCPESPRWYMKKNRYQDAFKSFLRLRNTELQAAKDLFYVHRQLIEERSALKGSTYLGRFFDLFTVPRLRRATLASWVVMIAQQMCGINIIAFYSSTIFKESGFSERDALLASFGFGLVNWLFAFPAVFTIDTFGRRNLLLFTFPNMAWTLLAAGFCFLIRTGSPAKVPLVSLFIFLFAAFYSPGEGPVPFAYSAEVFPLTHREMGMGWAVATNLFWASVLGITFPRMLRALTPTGAFAFYAGLNVLAFVMILFLLPETKQRTLEELDYVFAVPMRKHVSYQLTEFIPYWIRRYVFWNKNVELRPLYNFDEVESITVFEKGAGH

SEQ ID NO: 3334 - protein, 667 aa, Agaricus bisporus
  var. bisporus
  strain H97 / ATCC MYA-4626 / FGSC 10389
MFTAARSLRFTATRSGRYAVIPPSMTRRNLNSKVNGPVIGIDLGTTNSCVAMMEGQTARVIENSEGARTTPSVVAFTKHGERLVGLPAKRQAVVNSHNTVFAFKRLIGRQFKDKEVKDDMRHWPFKVVPTADGRPAVEVENGGKKQTFSAEELSSMILTKMRSTGEEYANKTINHAVITVPAYFNDAQRQATKDAGQIAGLDVLRVINEPTAAALAYGSERADNSVIAVYDLGGGTFDISILEMQKGVFEVKSTNGDTHLGGEDFDIVLVEYILDHFKKEEGMDLRGETMAIQRVREAAEKAKIELSSTSQTEINLPFIAANAAGAKHINMKINRSQFEALVQPLVQRTIDPCKKALADAGVKASEVNDVILVGGMSRMPKVQDTVKSIFGRDPSKGVNPDEAVAIGAAIQGGVLAGNVTDILLLDVTPLSLGIETLGGIMTKLINRNTTIPTKKSQVFSTAADGQTAIEVKIFQGERELVRDNKLLGNFNLVGIPPAPKGVPQIEITFDIDADGIVHVNAKDKATNKDQSMTIASSSGLNDKDIEKMVADAEQYAETDKARRNLIEEANKADSICVDTEKAMNDFKDQLDASEKEKVTKLVGELRELAAKGQTGDASITADIIREKISETQNASLGLFQKVYEKRAAESSSSSSESSEPPKEEKKD

SEQ ID NO: 3335 - protein, 756 aa, Agaricus bisporus
  var. bisporus
  strain H97 / ATCC MYA-4626 / FGSC 10389
MVPESVKKIGKKVVDYPEHGVEVISVKDWSSSFRTNPLPHIKSYILGLFPILNWITRYNIGWLSGDIVAGLTVGIVLVPQGMSYAQIATLPPEYGLYSSFFGVLLYCIFATSKDVSIGPVAVMSLTVGNVIKHVQERHPGEFDGPTIATGLAFICGFIVLGIGLLRIGWIVEFIPMPAVSGFMTGSAISIAAGQVPGLMGIAGFDTRAATYQVIINTLKGLPRTKLDAAWGLTGLVSLYIIRYVCTWCSKRWPRRARLFFFLSAMRNAFIIVVFTIAAWLYCRTRRDSNGNYPIRILKDVPAGFKHIHSPRISSSLVSAMAPELPVATIILLLEHIAISKSFGRLNGYKINPNQELIAIGVTNTVGSCFGAYPATGSFSRSALKSKSGVRTPLAGIFTAMVVIVALYGLTQAFFWIPNAALSAIIIHAVADLVASPDQVFRYWRVSPLEFFIWLAAVLITIFSSIEHGIYTSIAASVALLLIRLAHPRGQFLGKVSLESDSGDEKDKREIFVPIKQNNINNPHIKVSPPAPGILIYRFEESYLYPNCSIVNSALVDYVKENMRRGKDIGAVKLRDRPWNDNSPRRNSAQEQAINEKKPWLHAIILDFSTVSHIDTTAIQSLIDARSEIERWTDYPVEFHFATILSPWIRRALVAGGFGYGNTHSKVPREVAAVVPYRGGRLPDDSSVEPVSDVESGDSKADIGIAEKDVELRRWEPVMPDVTPFFHIDLTSAARAAESGLNRLSKLDMVKPVLSAD

SEQ ID NO: 3336 - protein, 876 aa, Agaricus bisporus
  var. bisporus
  strain H97 / ATCC MYA-4626 / FGSC 10389
MTLSFKGHTVVVTGAGGGLGKAYSLLFASRGANVVVNDFNAAAAQKVVDEITQAGGKAVANTSSVTDGAAVIKTAIDNFGTVTILINNAGILRDKGFKNMSDKEWDQITEVHLKGAFSCTKAAWPHFRKQKFGRVINTASAAGLYGNFGQANYSAAKMGLVGFTLTLAREGAKYNIKSTAIAPIAASGMTETVMPPEMLANLSPAYVAPFVVAVCHPDGPDASGKIFELGAGYIAEVRWERSNGTIFKTDSTFTPTAGLLESAKKSPQNAQSGPEVRYDGQTVIVTGAGAGLGRSYALMYARLGANVVVNDVSEKGANAVVAEITQSGGKAIPAVFSVEDGEKIVQLAVEKFGAVHVLVANAGVLRDKSFLSMSEQEWDLVIAVHLRYCAKAVWPIFQKQKYGRIVTTASQVGIYGNFGQANYTTAKAGIIGLTRSLAIEGAKYDILVNAIAPSAGTAMTSTIWPQEMVDAFKPDYIAPVVGYLTSKDNTGTSGCLFEILGGWAAQTRWQRAGGHGFPHTKPYTPEDVVAKWDVITNFDDGRATNPSSTSEAVESIVSNFENKGDESLKAKLTMSVFKNTDAFADPEDAQLVADAKKIIPDPVPYTYTERDVILYNLGIGATEKELQWIFEGDDEFGALPTFGVIPQFPATSGVPLDFLPNFNPAKLLHGEQYMSIKAPIPTSGSLVTEARILEVLDKGKAAAVTAIAETRDTKTGQVIFENQSTVFIRGSGGFGGKRVGKDRGPASASNAPPKRAPDAVAEEKTSPTQAALYRMSGDLNPLHILPEFAAIGGFDKPILPGLCTMGIAAKHVLKTYGPYKDIKIRFAGVVYPGETIVTEMWKEGSKVIFTAKVKERNATALAAAAVTLVQEPKAML

SEQ ID NO: 3337 - protein, 884 aa, Agaricus bisporus; identical to SEQ ID NO: 840
  var. bisporus
  strain H97 / ATCC MYA-4626 / FGSC 10389

SEQ ID NO: 3338 - protein, 837 aa, Agaricus bisporus
  var. bisporus
  strain H97 / ATCC MYA-4626 / FGSC 10389
MSDEYPSLFRSEQMSLVQLFVPTEVAHDTVAELGELGDVQFKDLNPNVNPFQRSFVGEIRRVDEMARRVRFFAAQIEKEKDPIPLRPLYDSAPLITVGPRAAQTMDELDTVLTEHETKLTRMNENYNTLTERLKQLIEARYVLRETAVFFDRAQSHTTDIRTSFDDSAAPLLQHDDQESQFAPGDVQFDLEFVAGTIDRARVATFERVLWRVLRGNLYMNQTDITEPFVDPDSGTETWKNVFIIFAHGDVLLSKIRKIAESMGATLYPIDANADKRADALREVTARIEDLQTVLYNTGLTRRGELVRIGESLRSWQDVVKKEKLIYETLNLFNYDVRRKTLIAEGWVPTRDITNIQLALRHATEEAGTSVPPILHELRTHKTPPTFNKTNKFTEGFQAIMDSYGMAKYQEVNPGLFAIVTFPFLFAVMFGDIGHGLIILSAAIYMILNERRLARSDLGEINGQFFFGRYIILLMGLFSIYTGLMYNDIFSKSLHIWHSGWTFTEANGTITGESNGHTYPFGVDPGWHGADNALLFTNSYKMKMSIVLGVIHMTFALCLQLPNHIKFKRPVDIWANFVPQMLFLQSIFGYLVVCILYKWSIDWSTATTQPPSLLNMLIAMFLSPGTIEPGTQLYRGQSFVQIILLLIAAICVPWLLIAKPFVIWKEMKKIQGQGYVGLAHGEDIPREHSDDTLEGEEEGNGRAIVEDDKEGDEHEDFSEIVIHQTIHTIEFCLGCISHTASYLRLWALSLAHAQLSEVLWSMTIENFLGPNSILGWVFLIVVIGLWFGLTVFILCIMEGLSAFLHALRLHWVEANSKHFEGGGYAFTPLTFADLETKE

SEQ ID NO: 3339 - protein, 901 aa, Agaricus bisporus
  var. bisporus
  strain H97 / ATCC MYA-4626 / FGSC 10389
MPFNLDNIAALSNQHPKPTYYQYQYGTAGFRTLGDRLDSVVFRIGILAALRSMKHNSHAIGVMVTASHNPEQDNGVKLIDPRGEMLEASWEVHATTIANARTTEELVNVIQHIIDVVNIDTTRPAVVIYGRDTRPTGESLVAALQDGIRAAGADGRDAGITTTPIIHYLVRATNSKDFGEPTEIGYYTKMIDAFKKLVAGRPKISPLLVDCANGVGYIAADKVKKYLGDTLSLILENTSTATAGALNNSCGADYVKTTQRLPPSLNGKLTPVQRGCSLDGDADRLIYFYIDEKRQFRMLDGDKIASLVATFIVDLVRAAGLQGQIKVGTVQTAYANGSSTKFLAQRLPVKCVPTGVKYLHHAAESFDVGVYFEANGHGTVLFSRNTQETLEKHEPKTPAQQTALNHIINLTKLINQTVGDALSDMLLVEVVLAHRSYTGVEWDSLYTDLPNRLVKVVVNDRNAFVTTDAERRLVSPPLLQQRIDELVLKYDGGRTFVRPSGTEDVVRVYAEASTRVQADDLAYRIAGMVYDEAGVAICLAPTAHPLFLLSMCRFVIYKGTSPVQLSHLLTRPCHSIINQAFDSRLRLDRRRPMNGDGFGVGWYDSVYDPELGGQPCIFTSVTPAWNNANLARLAVKIKSPLVFAHVRATTAGSLSLDNCHPFAYENLMFMHNGNIADFHLFKRRLQADLPDHLFSFVQGNTDSEWSFALFLSKVPDPNARSFSPEILRNAMLETITSLNQYAEDAGVTEPSLMNFCVTDGSSIVVSRYISSRKDEAASLWFSSGTEFNEYAEGGHYRMSKSDKRENIIMIASEPLTFERADWMEIKTNHLVVITPKMNLLQIPIEDKYFVSPSDPASLARDTDFAEEKGLLNPLTRQSKLAHDAAATAHESPFKRQVTAEH

SEQ ID NO: 3340 - protein, 896 aa, Agaricus bisporus
  var. bisporus
  strain H97 / ATCC MYA-4626 / FGSC 10389
MGDFKPSPNSSQTRIDNYGDPFADRPRQTQFVEPERPYGSSASARPFESSASLPQDLGGGFDDEEYVEKLPLNTGGNFAGGFYPPGPVDPSAYGDSHIHPGRPSSVVSTSTNGVDSAWRRRQTIKRGVTRKVKLTQGNFIAEYPVPTPILNAVEDKWKSTNKTEFSHMRYTAATVDPDEFSEENGWSLRTKMYNRDTEILIAVTSYNEDKTLYARTLHGVMLNIRDICKTKQSKYWRRHAEEGTPGWQKITVALIVDGLEPMDKTVLDILATIGVYQDGVMKKQVDGKDTVAHIFEYTTQLSVDATPQLVLPRAEDPNNLVPVQIIFVLKAQNQKKINSHRWLFNAIGRMLNPEICVLIDAGTKPGHKSIYYLWEAFYNDPHLGGCCGEIHAMIKGGKKLLNPLVAAQNFEYKMSNILDKPLESSFGYVSVLPGAFSAYRFQAITGCPLEQYFHGDHSLADRLGPKGIYGMNIFTKNMFLAEDRILCFELVAKAKDRWTLTYVKPSKAETDVPESAAELIGQRRRWLNGSFAASVYALVNFFKLYRSGHGIIRMFFLHIQGLYNVFSLIFSWFALANMWLTFSIIIDLVPSQGIVIFGTETVTHWVNLSFKWLYLSFLALQFILALGNRPKGERMAYVATLWVYGFLAVYLLVCSFALTIKAFKNIPNELSFEGKSAGEIVLQFFEPPVGALIAAMISTYGIYLVASFLYRDPWHMFSSFLQYLCLAPSFTNVLNVYAFCNLHDVSWGTKGSDKAEALPSVSSSKTKGADMAVVEDTTKIQEDVDAAFKETVTRAITKIESKEVVEKPTMDDQNKTFRTRLVSLWMLSNATLAIAIENISGLPSKDPSVDADTLQKRQSTYFAIILYSTFGLAMVRFIGCLFYFFKRNLFRCCRKN

SEQ ID NO: 3341 - protein, 926 aa, Agaricus bisporus
  var. bisporus
  strain H97 / ATCC MYA-4626 / FGSC 10389
MRGRGAPDRGRGGGYGGARGTPSRGRGGNRGRGSAGGGRGVPAGIYSPPNRPIAIDARLRDGSQKQVMAGLKSAPINEKGLPLRLDLGTKGREIALRTNYFAMTIPKGPFYDYEVVTTPAVSIRRVRRRIFEIAEDTEPWKKILAGCVAHDHSAKLVASKLLPQPLSIDVPFYEEDDDPPAKGSQPRKMYTLSIKFARELETESLRKVIAGDPQYSAHDIMPIISAFNLILAAWPTRSGAGGVMVGRNKFFMPGTGVPMPLGGGLEAVRGFYSSVRTAHQALMVNVNVCTTAFYRSGNLATALIEFLKINSRPTTFVKGLRVKATHLGYRKTIKEATEYTAKTYVFKTEDYGEISVEEYFLKRYKIKLQHPNLPLVDVGGQKVNYLPTELCEILPNQPYRGKLLDEHTAAMIRYAAQPPNANAHAIETQGLKELGFTQNAPTLNAFGVGISQAMATVPGRVVPPPKIKYKGEKELDGRSFRSDKASWNLREVKFVKGATLAKWAVLLIRDGSHTEFNGPSDPELRSALKSFSEVCGKSGLNITSLPTIAEVHLPPYDRTDLGRGKAIHIIHSMLPKMFNQKPQIIFTILSNTDKHIYSGLKRLFDVTLDLPSVCAQAERLRNGGPQYYSNVSLKFNMKLGGVNHVLDKTSVTWLGEMPTMVVGIDVTHPGVIAVKGTPSIAAVVASVDRDCVQFPASLRRQESRKEMVTDLKEMMIERLNAFHSKSGRYPERILIYRDGVSEGQFASVIEEELPAVVEACRAVKMKSRPKLTIVVCAKRHHTRFFPTSEKDVDDKFNPLPGTVVDQGVTTVYNFDFYLQAHGSLQGSSKPTHYFVIHDENGFIPDKLQALTNSISYMFARATKAVSLVSPAYYADLACERGRCYLHELLNGIRSGPIDEEKAWKDAAKYWGNGPTGSAMKNIMFYL

SEQ ID NO: 3342 - protein, 1012 aa, Agaricus bisporus
  var. bisporus
  strain H97 / ATCC MYA-4626 / FGSC 10389
MLSRRVVVGRLSTLARASRSLRPTPPPLIRRGYALARGPSHNDPFANGTNAYYADEMYRLWRQDPKSVHTSWDVYFSGLDQGMPSHHAFQPPPTTHLPHPADGAPALHAGDGAELNDHLKVQLLVRAYQVRGHHVAELDPLGILDTDLADVRPPELELSRYGFTERDLEKDITLGPGILPHFATEGNKTMKLKDIIRTLKRIYCGHVGIQYVHIPDKEQCDWIRERVETPKPWNYTVEEKRMILDRLIWSESFEKFMASKYPNEKRFGLEGCEALVPGMKALIDRSVETGVKHITMGMPHRGRLNVLANVIRKPIEAILNEFSGDEDDNWPAGDVKYHLGANYVRPTPSGKKVSLSLVANPSHLEAADPVVLGKTRAIQHFENDEIAHTTAMGVLLHGDASFAGQGVVYETMGLHSLPSYGTGGTIHLIVNNQIGFTTDPRFARSTPYPSDIAKSIDAPIFHVNGDNVEAVNFVCQLAADYRAKFKKDVVIDIVCYRRYGHNETDQPSFTQPRMYEAIKNQPTPLTKYTKFLVGRGTFTEKDIEEHKKWVWGMLETAANGAKDYVPTSKEWLSAAWTGFPSPRQLAEQALPTRATGSDVPTLRQIGKAISTFPQGFTTHRNLARILNARGKTVEEGTNIDWSTAEALAFGTLALEKIHVRLSGQDVERGTFSQRHAVIHDQANEQQYVPLNDLGSNQARFVVCNSSLSEFGTLGFELGYSLVSPDSLTIWEAQFGDFANNAQCIIDQFIAAGERKWLQRTGLVVSLPHGYDGQGPEHSSGRIERFLQLCDDHPHIYPSPEKIERQHQDCNMQVVYPTTPANYFHVLRRQIHRDFRKPLIVFFSKSLLRHPKARSSLDEMVGETHFERYIPEASEDLVAPDQVKRHILCSGQVYYALLQAREERGIKDVAISRIEQLSPFPYDMVTSHLDKYPNADLLWCQEEPMNNGAWTYIGPRIYTAASRTQNHKGKYPYYAGREPTSSVATGSKTQHKKETEAFVNTAFDTWTEMHHLK

SEQ ID NO: 3343 - protein, 1048 aa, Agaricus bisporus
  var. bisporus
  strain H97 / ATCC MYA-4626 / FGSC 10389
MATLPPDGPNPNSKSAAKKEAKRLEKEAKLAAKNAKTAATVPKAKDAAAGKKAKAKDDETEFVNTTPKGQKKDVSGPMPAGYNPLAIESAWYDWWLESGFFKPQFDKDAEGNPTIKPAGLFIIPAPPPNVTGSLHIGHALTVGIQDALIRWNRMLGKTTLFAPGFDHAGISTQSVVEKRLYKLEGKTRHDLGREKFLEQVMDWKNDYQDRITKQLYRLGGSYDWNRTAFTMDPKLSKAVIETFCRLHEDGIIYRANRLVNWCVKLNTTLSNLEVDQKQLNGRTFLNVPGYDAKEKFEFGVITSFAYPIENSDEKIIVATTRPETMLGDTAIAVHPDDPRYKHLHGKLAVHPFVPGRKIPIVTDSIIVDMEFGTGAVKITPAHDPNDYDVGVRHSLECINILNDDGTLNANAGEKFKGMKRFHARVAVVKELKELGLYVDTKDNPMQIPLCSKSGDVIEPVLKPQWWVNCKPLAEEAIRRTEAGELLITPKTSENEWYRWLEGIQDWCISRQLWWGHRCPAYFVRIEGRDQDVNDGKNWVVGRTLEEATERAKVFANGAPFTLEQDEDVLDTWFSSGLWPFSIMGWPDQTADLKTFYPSSMLETGWDILFFWVARMVLLGIHLTGQMPFKEVLCHAMIRDAHGRKMSKSLGNVIDPTDVIQGLPLEALHEKLYEGNLDEKEIAKAKDGQKKDFPKGIPQCGTDALRFALCAYSGGGRDINLEILRVEGYRKFCNKIFNATKFAMLKLDESFVPQPNNKPTGKESLVEKWILHKLNVAATEINQHLTDRNFMAATTSAYNFWLYELCDVYIEAMKPMTDEAAPLETKKSAQQTLYMCLDYGLRLLHPFMPFVTEELWQRLPRMPNDSTPSIMLSSFPVADSAFEFEEADKQFDLIFSTLRAGRSLAASYNLLNNIQLFIHVRNDSEAALFEPQLATIIALTKGGKSAQVVRSSSEIPEGCGASVVTSSVTVHTLVRGLVDLDVEIGKCDKKLDVARMNHAKIVKTESQADYAKTVPENVRLANEDKRKTIEAEVATLESSREMFRRIQLQ

SEQ ID NO: 3344 - protein, 1485 aa, Agaricus bisporus
  var. bisporus
  strain H97 / ATCC MYA-4626 / FGSC 10389
MASLEDYDEFGNYIGADLDSDAEDEELNQGQYAPQPSGAPAPLEGFDDEPMQEPENEMALMEVDDEPRHKAVVLHEDKQYYPTAGELYGADVETLVQEEDAQPLSEPIVAPIKIRRWTVEEKDMPETRFDKGFLLNMTAFPEMIRNVAVVGHLHHGKTALMDMLVFETHKLIWDADKPTRYTDTHVLSREREISIKSSPMSLVLQTTSGKSHLLHLIDTPGHVNFLDEVAAAIRLADGILLVVDVVEGLMVGAEYIIRHALQENLKITLVVNKIDRLILELRIKPADAYYKIKHTIEEINTFISNIDPDPELRLSPENGNVAFASTDMNYCFTLRSFAKLYADTYGKLDVNAFAARLWGDIYFDEESRRFTRKQSDPEQNRTFIHFILNPLYKIYSNVLSEDTDALRETLASLGITLKPVIYKMDVRPLLKVVLDQFFGNSTGLVDVIVEHIPSPVENAANKVEGIYTGPQTSELAVSMKSCDPEGPVMVHITKLYHTTDAQSFRAFGRVISGTLRKGAEIKVLGEEYSPEDEEDMMKATVEDLWISEARYFIPAEEVAAGNLILIGGVDASISKTATIASTSIDDDLYIFRPMKHMTESVLKVAIEPIAPSELPKMLAGLRSINKSYPLISTKVEESGEHVMIGTGELYLDCVMHDLRRLFSEIEIKVSDPVTKFCETVLETSALKCYADTPNKKNKITMIAEPLERGIAEDIERGRVTMKMTAKDRGKFFEEKYQWDLLASRSIWAFGPYDNGPNVLLDDTLPSQVDKKLLGTIKEHIKQGFQWGAREGPLCDEPMRNVKFRLLDADIAQEAIFRGGGQIVPTARRVCYSSFLMASPKLMEPVYYVEVQAPADCISAVYTVLARRRGHVTQDIPKAGSPLYTVKALIPVIDANGFETDLRTATQGQAFCLQIFDHWSAIPGDPMDTSIKLRPLEPASGQALARDLVLKTRRRKGLGDQIAVSKYLDDEFVPTEIKAPFLEQFTEDWADRWTASEATKKNNAGSETFSYVGKWKVEEATKSIIKGDHGLVAKSPASHHAISAPFKKPIDFKQKPLVVQYEVNYQKGGSCGGGYIKLLEDGFQSSGQDFDDKTPWVVMFGPDLTCPGTKVHFIVRHKSPMTEEIEEKHYTGHPRFLVEKYTNLHTLVLHPNNTFNIYLNGELDKTGNLLEDMQPPVNPPTEIDDPSDSKPDDWVEDDRIIDIHATKPDDWDEDAPRRIPDDEAEKPEGWLDDELPHIPDPDATKPDEWDDEEDGDWVAPTMPNPKCDNAPGCGPWERPMKNNPNYKGRWSAPLIDNPDYKGPWAPRKIPNPNYFEDPTPVKSLPKIGGVGIELWTMTEDILFDNLYIGHSLEHAKKLAAETFDIKKPLERLAASVIEKLEGKDDEDDDDEVSFKDDPVSFIRNRVLSFVENVKEDPIEAFKTQPETGVALLVTLFTIFGMFSGFLGFGGASAKPVITQTAKKADTSEKKSETTSDDKKDDLKKRK

SEQ ID NO: 3345 - protein, 1590 aa, Agaricus bisporus
  var. bisporus
  strain H97 / ATCC MYA-4626 / FGSC 10389
MPEADIFKVPILGKDSIHCGFHLIPYIAHTVISTLPSSTYVLITDTNIAKFHLKSFEDVFQSTLDTHDASGAKPRFISLVIPPGETSKSRDGKAQIEDFLLLNKCTRDTVVLALGGGVIGDLVGFVSATFMRGVRFVQIPTTLLAMVDSSVGGKTAIDTPHGKNLIGAFWQPEYIFIDAAFLETLPQREFSNGMAEVVKTAAIWNENEFLSLEARSAEIFTAIQTPSENFAGRTKDTRSAAQELLLSVIVGSISVKAHIVTIDERETGLRNLVNFGHSIGHAIEAVLTPTILHGECVSIGMILEAELSRQMGILSQVGVGRLSRCLKAYNLPISVSDPRIANLPAARLLTVDRLLDIMRIDKKNSGNEKKIVILSRIGATYEQKATVVKDALIFKTLSEAAKVIPGIPSHNPVVMSTPGSKSISNRALVLAALGKGTCRLRNLLHSDDTQVMMAALGELKGAKFSWEDNGDTLVVEGGQGFLAVPPKGKELYLGNAGTAARFLTTVCTLVQASPKDNADVTIITGNARMKQRPNGPLVTALRTNGSQIKCLETEGCLPLAIAPEGLKGGTIQLAASVSSQYVSSILLCAPYAAQPVTLELTGGQVISQPYIDMTIAMMKTFGVEVKRRVDSASGKLLDTYDIPKAVYVSPPNYSIESDASSATYPLAIAAITGTSCTIDNIGTSSLQGDAKFAKEVLEKMGCTVSQTETQTTVQGPPIGGLKAIEEVDMEIMTDAFLTATVVAAVAHGKTRILGIANQRVKECNRIRAMIDQLAKFGVECIELDDGLEVIGKPIPELKRGASVHCYDDHRVAMAFSVLSTVVENTIIEEKRCVEKTWPNWWDDLENKIGIKVEGVDLAGLHAKASVSGTRNFDPSASVVLIGMRGVGKSFIGDLAANALGWPQLDADDYFAEVKKQALRDFVTEHGWPAFREAEVEVLGELLKEKATGHVISLGGGIVETPAARELIKQYASTTGPVVHVTRPLDEILAYLGAESARPAYGEPVADVYHRRHPWYTDISNYEFLNPVGASSVVTSPSAGVHEEVARFFKHITGQKPNLSSNVGAGKRSYFLSLTYPDITEALSIVEQISEGVDALELRVDLLKSSKESDAIPSTDYVASQLAALRRVTSLPIVYTVRTSSQGGKHPDKAEKEALELLELGLKAAVEYLDVEITLPEQKIRELASKKGRSQIIASYHDFSGNLKWNSVAVKEKYDIAEGLGDIIKIIGTANAIQDNFELHNFITSVNSKPNAKPIIAVNMGTQGQLSRILNETFTPVTHPLLPIKAAPGQLSFKQIQEALTLVGQLPAKQFYLFGNPISHSMSPTLHNTGFQVLGLPHKYSLLETQQFNEQNKEAIAAADFGGASVTIPFKLDVIPSLDELTPAAQAIGAVNTVIPTVSGGKRVLVGDNTDWIGIRKSIIAQLSTGVVGNGLVIGGGGTARAAIYALQSLNAETVYLWNRTKSKAEDLARAFPNARVQVLDRLGAWTSAPPNVIVGTVPASATTLEEGAPSATLLTADLYQYRDGPAVVVDMAYKPAQTPLLQLASVASNWKTVRGLDVLLEQGYEQFELWTGRRCPRKIVGEKVTEKYDA

SEQ ID NO: 3346 - protein, 180 aa, Linum usitatissimum
MADRTTQPHQVQVHTQHHYPTGGAFGRYEGVLKGGPYHQQGTGSGPSASKVLAVMTALPIGGTLLALAGITLAGTMIGLAITTPIFVICSPVLVPAALLIGFAVSAFLASGMAGLTGLTSLSWFARYLQQAGQGVGVGVPDSFDQAKRRMQDAAGYMGQKTKEVGQEIQRKSQDVKASDK

SEQ ID NO: 3347 - protein, 180 aa, Linum usitatissimum
MADRTTQPHQVQVHTQHHYPTGGAFGRYEGGLKGGPHHQQGSGSGPSASKVLAVMTALPIGGTLLALAGITLAGTMIGLAITTPIFVICSPVLVPAALLIGFAVSAFLASGMAGLTGLTSLSWFARYLQQAGQGVGVGVPDSFEQAKRRMQDAAGYMGQKTKEVGQEIQRKSQDVKASDK

SEQ ID NO: 3348 - protein, 347 aa, Linum usitatissimum
MDLIHTFLNFVAPPFTFFSLCFLLPPYFLFKTFTSAVSYVFSENVSGKVILITGASSGIGEHLAYEYGSRGACLVLVARREKGLREVVDLALELGSPQVIMIVGDVQKVDDCRRIVNETINHFGRLDHLVNNAGISSVCFFEDATDVTNFRTIMDTNFWGSAYITQFAIPYLRQTAGKIIALSSAGSWLPEPRMTIYNASKAAMVAFFETLRVELSPDIGVLIVTPGYIESELTQGKFMTAEGRMDVDQDLRDEKFGPIPVASVVSTAKGIVNSACRGDKYLTVPAWVRTTWLWKIFCPDAVELGYRLFFTSGRPGEPAPSKKMLDMTGAQGLMYPYSILNPAIKTV

SEQ ID NO: 3349 - protein, 536 aa, Linum usitatissimum
MASSALNNLVAVNPNTLSPSPKSTPLPNTFSNLRRVSAFRPIKASLFGDSPIKIPGITSQPPPSSDETTLPIRQIPGDYGLPGIGPIQDRLDYFYNQGREEFFKSRLQKYKSTVYRANMPPGPFIASNPRVIVLLDAKSFPVLFDMSKVEKKDLFTGTYMPSTELTGGYRILSYLDPSEPNHTKLKQLLFNLIKNRRDYVIPEFSSSFTDLCEVVEYDLATKGKAAFNDPAEQAAFNFLSRAFFGVKPIDTPLGKDAPSLISKWVLFNLAPILSVGLPKEVEEATLHSVRLPPLLVQNDYHRLYEFFTSAAGSVLDEAEQSGISRDEACHNILFAVCFNSWGGFKILFPSLMKWIGRAGLELHTKLAQEIRSAIQSTGGGKVTMAAMEQMPLMKSVVYETLRIEPPVALQYGKAKKDFILESHEAAYQVKEGEMLFGYQPFATKDPKIFDRPEEFVADRFVGEGVKLMEYVMWSNGPETETPSVANKQCAGKDFVVMAARLFVVELFKRYDSFDIEVGTSSLGASITLTSLKRSTF

SEQ ID NO: 3350 - protein, 375 aa, Linum usitatissimum
MERKFSPFVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDMKEKLAYVALDYEQELETAKSSSSVEKNYELPDGQVITIGAERFRCPEVLFQPSLIGMEAAGIHETTYNSIIKCDVDIRKDLYGNIVLSGGSTMFPGIADRMSKEITALAPSSMKIKVVAPPERKYSVWIGGSILASLSTFQQMWISKSEYDESGPSIVHRKCF

SEQ ID NO: 3351 - protein, 100 aa, Linum usitatissimum
HVTHETGSMCYIEEINKAEYCDRSRYPCAQGKRYYGRGPLQLTWNYNYQEAGKANGFDGVANPDIVARDPVLAWRTALWFWMTNVRAVLPQGFGATIRAI

SEQ ID NO: 3352 - protein, 186 aa, Linum usitatissimum
KGGAKKVVISAPSKDAPMFVVGVNEKEYKPELDIVSNASCTTNCLAPLAKVINDRFGIVEGLMTTVHAITATQKTVDGPSNKDWRGGRAASFNIIPSSTGAAKAVGKVLPALNGKLTGMAFRVPTADVSVVDLTVKLEKKATYEQIKAAIKEESEGKLKGILGYVDEDCVSADFVGDNRSSIFDAK

SEQ ID NO: 3353 - protein, 158 aa, Linum usitatissimum
MSLIPSFFGNRRSDPFSALDMWDPIRDFSSFNFPSSSLILGGGENSAFVNTRIDWKETPEAHVFKADLPGLKKEEIKVEVEEDRVLQISGERNVEKEDKNDTWHRVERSSGKFMRRFRLPENAKMEEVKAAMENGVLTVTVPKAEVKKPEVKAIEISG

SEQ ID NO: 3354 - protein, 169 aa, Linum usitatissimum
MAKLMSLAAVATAFLFLIVVDASVRTTVIIDEETNQGRGGGQGGQGQQQSCEQQIQQQDFLRSCQQFMWEKVQRGGRSHYYNQGRGGGEQSQYFDSCCDDLKQLSTGCTCRGLERAIGQMRQEIQQQGQQQEVQRWIQQAKQIAKDLPGQCRTQPSQCQFQGQQQSAWF

SEQ ID NO: 3355 - protein, 168 aa, Linum usitatissimum
MAKLMSLAAVATAFLFLIVVDASVRTTVIIDEDTNQGRGGQGGQGQQQQCEKQIQEQDYLRSCQQFLWEKVQKGGRSYYYNQGRGGGQQSQHFDSCCDDLKQLRSECTCRGLERAIGQMRQDIQQQGQQQEVERWVQQAKQVARDLPGQCGTQPSRCQLQGQQQSAWF

SEQ ID NO: 3356 - protein, 475 aa, Linum usitatissimum
  MOD_RES (145)..(145): Any amino acid
  MOD_RES (228)..(228): Any amino acid
  MOD_RES (236)..(236): Any amino acid
  MOD_RES (265)..(265): Any amino acid
  MOD_RES (276)..(276): Any amino acid
  MOD_RES (362)..(362): Any amino acid
MSHQTETKASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYXKTFQGPPHGIQVERDKLNKYGRPLLGCTIKPKLGLSAKNYGRAVYECLRGGLBFTKDDENVNSQPFMRWRDRFLFCAEAIYKXQAETGEIXGHYLNATAGTCEEMIKRAVFARELGVPIXMHDYLTGGFTXNTSLAHYCRDNGLLLHIHRAMHAVIDRQKNHGIHFRVLAKALRMSGGDHIHSGTVVGKLEGEREITLGFVDLLRDDFVEKDRSRGXYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEYEAMDTL

SEQ ID NO: 3357 - protein, 69 aa, Linum usitatissimum
SRRCPGKNAWPELVGKSGNMAAATVERENRNVHAIVLKEGSAMTKDFRCDRVWVIVNDHGVVTSVPHIT

SEQ ID NO: 3358 - protein, 106 aa, Linum usitatissimum; identical to SEQ ID NO: 636

SEQ ID NO: 3359 - protein, 413 aa, Linum usitatissimum
MAGLAPEGSQFDAKQYDAKMSELISADGQDYFASYDEVHETFDSMGLQENLLRGIYAYGFEKPSAIQQRGIVPFCKGLDVIQQAQSGTGKTATFCSGILQQLNYGLVECQALVLAPTRELAQQIEKVMRALGDYLGVKVHACVGGTSVREDQRILSSGVHVVVGTPGRVFDMLRRQSLRADSIKMFVLDEADEMLSRGFKDQIYDIFQLLPPNIQVGVFSATMPPEALDITRKFMNKPVRILVKREELTLEGIKQFHVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRGGRFGRKGVAINFVTTDDERMLFDIQKFYNVVIEELPANVADLL

SEQ ID NO: 3360 - protein, 146 aa, Linum usitatissimum; identical to SEQ ID NO: 619

SEQ ID NO: 3361 - protein, 155 aa, Linum usitatissimum
MDQTHQTYAGTTQNPSYGGGGTMYQQQQPRSYQAVKAATAATAGGSLIVLSGLILTATVISLIIATPLLVIFSPVLVPALITVGLLITGFLASGGFGVAAVTVLSWIYRYVTGGHPAGGDSLDQARSKLAGKAREVKDRASEFAQQHVTGGQQTS

SEQ ID NO: 3362 - protein, 221 aa, Linum usitatissimum
MGRRPARCYRQIKNKPYPKSRFCRGVPDPKIRIYDVGMKKKGVDEFPFCVHLVSWEKENVSSEALEAARIACNKYMTKSAGKDAFHLRVRVHPFHVLRINKMLSCAGADRLQTGMRGAFGKPQGVCARVAIGQVLLSVRCKDSNSQHAQEALRRAKFKFPGRQKIIISRKWGFTKFNRADYVKLKQENRIMPDGVNAKLLGCHGPLANRQPGRAFAPTATA

SEQ ID NO: 3363 - protein, 826 aa, Linum usitatissimum
MPISSIATVSGGGGGDADGALRNFKLNESTFLASLMPKKEIGADRFIEAHPEYDGRGVIIAIFDSGMDPAAAGLQVTTDGKPKVLDVIDCTGSGDIDTSKVVKADADGCIGGASGASLAVNPSWKNPSGEWHNYDDKGPVIDAVVWYDGELWRAALDTQNLEDNPECGKLADFVPLTNYRIERKFGVFSTVDACTAVLNIYDEGNILSIVTDSSPHGTHVSGIATAFHQEAEGITVSPYTVRKALENTSLYVGECLADKLTTGQGLMQVDRAYEYVCQSRDIPIFQYNIKVNQSGKSSHIERRFIEVPLGASWAEATVRVSEFDTTRRFFLDTLQICPLRRPIKWESVATFSSPGAKTFSFRVVSGQTMELAVAQFWSSGLGSHDTTIVDFEISFHGIDVTKEEIILDGSDAPVRIDTEALLASEKLSPVALLNKLRVPYRPVDSKLITLTGTRDKLPSGKQTLALTLTYKFKLEDGANVKPQVPLLNNRIYDTKFESQFYMISDANKRVYSVGDVYPAASKLPKGDYTLQLYLRHDNVQYLEKLKQLVLFIEKTLEDKDVIRLNFFSEPDGPIMGNGSYKSSELVPGKKEAIYLAPPAKDKLPKAEYPQHTPLLAKILEGLHSRSKIDDKIKHSQEVIATADEVISSVDKDELAKFFSYKPDPEDEEAEKMKKKMETTRDQLAEALYSKGLALSEIESLKNSDKTETEAGAEGNIDEWTDVRKEASEESGSKQDTFEETFKELQKWVDVKSSKFGTLYVLREKRRGRLGTALKVLNDMILEDGDPPKKKLYEMKLSLLEEIGWTHLTAYEKQWMHVRFPSSLPLF

SEQ ID NO: 3364 - protein, 262 aa, Linum usitatissimum
MARGLKKHLKRLNAPKHWMLDKLGGAFAPKPSSGPHKSRECLPLVLILRNRLKYALTYREVQSILMQRHVMVDNKVRTDKTFPAGFMDVVSIPKTNENFRLLYDTKGRFRLHSIRDEEAKFKLCKVRNIQFGSKGIPYLNTYDGRTIRYPDPLIKANDTIKLDLDSTKIVDFIKFDVGNVVMVTGGRNRGRVGILKNREKHKGSIETVHIQDSTGHEFATLLSNVFTIGKGSKPWVSLPKGKGIKLTIIEEAKKRIAAQAAA

SEQ ID NO: 3365 - protein, 142 aa, Linum usitatissimum
HQTQYGGTMQNQPQYQTKSYQAVKAATAATAGGSLLVLSGLILVATIIALTMATPLLVIFSPVLVPALITVGLLITGFLASGGFGVAAITVLSWIYRYVTGRHPVGADSLDQARMRITGKAREMKDRASDFGQQHVTGQQTS

SEQ ID NO: 3366 - protein, 260 aa, Linum usitatissimum
MARPILICVASLLLFSLLATVTARIPGVYTGGPWESAHATFYGGADASGTMGGACGYGNLYSQGYGVNTAALSTALFNEGLSCGACFEIKCDSDPRWCHPGQPSIFVTATNFCPPNFAQPSDNGGWCNPPRTHFDLAMPMFLKIAEYRAGIVPVSFRRVPCRKVGGIRFSINGFRYFNLLLVTNVAGAGDIVKVSIKGERTNWMPMSRNWGQNWQSNSVLVGQRLSFRVTGSDRRTVTSMNIAPANWQFGQTFTGKNFRV

SEQ ID NO: 3367 - protein, 270 aa, Linum usitatissimum
MSSTNETSPLPGLPIDLRGKRAFVAGVADDNGYGWAIAKSLAAAGAEILLGTWVPIKTNKRYAGSSNWTVKELAESVKQDFGSIDILVHSLANGPEVVKPLLETSRNGYLAAISASSYSFISLLQNFIPIMNPGGATISLTYIASERIIPGYGGGMSSAKAALESDTRVLAFEAGRKHKIRVNTISAGPLRSRAAKAIGFIDMMIDYSSANAPLQKEVTAEEVGNAAAFLVSPLASAITGTVVYVDNGLNAMGVGVDSPLFESLNIPKAN

SEQ ID NO: 3368 - protein, 293 aa, Linum usitatissimum
MKLNPLLSNLALYDIANTPGVAADVSHINTGSEVSGYVGDEQLGKALEGSDIVIIPAGVPRKPGMTRDDLFNINAGIVKGLCQAIAKYCPHALVNMISNPVNSTVPIAAEVFKKAGTYDEKRLFGVTSLDVVRARTFYAGKANVPVAGVNIPVVGGHAGVTILPLFSQANPKANLSDEEIVALTKRTQDGGTEVVEAKAGKGSATLSMAYAGALFADACLKGLNGVPDVVECTFVQSNVTELPFFASKVRLGKNGVEEILGLGPLSDFEKQGLENMKSELKSSIEKGITFANK

SEQ ID NO: 3369 - protein, 300 aa, Linum usitatissimum
MATDAAPPRALSARELDIQMMLAAEVHLGTKNCDFQMERYVFKRRNDGIYIINLGKTWEKLQMAARVIVGIENPQDIIVQSARPYGQRAVLKFAQYTGAHAIAGRHTPGTFTNQMQTSFSEPRLLILTDPRTDHQPIKEGALGNIPTIAFCDTDSPMRYVDIGIPANNKGKNSIGCLFWLLARMVLQMRGTIPQGHKWDIMVDLFFFREPEEQKQDQDEEPDYALAAPEFYGMAAGGDWNTPAADAQWTADAVQAPISGVPAAYIAEPTAAPIAGNWEPAPVPSPAFAPPASAASGWDEV

SEQ ID NO: 3370 - protein, 80 aa, Linum usitatissimum
VGCGRIGKLLLQRLKPFGCNLLYHDRLKMEPELETQIGAKFEEDVDAMLPKCDVVVINTPLTEKTKGMFDKDRILKMKKG

SEQ ID NO: 3371 - protein, 141 aa, Linum usitatissimum
MSSVAAAGSAKSGRGKPKSKAVSRSQKAGLQFPVGRIARFLKKGRYAERVGSGSPVYLCAVMEYLAAEVLELAGNAARDNKKTRIVPRHIQLAVRNDEELSKLLGGVTIANGGVLPKIHQSLLLKKAGKDKGDIGSASQEF

SEQ ID NO: 3372 - protein, 155 aa, Linum usitatissimum
MDQSHQTYAGTMQNPSYGGGGTMHQQQQPRSYQAVKAATAATAGGSLIVLSGLILTATVISLILATPLLVIFSPVLVPALITVGLLITGFLASGGFGVAAVTVLSWIYRYVTGGHPVGADSLEQARSRLAGKAREVKDRASEFGQQHVTGGQQTS

SEQ ID NO: 3373 - protein, 166 aa, Linum usitatissimum
MASIATAEACDSNAALLASGDLRVLQPIFKIYGQSNAFSGPIVTLKLFEDNVLVREMLETRGEGRVLVVDGAGSMRCALVGGNLGQLAQNMGWAGIVVNGCIRDVDEINACDIGVRALASHPMKSSKRGLGEKHVTVQIGGTLIRDGEWLYADSDGILISKTELSV

SEQ ID NO: 3374 - protein, 206 aa, Linum usitatissimum
MNSKSLAVALLWGALLFGTLALIQAKKSDEKLKEITHKVYFDVEIDGKPAGRITMGLYGKAVPKTAENFRALCTGEKGVGKSGKPLHYKGSSFHRIIPSFMLQGGDFTHGDGRGGESIYGEKFADENFKLKHTGPGLLSMANAGKDTNGSQFFITTVTTSWLDGRHVVFGKVLSGMDVVYKVEAEGKQSGTPKSKVVIVDSGELPL

SEQ ID NO: 3375 - protein, 305 aa, Linum usitatissimum
IPPDQQRLIFAGKQLEDGRTLADYNIQKESTLHLVLRLRGGMQIFLKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGI

SEQ ID NO: 3376 - protein, 323 aa, Linum usitatissimum
MAASTGSTAVAFKSAGFVAASSGERGINQFRHWSPVPASLHFSRAGLRCRSRSSVSSSGVRAQVAAVEPVSSESVKKVESPVVIVTGASRGIGKAIALSLGKAGCKVLVNYARSSKEAEEVSKEIEASGGQAVTFGGDVSKEEDVEAMMKTAIDAFGTVDILINNAGITRDTLLMRMKKQQWQDVIDLNLTGVFLCTQAAAKIMMKKRKGRIINIASVVGLVGNIGQANYSAAKAGVIGFTKSVAKEYSSRNINVNAVAPGFIASDMTAKLGDDIEKKILETIPLGRYGQPEEVAGLVEFLALNPAAGYMTGQVLTIDGGMVM

SEQ ID NO: 3377 - protein, 332 aa, Linum usitatissimum
MAKDPVRVLVTGAAGQIGYALVPMIARGVMLGADQPVILHMLDIPPAAEALNGVKMELVDAAFPLLKGVVATTDVVEACTGVNIAVMVGGFPRKEGMERKDVMSKNVSIYKSQASALEKHAAANCKVLVVANPANTNALILKEFAPSIPEQNITCLTRLDHNRALGQVSERLNVPVSDVKNVIIWGNHSSTQYPDVNHATVKTSSGDKPVRELVKDDVWLNAEFITTVQQRGAAIIKARKLSSALSAASSACDHIRDWVLGTPQGTWVSMGVYSDGSYNVPAGLIYSFPVTCQNGEWKIVQGLAIDEFSRKKLDLTAEELSEEKALAYSCLN

SEQ ID NO: 3378 - protein, 388 aa, Linum usitatissimum
MNVIGEPIDEKGEISTEHFLPIHREAPSFVEQATEQQILVTGIKVVDLLAPYQRGGKIGLFGGAGVGKTVLIMELINNVAKAHGGFSVFAGVGERTREGNDLYREMIESGVIKLGDKQADSKCALVYGQMNEPPGARARVGLTGLTVAEHFRDAEGQDVLLFVDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHILGEDHYGTARGVQKVLQNYKNLQDIIAILGMDELSEDDKLTVARARKIQRFLSQPFHVAEVFTGAPGKYVELKESIQSFQGVLDGKYDDLSEQSFYMVGGIDEVIAKAEKIAKESATS

SEQ ID NO: 3379 - protein, 427 aa, Linum usitatissimum
MGETRDNDYEEELLDYEEEEEKAPDSITAKVNGEAPKKGYVGIHSSGFRDFLLKPELLRAIVDSGFEHPSEVQHECIPQAILGMDVICQAKSGMGKTAVFVLSTLQQIEPTPGQVIALVLCHTRELAYQICHEFERFSTYLPDTKVAVFYGGVNIKTHRDLLKNECPHVVVGTPGRILALARDKELSLKNVRHFILDECDKMLESLDMRRDVQEIFKMTPHDKQVMMFSATLSKEIRPVCKKFMQDPMEIYVDDEAKLTLHGLVQHYIKLTELEKNRKLNDLLDALDFNQVVIFVKSVSRAAELNKLLIECNFPSICIHSGMSQEERLTRYKGFKEGHKRILVATDLVGRGIDIERVNIVINYDMPDSADTYLHRVGRAGRFGTKGLAITFVSSASDSDVLNQVQERFEVDIKELPEQIDTSTYMPS

SEQ ID NO: 3380 - protein, 508 aa, Linum usitatissimum
MGFEKKEHEFLGEIGLSSSNPGCYVGGKWKANGPVITTTNPANNQTIAEVVEGSMEDYEEGLKACSEATKTWMQVPAPKRGEIVRQIGDALRAKLDHLGRLVSLEMGKILAEGVGEVQEIIDMCDFAVGLSRQLNGSIIPSERPNHAMLEMWNPLGIVGVITAFNFPCAVLGWNACLALVCGNCVVWKGAPTTPLVTIAMTKLIAEVLEKNNLPGAIFTSLCGGAEIGQAIAKDTRIPLVSFTGSSKVGQMVQQIVSQRFGKCLLELSGNNAIIVMDDADVQLAARSVLFAAVGTAGQRCTTCRRLLLHESIYKKVLDQLVEAYKQVKIGDPLEKGTLLGPLHTTESRKNFERGIELVKSQGGNILTGGSIIKSDGNFVQPTIVEVAPTVVAVKEELFAPVLYVMKFKTLQEAIDINNSVPQGLSSSIFTQKPETIFKWIGPLGSDCGIVNVNIPTNGAEIGGAFGGEKATGGGREAGSDSWKQYMRRSTCTINYGNELPLAQGINFG

SEQ ID NO: 3381 - protein, 801 aa, Linum usitatissimum
MADSGVVTVYGNAALYEPTTKKSTFSVKVGLAQMLRGGVIMDVVNADQARIAEEAGACAVMALERVPADIRSQGGVARMSDPQLIKEIKQSVTIPVMAKARIGHFVEAQILEALGIDYIDESEVLTLADEDNHINKHNFRIPFVCGCRNLGEALRRIREGAAMIRTKGEAGTGNVIEAVRHVRSVMGDIRVLRNMDDDEVFTFAKKIAAPYDLVMQTKQLGRLPVVQFAAGGVATPADAAMMMQLGCDGVFVGSGVFKSGDPARRARAIVQAVTHYTDPEVLAEVSCGLGEAMVGINLNDPNVERIFRLTEAEPPEYIKFLFDRYSRDGTMTVEDLTRFLVEIQGEHTASHDDALAIFNSLKHLRIFQRRGLHFDAFYRYLLGDLNVANSPSNVVHHNMNAPLSHYFLFTGHNSYLTGNQLSSDSSTKPIINALKKGVRVIELDLWPNNNKDDVEMVNDTFGEILYTPESDEMSEFRSPDYLKKRILISTKPPKEYLETPGSQSSGKERTPSSSFDDKDKDEGHIPDEDEEKTAPQYRHLIAIHAAKMKGGIKNMLKVEANKVRRLSMSEQEFETASKTLATAIVRFTQRNLLRVYPKGSRLDSSNYNPFIGWMHGAQMVAFNMQGYGKHLWTMQGMFSANGGCGYLKKPDFLLELGPDDKVYDPSIPQQVKTTLKGKLYLGEGWLQDFRHTHFDLCSPPDFFVKVGIEGVPGDKAKHITKVIDDEWLPIWDEEFKFELRVPELAILRIEVMDYDVGNHGFGSQTYLPISELQTGIRSVPLYSRDGSRYKHTRLLMQFEFS

SEQ ID NO: 3382 - protein, 136 aa, Solanum tuberosum
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGVFEDTNLCAIHAKRVTIMPKDIQLARRIRGERA

SEQ ID NO: 3383 - protein, 219 aa, Solanum tuberosum
MKSINILSFLLLSSTLSLVAFARSFTSENPIVLPTTCHDNLVLPEVYDQDGNPLRIGERYIIKNPLLGAGAVYLNNIGNLQCPNAVLQHMSIPQFLGKGTPVMFVRKSESDDGDVVRLMTAVYIKFFVKTTKLCVDETVWKVNDEQLVVTGGNVGNENDIFKIKKTDLVIRGMKNVYKLLHCPSHLQCKNIGSNFKNGYPRLVTVDDDKDFIPFVFIKA

SEQ ID NO: 3384 - protein, 222 aa, Solanum tuberosum
MKSINILSFLLLSSTLSLVAFARSFTSENPIVLPTTSHDDDNLVLPEVYDQDGDPLRIGERYIINNPLIGAGAVYLYNIGNLQCPNAVLQHMSIPQFLGKGTPVVFVRKSESDYGDVVRQMTAVYIKFFVKTTKLCVDQTVWKVDDEQLVVTGGKVGNENDIFKIRKIDLVTPGSSKNVYKLLHCPSHLQCKNIGGNFKNGYPRLATVDDDKDFIPFVFIKA

SEQ ID NO: 3385 - protein, 534 aa, Solanum tuberosum
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGNF

SEQ ID NO: 3386 - protein, 123 aa, Solanum tuberosum
MLQHMSIPQFLGEGTPVMFVRKSESDYGDVVRIMTGVYIKFFVKTTKLCVDQTGGKVGNENDIFKIRKTDLVTPGGSKNVYKLLHCPSHLQCKNIGGNFKNGYPRLVTVDDDKEFIPFVFIKA

SEQ ID NO: 3387 - protein, 218 aa, Solanum tuberosum
MKCLFLLCLCLVPIVVFSSTFTSQNLIDLPSESPLPKPVLDTNGKELNPNSSYRIISIGRGALGGDVYLGKSPNSDAPCPDGVFRYNSDVGPSGTPVRFIPLSTNIFEDQLLNIQFNIPTVKLCVSYTIWKVGNLNAYFRTMLLETGGTIGQADNSYFKIVKSSKIGYNLLSCPFTSIICLRCPEDQFCAKVGVVIQNGKRRLALVNENPLDVLFQEV

SEQ ID NO: 3388 - protein, 348 aa, Solanum tuberosum
MVTVLSIDGGGIKGIIPGIILEFLEGQLQKMDNNADARLADYFDVIGGTSTGGLLTAMITTPNENNRPFAAAKDIVPFYFQHGPHIFNSSTGQFFGPKYDGKYLMQVLQEKLGETRVHQALTEVAISSFDIKTNKPVIFTKSNLAKSPELDAKMSDICYSTAAAPTYFPPHYFATNTSNGDKYEFNLVDGAVATVADPALLSVSVATRRAEEDPAFASIRSLNYKQLLLLSLGTGTNSEFDKTHTAQETAKWGALQWMLVIQQMTEAASSYMTDYYLSTVFQDLHSQNNYLRVQENALTGTTTKADDASEANMELLVQVGENLLKKPVSKDNPETYEEALKRINRGYG

SEQ ID NO: 3389 - protein, 377 aa, Solanum tuberosum
MAEGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDHLMKILTERGYSFTTTAEREIVRDVKEKLSYIALDFEQELETSKTSSSVEKSYELPDGQVITIGAERFRCPEVLFQPSLIGMEAAGIHETTYNSIMKCDVDIRKDLYGNIVLSGGTTMFPGIADRMSKELTALAPSSMKIKVVAPPERKYSVWIGGSILASLSTFQQMWIAKAEYDESGPSIVHRKCF

SEQ ID NO: 3390 - protein, 858 aa, Solanum tuberosum
MGGRELFGGHDDSKKVKGTVVMMKKNALDFTDLAGSVTDKIFEAFGQKVSFQLISSVQGDPRNGLQGKHSNPAYLENSLFTLTPLTAGSETAFGVTFDWNEEFGVPGAFIIKNTHINEFFLKSLTLEDVPNHGKVHFVCNSWVYPSFRYKSDRIFFANQPYLPSKTPELLRKYRENELLTLRGDGTGKREAWDRIYDYDIYNDLGNPDQGQENVRTTLGGSAEYPYPRRGRTGRPPTRTDPKSESRIPLILSLDIYVPRDERFGHLKMSDFLTYALKSIVQFILPELHALFDGTPNEFDSFEDVLRLYEGGIKLPQGPLFKALTAAIPLEMIKELLRTDGEGILRFPTPLVIKDSKTAWRTDEEFAREMLAGVNPIIISRLQEFPPKSKLDPEAYGNQNSTITAEHIEDKLDGLTVDEAMNNNKLFILNHHDLLIPYLRRINTTITKTYASRTLLFLQDNGSLKPLAIELSLPHPDGDQFGVTSKVYTPSDQGVESSIWQLAKAYVAVNDAGVHQLISHWLNTHAVIEPFVIATNRQLSVLHPIHKLLYPHFRDTMNINASARQILINAGGVLESTVFQSKFALEMSAVVYKDWVFPDQALPADLVKRGVAVEDSSSPHGVRLLIEDYPYAVDGLEIWSAIKSWVTDYCSFYYGSDEEILKDNELQAWWKELREVGHGDKKNEPWWPEMETPQELIDSCTTIIWIASALHAAVNFGQYPYAGYLPNRPTVSRRFMPEPGTPEYEELKKNPDKAFLKTITAQLQTLLGVSLVEILSRHTTDEIYLGQRESPEWTKDKEPLAAFDKFGKKLTDIEKQIIQRNGDNILTNRSGPINAPYTLLFPTSEGGLTGKGIPNSVSI

SEQ ID NO: 3391 - protein, 142 aa, Solanum tuberosum; identical to SEQ ID NO: 572

SEQ ID NO: 3392 - protein, 103 aa, Solanum tuberosum; identical to SEQ ID NO: 1753

SEQ ID NO: 3393 - protein, 154 aa, Solanum tuberosum
MDVHKEVNFVAYLLIVLGLLVLVSAMEHVDAKACTLECGNLGFGICPRSEGSPENRICTNCCAGYKGCNYYSANGAFICEGQSDPKKPKACPLNCDPHIAYSKCPRSEGKSLIYPTGCTTCCTGYKGCYYFGKNGKFVCEGESDEPKANMYPAM

SEQ ID NO: 3394 - protein, 232 aa, Solanum tuberosum
MQVLQEKLGETRVHQALTEVAISSFDIKTNKPVIFTKSNLANAPELDAKMYDICYSTAAAPIYFPPHYFTTHTSNGDIYEFNLVDGGVATVGDPALLSLSVATKLAQVDPKFASIKSLDYKQMLLLSLGTGTNSEFDKTYTAEEAAKWGPLRWMLAIQQMTNAASSYMTDYYISTVFQARHSQNNYLRVQENALTGTTTEMDDASEANMDLLVQVGETLLKKPVSKDSPENL

SEQ ID NO: 3395 - protein, 314 aa, Solanum tuberosum
MASLTVPAEVPSVAEDCEQLRSAFKGWGTNEKLIISILAHRNAAQRKLIRQTYAETFGEDLLKELDRELTHDFEKLVLIWTLDPSERDAYLAKEATKRWTKSNFVLVEIACTRSPKELVLAREAYHARNKKSLEEDVAYHTTGDHRKLLVPLVSSYRYGGDEVDLRLAKAESKVLHEKISDKAYSDDEVIRILATRSKAQLNATLNHYKDEYGEDILKQLEDEDEFVALLRATIKGLVYPEHYFVEVLRDAINRRGTEEDHLSRVIATRAEVDLKTIANEYQKRDSIPLGRAIAKDTGGDYENMLVALLGQEEE

SEQ ID NO: 3396 - protein, 338 aa, Solanum tuberosum
MANGKIKIGINGFGRIGRLVARVALQRDDVELVAVNDPFISTDYMTYMFKYDSVHGQWKHHELKVKDEKTLLFGEKAVTVFGIRNPEDIPWGEAGADFVVESTGVFTDKDKAAAHLKGGAKKVVISAPSKDAPMFVVGVNENEYKPELDIVSNASCTTNCLAPLAKVINDRFGIVEGLMTTVHAMTATQKTVDGPSMKDWRGGRAASFNIIPSSTGAAKAVGKVLPSLNGKLTGMAFRVPTADVSVVDLTVRLEKEASYEDIKAAIKEESEGKLKGILGYTEDDVVSTDFVGDSRSSIFDAKAGIALSKNFVKLVSWYDNEWGYSSRVIDLICHMAKA

SEQ ID NO: 3397 - protein, 414 aa, Solanum tuberosum
MNDTHPTLCIPELMRILIDLKGLNWNEAWNITQRTVAYTNHTVLPEALEKWSYELMQKLLPRHVEIIEAIDEELVHEIVLKYGSMDLNKLEEKLTTMRILENFDLPSSVAELFIKPEISVDDDTETVEVHDKVEASDKVVTNDEDDTGKKTSVKIEAAAEKDIDKKTPVSPEPAVIPPKKVRMANLCVVGGHAVNGVAEIHSEIVKEEVFNDFYELWPEKFQNKTNGVTPRRWIRFCNPPLSAIITKWTGTEDWVLKTEKLAELQKFADNEDLQNEWREAKRSNKIKVVSFLKEKTGYSVVPDAMFDIQVKRIHEYKRQLLNIFGIVYRYKKMKEMTAAERKTNFVPRVCIFGGKAFATYVQAKRIVKFITDVGATINHDPEIGDLLKVVFVPDYNVSVAELLIPASDLSEHIR

SEQ ID NO: 3398 - protein, 652 aa, Solanum tuberosum
MAGKGEGPAIGIDLGTTYSCVGVWQHDRVEIIANDQGNRTTPSYVAFTDTERLIGDAAKNQVAMNPVNTVFDAKRLIGRRFSDPSVQSDMKLWPFKVIPGPADKPMIVVTYKGEEKQFSAEEISSMVLTKMKEIAEAYLGTTIKNAVVTVPAYFNDSQRQATKDAGVISGLNVMRIINEPTAAAIAYGLDKKSTSTGEKNVLIFDLGGGTFDVSLLTIEEGIFEVKATAGDTHLGGEDFDNRMVNHFVQEFKRKHKKDISGNPRALRRLRTACERAKRTLSSTAQTTIEIDSLYEGIDFYTTITRARFEEKNMDLFRKCMEPVEKCLRDAKMDKSGVHDVVLVGGSTRIPKVQQLLQDFFNGKELCKSINPDEAVAYGAAVQAAILSGEGNEKVQDLLLLDVTPLSLGLETAGGVMTVLIPRNTTIPTKKEQVFSTYSDNQPGVLIQVYEGERARTKDNNLLGKFELSGIPPAPRGVPQINVCFDIDANGILNVSAEDKTTGQKNKITITNDKGRLSKEEIERMVQEAEKYKSEDEELKKKVEAKNGLENYAYNMRNTIKDDKVSSQLPAADKKKIEDAIDEAIKWLDSNQLAEADEFEDKMKELESVCNPIIAKMYQGGAGGATMDEDDGPSVGGGAGSGSGAGPKIEEVD

SEQ ID NO: 3399 - protein, 56 aa, Solanum tuberosum
MDDASEANMDLLVQVGETLLKKPVSKDSPETYEEALKRFAKLLSDRKKLRANKASY

SEQ ID NO: 3400 - protein, 181 aa, Solanum tuberosum
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 3401 - protein, 447 aa, Solanum tuberosum
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVSSYLKKVGYNPDKIPFVPISGFEGDNMIERSTNLDWYKGPTLLEALDQLNEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAKGAASFTAQVIIMNHPGQIGNGYAPVLDCHTSHIAVKFAEILTKIDRRSGKELEKEPKFLKNGDAGMVKMIPTKPMVVETFSEYPPLGRFAVRDMRQTVAVGVIKSVDKKDPSGAKVTKAAQKKK

SEQ ID NO: 3402 - protein, 78 aa, Solanum tuberosum; identical to SEQ ID NO: 595

SEQ ID NO: 3403 - protein, 150 aa, Solanum tuberosum
MSKRKTREPKEETVTLGPATREGELVFGVAHIFASFNDTFIHVTDLSGRETMVRITGGMKVKADRDESSPYAAMLAAQDVSQRCKELGINALHIKLRATGGNKTKTPGPGAQSALRALARSGMKIGRIEDVTPIPTDSTRRKGGRRGRRL

SEQ ID NO: 3404 - protein, 203 aa, Solanum tuberosum
MKQAYYLSMEFLQGRALLNAIGNLELTGAFAEALKNLGHNLENVASQEPDAALGNGGLGRLASCFLDSLATLNYPAWGYGLRYKYGLFKQRITKDGQEEVAEDWLEIGSPWEVVRNDVSYPIKFYGKVSTGSDGKRYWIGGEDIKAVAYDVPIPGYKTRTTISLRLWSTQVPSADFDLSAFNAGEHTKACEAQANAEKVYLIY

SEQ ID NO: 3405 - protein, 142 aa, Solanum tuberosum; identical to SEQ ID NO: 621

SEQ ID NO: 3406 - protein, 205 aa, Solanum tuberosum; identical to SEQ ID NO: 566

SEQ ID NO: 3407 - protein, 490 aa, Solanum tuberosum
MTISPRYDQYKDAWDTSVAVEVKVGDSIEIVRFFHCYKRGVDRVFVDHPMFLEKVWGKTGSKIYGPKAGLDYLDNELRFSLLCQAALEAPKVLNLNSSNYFSGPYGEDVLFIANDWHTALIPCYLKSMYQSRGIYLNAKVAFCIHNIAYQGRFSFSDFPLLNLPDEFRGSFDFIDGYEKPVKGRKINWMKAGILESHRVVTVSPYYAQELVSAVDKGVELDSVLRKTCITGIVNGMDTQEWNPATDKYTDVKYDITTVMDAKPLLKEALQAAVGLPVDKKIPLIGFIGRLEEQKGSDILVAAIHKFIGLDVQIVVLGTGKKEFEQEIEQLEVLYPNKAKGVAKFNVPLAHMITAGADFMLVPSRFEPCGLIQLHAMRYGTVPICASTGGLVDTVKEGYTGFHMGAFNVECDVVDPADVLKIVTTVARALAVYGTLAFAEMIKNCMSEELSWKEPAKKWETLLLGLGASGSEPGVEGEEIAPLAKENVATP

SEQ ID NO: 3408 - protein, 492 aa, Solanum tuberosum
MDPSKYRPSSAYDTPFLTTNAGGPVYNNVSSLTVGPRGPVLLEDYYLIEKLATFDREKIPERVVHARGASAKGFFEVTHDISHLSCADFLRAPGAQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPTDYRHMEGFGVHAYQLINKEGKAHYVKFHWKPTCGVKCMSEEEAIRVGGTNHSHATKDLYDSIAAGNYPEWKLFIQTMDPEDVDKFDFDPLDVTKTWPEDLLPLIPVGRLVLNRNIDNFFAENEQLAFNPGHIVPGIYYSEDKLLQTRIFAYADTQRHRIGPNYMQLPVNAPKCGHHNNHRDGAMNMTHRDEEVDYLPSRFDPCRPAEQYPIPACVLNGRRTNCVIPKENNFKQAGERYRSWESDRQDRYITKWVESLSDPRVTHEIRSIWISYLSQADKSCGQKVASRLTVKPTM

SEQ ID NO: 3409 - protein, 765 aa, Solanum tuberosum
MASHVVGYPRMGPKRELKFALESFWDGKSSAEDLKKVSADLRSSIWKQMSDAGIKYIPSNTFSYYDQVLDTTTMLGAVPSRYNWTGGEIEFGTYFSMARGNASVPAMEMTKWFDTNYHFIVPELGPDVNFSYASHKAVNEYKEAKAQGVDTVPVLVGPVSYLLLSKPAKGVDKSFPLLSLLDKILPIYKEVIAELKAAGASWIQLDEPTLVLDLESHKLEAFTKAYADLESSLSGLNVLVETYFADVPAGAFKTLTALKGVTAFGFDLVRGTQTLELIKSSFPSGKYLFAGVVDGRNIWASDLAASLALLQSLEGVVGKDKLVTSTSCSLLHTAVDLINETKLDDEIKSWLAFAAQKVVEVNALAKALSGAKDEAFFSANAAAQASRKSSPRVTNEAVRKASAALQGSDHRRATNVSARLDAQQKKLNLPILPTTTIGSFPQTVELRRVRREYKAKKISEEEYVKAITEEIKKVVDLQEELDIDVLVHGEPERNDMVEYFGEQLSGFAFTANGWVQSYGSRCVKPPIIYGDVSRPKAMTVFWSSKAQEMTKRPMKGMLTGPVTILNWSFVRNDQPRFETCYQIALAIKDEVEDLEKAGITVIQIDEAALREGLPLRKAEHTSYLNWAVHSFRITNVGIQDTTQIHTHMCYSNFNDIIHSIIDMDADVITIENSRSDEKLLSVFREGVKYGAGIGPGVYDIHSPRIPSTEEIADRVNKMLAVLETNILWVNPDCGLKTRKYTEVKPALQNMVSAAKTIRTQLASAK

SEQ ID NO: 3410 - protein, 140 aa, Solanum tuberosum
MSKRGRGGSAGNKFRMSLGLPVAATVNCADNTGAKNLYIISVKGIKGRLNRLPSACVGDMVMATVKKGKPELRKKVMPAVIVRQRKPWRRKDGVFMYFEDNAGVIVNPKGEMKGSAITGPIGKECADLWPRIASAANAIV

SEQ ID NO: 3411 - protein, 227 aa, Solanum tuberosum
MKSINILSFLLLSSTLSLVAFAQSFTSENPIVLPTTSHDDDNLVLPEVYDDEGHPLRIGEEYIINNPLLGAGAVYLDNIGNLTCPNAVLQHISTFNLSGDGTPVKFVRKSESDDGDVVRVMTVVYIKFFPNIPNLLCVNENVWKVNDEELVVTGGNVGNENDIFKIMKTDLVTPEGSKYVYKLLHCPAHLECKNIGVNFKDGYPRLTTVDDDKNFAPFVFSKAKNAN

SEQ ID NO: 3412 - protein, 381 aa, Solanum tuberosum
MAMSRVASTAARAITSPSSLVFTRELQASPGPKKIVGVFYKANEYAEMNPNFLGCAENALGIREWLESKGHQYIVTPDKEGPDCELEKHIPDLHVLISTPFHPAYVTAERIKKAKNLQLLLTAGIGSDHVDLKAAAAAGLTVAEVTGSNTVSVAEDELMRILILVRNFLPGHHQVINGEWNVAAIAHRAYDLEGKTVGTVGAGRIGRLLLQRLKPFNCNLLYHDRLKMDSELENQIGAKFEEDLDKMLSKCDIVVINTPLTEKTKGMFDKERIAKLKKGVLIVNNARGAIMETQAVVDACNSGHIAGYSGDVWYPQPAPKDHPWRYMPNQAMTPHISGTTIDAQLRYAAGTKDMLDRYFKGEDFPAENYIVKDGELAPQYR

SEQ ID NO: 3413 - protein, 444 aa, Solanum tuberosum
MATIKSIKARQIFDSRGNPTVEVDVHVSNGVFARAAVPSGASTGIYEALELRDGGSDYLGKGVSKAVNNVNSIIGPALIGKDPTDQTGLDNFMVHELDGTQNEWGWCKEKLGANAILAVSLAVCKAGAAVRNVPLYKHIADLAGNKKLVLPVPAFNVINGGSHAGNKLAMQEFMILPVGAANFKEAMKMGCEVYHHLKSVIKKKYGQDATNVGDEGGFAPNIQENKEGLELLKTAIEKAGYTGKVVIGMDVAASEFYGKDKSYDLNFKEESNDGSQKISGDQLKDLYKSFVSEYPIVSIEDPFDQDDWETYAKLTTEIGEQVQIVGDDLLVTNPKRVAKAIAEKTCNALLLKVNQIGSVTESIEAVKMSKKAGWGVMTSHRSGETEDTFIADLAVGLSTGQIKTGAPCRSERLAKYNQLLRIEEELGSEAVYAGASFRKPVEPY

SEQ ID NO: 3414 - protein, 579 aa, Solanum tuberosum
MESALKDLSTPTGGVEDVYGEDCATEDQCITPWTIAVSSGYNLLRDPRYNKGLAFTERERDAHYLRGLLPPVISSQELQEKKLMQSIRQYDVPLHKYVAMMELEERNERLFYKLLIDNVEELLPIVYTPTVGEACQKYGSIFKRPQGLYISLNEKGRILEVLKNWPEKSIQVIVVTDGERILGLGDLGCQGMGIPVGKLALYTALGGVRPSACLPITIDVGTNNEKLLNDEFYIGLKQRRATGQEYYDFLHEFMSAVKQNYGEKILVQFEDFANHNAFELLAKYRTSHLVFNDDIQGTASVVLAGLIASLKLLGGALCDHTFLFLGAGEAGTGIAELIALEISNKTKIPVEETRKKIWLVDSKGLIVSGRKETLQAFKKPWAHEHEPVNNLLDAVKAVKPTVLIGTSGTGRTFTKEVVEAMACMNKRPLIMALSNPTSQAECTAEEAYTWSEGRVVFASGSPFPSFEYDGKLNIPGQANNCYIFPGFGFGLVMSGTIRVHDDMLLAASEALAAQVTEEHYAKGMIYPPFADIRKISAHIAASVAAKAYELGVATRLPQPADLVKYAESCMYTPNYRSYR

SEQ ID NO: 3415 - protein, 761 aa, Solanum tuberosum
MGLMSEALTQILIPLAAFIGIGFALLQWFLVSKVRVSSGSNLVSEYNDKLIEEDEQEEGIDSDDVVAKCADIQKAISEGATSFLFTEYKYLGIFMVVFGAIIFLFLGSVKSFSTESEPCTFNKEKICKPALANAFFTTIAFFLGGLTSALSGFLGMKIATYANARTTLEARKSIGKAFIIAFRSGAVMGFLLAANGLLVLYISINLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISSFGSSHDYSAMSYPLIISSMGIVVCLITTLFATDMFEIKNVTEIEPSLKRQLLISTVLMTVGIAFVSFFALPSEFTIFDFGSEKVVKNWHLFFCVSIGLWAGLVIGYTTEYYTSSAYSPVQEVADSCKTGAATNVIFGLALGYKSVIIPIFAIAASIYVSFSLAAMYGIAVAALGMLSTIATGLAIDAYGPISDNAGGIAEMAGMSHSIRERTDALDAAGNTTAAIGKGFAIGSAALVSLALFGAYVSRAGIKTVDVLSPKVFIGLLVGAMLPYWFSAMTMKSVGSAALKMVEEVRRQFNSIPGLMEGTAKPDYATCVKISTDASLKEMIPPGALVMLTPLIAGTFFGVETLAGVLAGSLVSGVQVAISASNTGGAWDNAKKYIEAGATEHARSLGPKGSDAHKAAVIGDTVGDPLKDTSGPSLNILIKLMAVESLVFAPFFATHGGLLFKLL

SEQ ID NO: 3416 - protein, 92 aa, Gossypium barbadense
MARSLKKNPFVANHLLKKIERLNTKAEKEIIITWSRASTIIPTMIGHTIAIHNGKEHLPIYITDRMVGHKLGEFAPTINFRGHAKNDNKSRR

SEQ ID NO: 3417 - protein, 92 aa, Bifidobacterium adolescentis
  strain ATCC 15703 / DSM 20083 / NCTC 11814 / E194a
MTRSIKKGPFVDAHLQKKVDEQNEKGTHNVIKTWSRRSMITPDFIGHTFAVHDGRKHVPVFVTESMVGHKLGEFAPTKTFKGHVKDDKKARR

SEQ ID NO: 3418 - protein, 72 aa, Bifidobacterium adolescentis
  strain ATCC 15703 / DSM 20083 / NCTC 11814 / E194a
MAKDGVIEVEGQVVEALPNAMFRVELENKHIVLATISGKMRKNYIRILPQDRVVLEMSPYDLNRGRITYRYK

SEQ ID NO: 3419 - protein, 62 aa, Oryza sativa
  subsp. indica
MSDKCGNCDCADKSQCVKKGTSYGVVIVEAEKSHFEEVAAGEENGGCKCGTSCSCTDCKCGK

SEQ ID NO: 3420 - protein, 244 aa, Oryza sativa
  subsp. indica
MDRYGEKQQQQQMFASYVDASLLAASGEVQGERPRARRRRRRGARCVGGGGGGGEVDGGDPKKRRLSDEQVEMLELSFREERKLETGRKVHLASELGLDPKQVAVWFQNRRARHKSKLLEEEFSKLKHAHDAAILHKCHLENEVLRLKERLVVAEEEVRRLRSAAGSHTASGEGGDIMGLGGSGACVAGSPSSSFSTGTCQPPSFGGGGGGGDHLGDDDLVYVPEYGGYADNSVVEWFSLYGLI

SEQ ID NO: 3421 - protein, 119 aa, Phaseolus vulgaris
MTRIKRGYIARKRRTKIRLFVSSFRGAHSRLTRTITQQKMKALVSAHRDRDRKKRDFRGLWISRINAVIRGNPKVSYIYSNLIHSLYTRQLLLNRKIVAQIAILKENCLFMIANNIIKT

SEQ ID NO: 3422 - protein, 92 aa, Populus trichocarpa
MTRSLKKNPFVANHLLRKINKLNTKAEKNLIVTWSRASTIIPTMIGHTIAIHNGKEHLPIYITDRMVGHKLGEFAPTLNFRGHAKNDNKSRR

SEQ ID NO: 3423 - protein, 567 aa, Sus scrofa
MHGRLKVKTSEEQAEAKRLEREQKLKLYQTATQTVFQKRQAGELDESVLELTSQILGANPDFATLWNCRREVLQRLEVQKSPEELAALVKAELGFLESCLRVNPKSYGTWHHRCWLLGRLPEPNWARELELCARFLEVDERNFHCWDYRRFVASQAAVPPAEELAFTDSLITRNFSNYSSWHYRSCLLPQLHPQPDSGPQGRLPEDVLLKELELVQNAFFTDPNDQSAWFYHRWLLGRADPQDALRCLHVSRDEACLTVSFSRPLLVGPSTETLLLMVNESPLSVEWRTPDGRNRPSHVWLCDLPAASLNDHLPQHTFRVIWTAGNAQKECVLLKGRQEGWCRDSATDEQLFRCELSVEKSTVLQSELESCKELQELEPENKWCLLTIILLMRALDPLLYEKETLQYFQTLKAVDPMRAAYLDDLRSKFLLENSVLKMEYADVRVLHLGHKDLTVLCHLEQLLLVTHLDLSHNRLRALPPALAALRCLEVLQANDNAIESLDGVTNLPRLQELSLCNNRLQQPAVLQPLASCPRLVLLNLQDNPLCQAVGISEHLAELLPSVSSILT

SEQ ID NO: 3424 - protein, 108 aa, Sus scrofa
MTAHILLLWLFASSILGDPDSAGRLTRHQVSLKSGRLCSLGTCQTHRLPEIIYWLRSASTKELSGKAGRKPQDPYSYGRRRRRRRRRREARLLRRLQDPSLRRAQLAG

SEQ ID NO: 3425 - protein, 185 aa, Lactobacillus reuteri
  strain DSM 20016
MDLKVFDGQDKSELSMIEVAHAILAHHGKAMAFVDLTNEVQQYLGKSDEEIRERLAQFYTDLNVDGSFISLGDNTWGLRAWYPFESIDEATVGENEEDEEDDRPKKKRRKVNAFLADTDDDDDVIDYDNDDPEDEDLDTDDDADSEDDYDDDTDDFSDDDDDLDDGIEGQLSELHDEEDEDEDDE

SEQ ID NO: 3426 - protein, 158 aa, Lactobacillus reuteri
  strain DSM 20016
MAKVESFTLDHTKVKAPYVRLITVEEGPKGDKISNYDLRLVQPNENAIPTAGLHTIEHLLAGLLRDRLGGVIDCSPFGCRTGFHLITWGEHSTTEVAKALKSSLEEIAYKTKWEDVQGTTIESCGNYRDHSLFSAKEWSKKILDEGISDKPFERHVVD

SEQ ID NO: 3427 - protein, 344 aa, Bubalus bubalis
MARPRHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGLVCGLDGKTYRNECALLKARCKEQPELQVQYQGKCKKTCRDVFCPGSSTCVVDQTNNAYCVTCNRICPEPTSSEQYLCGNDGVTYPSACHLRKATCLLGRSIGLAYEGKCIKAKSCDDIQCTGGKKCLWDFKVGRGRCSLCGELCPESKSEEPVCASDNATYASECAMKEAACSSGVLLEVKHSGSCNSISEDTEDEEEDEDQDYSFPISSILEW

SEQ ID NO: 3428 - protein, 582 aa, Bos taurus
MSSSLGKEKDSKEKDPKAPSAKEREKEAKASGGFGKESKEKEPKTKGKDAKDGKKDSSAAQPGVAFSVDNTIKRPNPAPGTRKKSSNAEVIKELNKCREENSMRLDLSKRSIHILPSSIKELTQLTELYLYSNKLQSLPAEVGCLVNLMTLALSENSLTSLPDSLDNLKKLRMLDLRHNKLREIPSVVYRLDSLTTLYLRFNRITTVEKDIKNLSKLSMLSIRENKIKQLPAEIGELCNLITLDVAHNQLEHLPKEIGNCTQITNLDLQHNELLDLPDTIGNLSSLSRLGLRYNRLSAIPRSLAKCSALEELNLENNNISTLPESLLSSLVKLNSLTLARNCFQLYPVGGPSQFSTIYSLNMEHNRINKIPFGIFSRAKVLSKLNMKDNQLTSLPLDFGTWTSMVELNLATNQLTKIPEDVSGLVSLEVLILSNNLLKKLPHGLGNLRKLRELDLEENKLESLPNEIAYLKDLQKLVLTNNQLTTLPRGIGHLTNLTHLGLGENLLTHLPEEIGTLENLEELYLNDNPNLHSLPFELALCSKLSIMSIENCPLSHLPPQIVAGGPSFIIQFLKMQGPYRAMV

SEQ ID NO: 3429 - protein, 131 aa, Bos taurus
MPPKGKSGSGKGGKGKAASGSESSEKKAQGPKGGGNAVKVRHILCEKHGKILEAMEKLKSGMKFNEVAAQYSEDKARQGGDLGWMTRGSMVGPFQEAAFALPISVLDKPVFTDPPVKTKFGYHIIMVEGRK

SEQ ID NO: 3430 - protein, 69 aa, Saccharomyces cerevisiae
  strain YJM789
MTVKICDCEGECCKDSCHCGSTCLPSCSGGEKCKCDHSTGSPQCKSCGEKCKCETTCTCEKSKCNCEKC

SEQ ID NO: 3431 - protein, 271 aa, Saccharomyces cerevisiae
  strain YJM789
MGLAATRTKQRFGLDPRNTAWSNDTSRFGHQFLEKFGWKPGMGLGLYPMNSNTSHIKVSIKDDNVGLGAKLKRKDKKDEFDNGECAGLDVFQRILGRLNGKESKISEELDTQRKQKIIDGKWGIHFVKGEVLASTWDPKTHKLRNYSNAKKRKREGDDSEDEDDDDKEDKDSDKKKHKKHKKHKKDKKKDKKDKKEHKKHKKEEKRLKKEKRAEKTKETKKTSKLKSSESASNIPDAVNTRLSVRSKWIKQKRAALMDSKALNEIFMITND

SEQ ID NO: 3432 - protein, 93 aa, Ipomoea purpurea
MARSLKKNPFVANHLLKKIDKLNRKAEKEIIRTWSRGSTIIPTMIGHTIAIHNGKEHLPIYITDHMVGHKLGEFASTFNFRGHTKSDNKSRRR

SEQ ID NO: 3433 - protein, 166 aa, Bos taurus
MSAPPPLQIREANAHLAAVHRRAAELEARLEAAECMVRAQAERLARHDQQLSAALDELGRAKDREIAALREQLLTSEAAVQSLQAAVRQRDKLIGQLQPRAELLQDLCRRRPPLAGLLATLAEAERLGPLPASDLLPGGPSSPLANSTGEEEGSDQLEPAVFGTTV

SEQ ID NO: 3434 - protein, 117 aa, Carica papaya
MTRIKRGYIARRRRTKIRLFASSFRGAHSRLTRTITQQRIRALVSAHRDRGRKKRDFRRLWITRINAVIRGDGVSYSYNRFIHNLYKKQLLLNRKILAQIAISNRSCLYTISNEIRK

SEQ ID NO: 3435 - protein, 37 aa, Carica papaya
MKIRASVRKICEKCRLIRRRGRIIVICSNPRHKQRQG

SEQ ID NO: 3436 - protein, 131 aa, Lactobacillus reuteri
  strain JCM 1112
MKKTGIINSEVSAVVANMGHMDWLSIGDAGMPVPFGTKKIDLAVDKELPSFMDVLNNVLKEMKVQKIYLAEEIKDQNPAQLENIKKALPDVEVAFMPHSELKKSLTKTHAFIRTGEMTPYSNIILESGVTF

SEQ ID NO: 3437 - protein, 73 aa, Lactobacillus reuteri
  strain JCM 1112
MRMSFYQFLMTQRNPNSADEVQQFANNAFFDTTFPKHSEDFDEISHYLEENADYLPSMTIFDEAWQRYIDAMN

SEQ ID NO: 3438 - protein, 106 aa, Lactobacillus casei
  strain BL23
MANNEHVTPGEDDQQITLIDEKGNEELYQVLFTFDSEDYGKSYVLLYPASESDDQEVEIQAFSFTPDENGDASSGDLFPIEDDAEWDMVEEVLNTFLADDDSNLKD

SEQ ID NO: 3439 - protein, 333 aa, Salmo salar
MNDTLALLQKFNAHPDSRCWYVAWNPKGTLLASCGGDRTIRIWGREGDSWECKTVLQDGHQRTVRKVAWSPCGNYLASASFDATTCIWKKKNDDFECLTVLEGHENEVKCVAWAPSGNLLATCSRDKSVWIWEVDEENEYECVSVVNSHTQDVKHVVWHPTQELLASCSYDNNVCVYKEEDDDWECRATLEGHTSTVWGLTFDPSGQRLASCSDDCTVKIWKECQPEGGQEGTDAAWKCVCTLSGFHGRTVYDIAWCPLTGALATACGDDGVRVFKEDETADPDQPAFSLSAHVPKAHTQDVNCIAWHPKEAGLLVSCSDNGEIAVWNYQSGV

SEQ ID NO: 3440 - protein, 330 aa, Salmo salar
MKDTLALLQKFNAHPDSRCWYVAWNPKGTLLASCGGDRAIRIWGREGDSWECKTVLQDGHQRAVRKVAWSPCGNYLASASFDATTCIWKKKNDDFECLTVLEGHENEVKCVAWAPSGNQLATCSRDKSVWIWEVDEEDEYECVSVVNSHTQDVKHVVWHPTQELLASCSYDNNVCVYKEEDDDWECRATLEGHTSTVWGLTFDPSGQRLASCSDDRTVKIWKECQPGGGQDTAWKCVCTLSGFHGRTVYDIAWCPLTGALATACGDDGVRVFKEDETADPDQPVFSLSAHVPKAHSQDVNCIAWHPKEAGLLVSCSDNGEIAVWNYQSEV

SEQ ID NO: 3441 - protein, 61 aa, Bifidobacterium longum
  subsp. infantis
  strain ATCC 15697 / DSM 20088 / JCM 1222 / NCTC 11817 / S12
MAKNLKITLHHGIVNRTPAQRATVKTLGLNKIGKTVVREDTPANRGLVNAVRHLVTVEEVD

SEQ ID NO: 3442 - protein, 92 aa, Bifidobacterium longum
  subsp. infantis
  strain ATCC 15697 / DSM 20088 / JCM 1222 / NCTC 11817 / S12
MTRSIKKGPFVDAHLQKKVDEQNEKGTKNVIKTWSRRSMITPDFIGHTFAVHDGRKHVPVFVTEAMVGHKLGEFAPTKTFKGHVKDDKKARR

SEQ ID NO: 3443 - protein, 92 aa, Bifidobacterium animalis
  subsp. lactis
  strain AD011
MTRSIKKGPFVDAHLQKKVDEQNAKGTHNVIKTWSRRSMITPDFIGHTFAVHDGRKHVPVFVTESMVGHKLGEFAPTRTFKGHVKDDKKSRR

SEQ ID NO: 3444 - protein, 563 aa, Bos taurus; identical to SEQ ID NO: 751

SEQ ID NO: 3445 - protein, 360 aa, Saccharomyces cerevisiae; identical to SEQ ID NO: 734
  strain FostersB

SEQ ID NO: 3446 - protein, 446 aa, Bos taurus; identical to SEQ ID NO: 750

SEQ ID NO: 3447 - protein, 559 aa, Bos taurus; identical to SEQ ID NO: 761

SEQ ID NO: 3448 - protein, 441 aa, Sus scrofa; identical to SEQ ID NO: 731

SEQ ID NO: 3449 - protein, 591 aa, Meleagris gallopavo; identical to SEQ ID NO: 781

SEQ ID NO: 3450 - protein, 616 aa, Bos taurus; identical to SEQ ID NO: 776

SEQ ID NO: 3451 - protein, 264 aa, Sus scrofa; identical to SEQ ID NO: 746

SEQ ID NO: 3452 - protein, 132 aa, Oryza sativa
  subsp. japonica
MVVLQPDPFLSELTSMYERSTEKGSVWVTMKRSSMKCQARLKKMAAKGEAVEYRCLVRATDGKKNICTALSAKEYLKFQASYATVLKAHMHALKKRERKDKKKAAEVEKIPEKAPKKQKKAPSSKKSAGSKS

SEQ ID NO: 3453 - protein, 172 aa, Gallus gallus
MSSNECFKCGRTGHWARECPTGIGRGRGMRSRGRAGFQFMSSSLPDICYRCGESGHLAKDCDLQEDKACYNCGRGGHIAKDCKEPKREREQCCYNCGKPGHLARDCDHADEQKCYSCGEFGHIQKDCTKVKCYRCGETGHVAINCSKTSEVNCYRCGESGHLARECTIEATA

SEQ ID NO: 3454 - protein, 344 aa, Equus caballus
MVRPRHQPGGLCLLLLLLCQFMEDRSAQAGNCWLRQAKNGRCQVLYKTELSKEECCSTGRLSTSWTEEDVNDNTLFKWMIFNGGAPNCIPCKETCDNVDCGPGKKCRMNKKNKPRCVCAPDCSNITWKGPVCGLDGKTYRNECALLKARCKEQPELEVQYQGKCKKTCRDVNCPGSSTCVVDQTNNAYCVTCNRICPEPTSSEQYLCGNDGVTYSSACHLRKATCLLGRSIGLAYEGKCIKAKSCEDIQCTGGKKCLWDFKVGRGRCSLCDELCPDSKSEEPVCASDNATYASECAMKEAACSSGVLLEVKHSGSCNSISEDTEEEEEDEDQDYSFPISSILEW

SEQ ID NO: 3455 - protein, 147 aa, Saccharomyces cerevisiae
  strain ATCC 204508 / S288c
MGMLELVGEYWEQLKITVVPVVAAAEDDDNEQHEEKAAEGEEKEEENGDEDEDEDEDEDDDDDDDEDEEEEEEVTDQLEDLREHFKNTEEGKALVHHYEECAERVKIQQQQPGYADLEHKEDCVEEFFHLQHYLDTATAPRLFDKLK

SEQ ID NO: 3456 - protein, 90 aa, Bos taurus [sequence omitted]

SEQ ID NO: 3457 - protein, 90 aa, Gallus gallus
MPKRKAEGDTKGDKAKVKDEPQRRSARLSAKPAPPKPEPKPKKAAPKKSEKVPKGKKGKADAGKEGNNPAENGDAKTDQAQKAEGAGDAK

SEQ ID NO: 3458 - protein, 169 aa, Bos taurus
AAQKRPSQRSKYLASASTMDHARHGFLPRHRDTGILDSLGRFFGSDRGAPKRGSGKDGHHAARTTHYGSLPQKAQGHRPQDENPVVHFFKNIVTPRTPPPSQGKGRGLSLSRFSWGAEGQKPGFGYGGRASDYKSAHKGLKGHDAQGTLSKIFKLGGRDSRSGSPMARR

SEQ ID NO: 3459 - protein, 50 aa, Sus scrofa
MARYRCCRSHSRSRCRPRRRRCRRRRRRCCPRRRRAVCCRRYTVIRCRRC

SEQ ID NO: 3460 - protein, 155 aa, Bos taurus
MYKIQLLSCIALTLALVANGAPTSSSTGNTMKEVKSLLLDLQLLLEKVKNPENLKLSRMHTFDFYVPKVNATELKHLKCLLEELKLLEEVLNLAPSKNLNPREIKDSMDNIKRIVLELQGSETRFTCEYDDATVNAVEFLNKWITFCQSIYSTMT

SEQ ID NO: 3461 - protein, 176 aa, Saccharomyces cerevisiae
  strain ATCC 204508 / S288c
MTAQQAPKWYPSEDVAAPKKTRKAVRPQKLRASLVPGTVLILLAGRFRGKRVVYLKHLEDNTLLVTGPFKVNGVPLRRVNARYVIATSTKVSVEGVNVEKFNVEYFAKEKLTKKEKKEANLFPEQQTKEIKTERVEDQKVVDKALLAEIKKTPLLKQYLSASFSLKNGDKPHLLKF

SEQ ID NO: 3462 - protein, 87 aa, Bos taurus
MSQAEFDKAAEEVKHLKTKPADEEMLFIYSHYKQATVGDINTERPGMLDFKGKAKWDAWNELKGTSKEDAMKAYIDKVEELKKKYGI

SEQ ID NO: 3463 - protein, 116 aa, Triticum aestivum
MSYISGARSLPDEQVRIASTKMDGIGPKKAIQLRYRLGISGNIKMNELTKYQIDQIEQMIAQDHVVHWELKRGERADIERLISISRYRGIRHQDGSPLRGQRTHTNARTARKQIRK

SEQ ID NO: 3464 - protein, 102 aa, Zea mays
MQMVQLQIRVKMIWLLFMNHNHNHNHNQNHNHSHNLNPKKKHHRRGQRSAHRMYGSISPRRKLKWRSMERNTFRYGDIATFLIARLSIGLRVIMEQADFEIT

SEQ ID NO: 3465 - protein, 85 aa, Saccharomyces cerevisiae
  strain ATCC 204508 / S288c
MAEKQRQLKLQKIYKQKYIGLGDESTTREQWQRNVRNDTLNTLQGHSASLEYVSLSRGDLSIRDTRIHLLKSMSPGYKAYLREER

SEQ ID NO: 3466 - protein, 108 aa, Saccharomyces cerevisiae
  strain ATCC 204508 / S288c
MPPKQQLSKAAKAAAALAGGKKSKKKWSKKSMKDRAQHAVILDQEKYDRILKEVPTYRYVSVSVLVDRLKIGGSLARIALRHLEKEGIIKPISKHSKQAIYTRAAASE

SEQ ID NO: 3467 - protein, 59 aa, Oryza sativa
  subsp. indica
MAVPKKRTSMSKKRIRKNLWKKKTYFSIVQSYSLAKSRSFSGVSEHPKPKGFSRQQTNK

SEQ ID NO: 3468 - protein, 53 aa, Saccharomyces cerevisiae
  strain ATCC 204508 / S288c
MRNLHHLRVGHEAHSTHHLWMWKHLRRRAISELRILRNFIRKCIRGGVFLWII

SEQ ID NO: 3469 - protein, 82 aa, Saccharomyces cerevisiae
  strain ATCC 204508 / S288c
MFWEKLEKVSNIMIEKKLVNLDGTSANEENTMKPWQMIKILMDRDLRHAMKEFKLELEKSGIQLGPEQLAPLMTVLGLEKKK

SEQ ID NO: 3470 - protein, 344 aa, Sus scrofa
MVRPKHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELEVQYQGKCKKTCRDVFCPGSSTCVVDQTNNAYCVTCNRICPEPTSSEQYLCGNDGVTYSSACHLRKATCLLGRSIGLAYEGKCIKAKSCEDIQCTGGKKCLWDFKVGRGRCSLCDELCPESKSEEPVCASDNATYASECAMKEAACSSGVLLEVKHSGSCNSISEDTEEEEEDEDQDYSFPISSILEW

SEQ ID NO: 3471 - protein, 105 aa, Gallus gallus
MPKRKAPAEGEAKEEPKRRSARLSAKPAPPKPEPKPKKAAPKKEKAANDKKEDKKAATKGKKGAKGKDETKQEDAKEENHSENGDTKTNEAPAAEASDDKEAKSE

SEQ ID NO: 3472 - protein, 103 aa, Bos taurus
HPVGGPGPVSELPGLQELLDRLRDRVSELQAEQLRVEPLQQGQGLEETWDSPAAAPAGFLGPHHSILRALRGPKMMRDSGCFGRRLDRIGSLSGLGCNVLRRY

SEQ ID NO: 3473 - protein, 57 aa, Coturnix japonica
MARYRRTRTRSRSRRRRRSRRRRSSRRRRYGRSRRSYRSVGRRRRRYGRRRRRRRRY

SEQ ID NO: 3474 - protein, 174 aa, Gallus gallus
MASQKRSSFRHGSKMASASTTDHARHGSPRHRDSGLLDSLGRFFGGDRHVPRRGFGKDIHAARASHVGSIPQRSQHGRPGDDNPVVHFFKNIVSPRTPPPMQAKGRGLSLTRFSWGGEGHKPGYGSGKFYEHKSAHKGHKGSYHEGQGTLSKIFKLGGSGSRPGSRSGSPVARR

SEQ ID NO: 3475 - protein, 155 aa, Ovis aries
MYKIQLLSCIALTLALVANGAPTSSSTGNTMKEVKSLLLDLQLLLEKVKNPENLKLSRMHTFNFYMPKVNATELKHLKCLLEELKLLEEVLDLAPSKNLNTREIKDSMDNIKRIVLELQGSETRFTCEYDDATVKAVEFLNKWITFCQSIYSTMT

SEQ ID NO: 3476 - protein, 130 aa, Glycine max
MTRIKRGYIARKRRTKIRLFTSSFRGAHSRLTRTITQQKIKALVSAHRDRDRKKRDFRGLWISRINAVIRGNIKVYYIYSNLVYSLYTGQLLLNRKIVAQIAILKQNCLFMIANDIIKTKNPLRLYSGKV

SEQ ID NO: 3477 - protein, 47 aa, Triticum aestivum
KICRRRSAGFKGPCMSNKNCAQVCQQEGWGGGNCDGPFRRCKCIRQC

SEQ ID NO: 3478 - protein, 47 aa, Triticum aestivum
KVCRQRSAGFKGPCVSDKNCAQVCLQEGWGGGNCDGPFRRCKCIRQC

SEQ ID NO: 3479 - protein, 116 aa, Bos taurus
MAGLLKKTTGLVGLAVCETPHERLKILYTKILDVLGHIPKNAAYRKYTEQITNEKLSMVKAEPDVKKLEERLQGGQIEEVILQAENELSLARKMIQWKPWEPLVEEPPASQWKWPI

SEQ ID NO: 3480 - protein, 142 aa, Gallus gallus
MQPRGLLLLLALLLLAAAAEAAKAKKEKMKKEGSECQDWHWGPCIPNSKDCGLGYREGSCGDESRKLKCKIPCNWKKKFGADCKYKFESWGGCSAKTGVKTRSGILKKALYNAECEEVVYVSKPCTAKMKAKAKAKKGKGKD

SEQ ID NO: 3481 - protein, 215 aa, Saccharomyces cerevisiae
  strain ATCC 204508 / S288c
MSCTTDKLIQKYDALVRKTTEHKFAKELCAGTLKDRSLYIYLSQDLQFFETSLRLICKTTSLAPTTHALITLAKKIGFFSNDENSYFHDCLELLAPSLTKEERDNFDNKAIPGVDAYINFLDELRKDASITWPSLVTSLWVAEELYWRWARDTPRAPGLHWKYQKWIDLHDGEHFQTWCEFLKAEVDKFPVEEVESIFVKVSQFEFEFFESCYNA

SEQ ID NO: 3482 - protein, 258 aa, Salmo salar
MKFLVLALTILLAAGTQAFPMQADAPSQLEHVKAALNMYIAQVKLTAQRSIDLLDDTEYKEYKMQLSQSLDNLQQFADSTSKSWPPTPRSSAPSCDATATVRAEVMKDVEDVRTQLEPKRAELTEVLNKHIDEYRKKLEPLIKQHIELRRTEMDAFRAKIDPVVEEMRAKVAVNVEETKTKLMPIVEIVRAKLTERLEELRTLAAPYAEEYKEQMFKAVGEVREKVAPLSEDFKARWAPPPRRPSKSSWLSTRPSARP

SEQ ID NO: 3483 - protein, 154 aa, Phoca sibirica
MGLSDGEWHLVLNVWGKWETDLAGHGQEVLIRLFKSHPETLEKFDKFKHLKSEDDMRRSFDLRKHGNTVLTALGGILKKKGHHEAELKPLAQSHATKHKIPIKYLEFISEAIIHVLHSKHPAEFGADAQAAMKKALELFRNDIAAKIKELGFHG

SEQ ID NO: 3484 - protein, 92 aa, Pisum sativum
MTRSRKKNPFVANHLLKKIKKLNTKGEKAIIKTWSRKSTIIPIMIGHTIAIHNGKEHLPVYITDRMVGHKLGEFSPTLNFGGFAKNDNKSRR

SEQ ID NO: 3485 - protein, 222 aa, Spinacia oleracea
MANMLVASSSKTLPTTTTTTITPKPKFPLLKTPLLKLSPPQLPPLKHLNLSVLKSAAITATPLTLSFLLPYPSLAEEIEKASLFDFNLTLPIIMAEFLFLMFALDKIYYTPLGDFMDKRDASIKEQLSGVKDTSSEVKQLEEQANAVMRAARAEISAALNKMKKETQLEVEAKLAEGRKKIEVELQEALGSLEQQKEDTIKSLDSQISALSDDIVKKVLPVS

SEQ ID NO: 3486 - protein, 92 aa, Gallus gallus
MAKRTKKVGIVGKYGTRYGASLRKMVKKIEISQHAKYTCSFCGKTKMKRKAVGIWHCGSCMKTVAGGAWTYNTTSAVTVKSAIRRLKELKDQ

SEQ ID NO: 3487 - protein, 111 aa, Saccharomyces cerevisiae
  strain ATCC 204508 / S288c
MLGRALRPGWLGITRTVVKKPSCGSYFNRTFQTAINTTMPPMQEGMLSTMMMMTATATRITGTVSEPLNGSNIVMQLDSVMRKRKKKMKKHKLRKRRKREKAERRKLSQGR

SEQ ID NO: 3488 - protein, 121 aa, Saccharomyces cerevisiae
  strain ATCC 204508 / S288c
MSNQALYEKLEQTRTILSVKLAELINMTTIADRNDDDEGSFAQENSELAVATTSVMMVNNQTMQLIKNVQDLLILTRSIKEKWLLNQIPVTEHSKVTRFDEKQIEELLDNCIETFVAEKTT

SEQ ID NO: 3489 - protein, 136 aa, Gallus gallus
  MOD_RES (121)..(121): Any amino acid
GKKEKPEKKAKKSDCGEWQWSVCVPTNGDCGLGTREGTRTGAECKQTTKTQKCKIPCNWKKQFGAECKYQFQAWGECDLNTALKTRTGNLKRALHNADCQKTVTISKPCGKLTKPKPQZEXKKKKKEGKKQEKMLB

SEQ ID NO: 3490 - protein, 386 aa, Saccharomyces cerevisiae
  strain ATCC 204508 / S288c
MKVISLKKDSFNKGGAVITLLPEDKEDLFTVYQIVDKDDELIFKKKFTSKLDEAGKKKSTDLVKLKIKVISEDFDMKDEYLKYKGVTVTDESGASNVDIPVGKYLSFTLDYVYPFTIIKQNFNKFMQKLLNEACNIEYKSDTAAVVLQEGIAHVCLVTSSSTILKQKIEYSMPKKKRTTDVLKFDEKTEKFYKAIYSAMKKDLNFDKLKTIILCSPGFYAKILMDKIFQYAEEEHNKKILDNKGMFFIAHCSTGYLQGINEVLKNPLYASKLQDTKYSKEIMVMDEFLLHLNKDDDKAWYGEKEVVKAAEYGAISYLLLTDKVLHSDNIAQREEYLKLMDSVESNGGKALVLSTLHSLGEELDQLTGIACILKYPLPDLDEDDGEE

SEQ ID NO: 3491 - protein, 338 aa, Saccharomyces cerevisiae
  strain ATCC 204508 / S288c
MDKNSVNKDSEEKDERHKIEVVDDTNPDFITADSELTQDLPDDVEVIDLVHLKIKSLEDLNLYRFKNLKQLCLRQNLIESISEVEVLPHDKIVDLDFYDNKIKHISSNVNKLTKLTSLDLSFNKIKHIKNLENLTDLENLYFVQNSISKIENLSTLKSLKNLELGGNKVHSIEPDSFEGLSNLEEIWLGKNSIPRLINLHPLKNLKILSIQSNKLKKIENLEELTNLEELYLSHNFITKIEGLEKNLKLTTLDVTSNKITSLENLNHLSNLTDIWASFNKIDQSFESLGENLSALSRLETIYLEGNPIQLENKTSYRRKLTMNLPPSLQKIDATYIRG

SEQ ID NO: 3492 - protein, 126 aa, Saccharomyces cerevisiae
  strain ATCC 204508 / S288c
MKESLLTLTEKIMFTTTVLKPTITTPITMLITTMRTLVAMKIRHYWKMMAIKDRKIQIPPVKYQMELSIRTLEINLLKNVKETEANLLKRRTDRENKRHYEFGFFYNLRIHNIYIPTSFFFFNSIV

SEQ ID NO: 3493 - protein, 55 aa, Solanum lycopersicum
MAVPKKRTSTSKKRIRKNIWKRKGYWVALKAFSLAKSLSTGNSKSFFVRQTKINK

SEQ ID NO: 3494 - protein, 155 aa, Capra hircus
MYRMQLLSCIALTLALVANGAPTSSSTGNTMKEVKSLLLDLQLLLEKVKNLENLKLSRMHTFNFYMPKVNDTELKHLKCLLEELKLLEDVLDLAPSKNRNTREIKDYMASLKGIVLELQGSETRFTCEYDDATVKAVEFQNKWTTFCQSIYSTLT

SEQ ID NO: 3495 - protein, 68 aa, Equus caballus
MDPETCPCPTGGSCTCSGECKCEGCKCTSCKKSCCSCCPAECEKCAKDCVCKGGEGAEAEAEKCSCCQ

SEQ ID NO: 3496 - protein, 106 aa, Saccharomyces cerevisiae
  strain ATCC 204508 / S288c
MAKSLRASSHLNAKSVKRRGVFQKAVDAREQRISDKLKEDLLKQKLEDLKKKEEQGIDMDVDEKKSNEEAPRKKISTSGWRDGRHHTYKKAKLMKQSKKKTSFTRF

SEQ ID NO: 3497 - protein, 187 aa, Saccharomyces cerevisiae
  strain ATCC 204508 / S288c
MSVSLEQTLGFRIKVTNVLDVVTEGRLYSFNSSNNTLTIQTTKKNQSPQNFKVIKCTFIKHLEVIGDKPSFNSFKKQQIKPSYVNVERVEKLLKESVIASKKKELLRGKGVSAEGQFIFDQIFKTIGDTKWVAKDIIILDDVKVQPPYKVEDIKVLHEGSNQSITLIQRIVERSWEQLEQDDGRKGG

SEQ ID NO: 3498 - protein, 125 aa, Saccharomyces cerevisiae
  strain ATCC 204508 / S288c
MPSKDPESVIDKEIRKISARNDELIKQDGTLKREYTTLLRKVSSVITVLNSIDDADTGSAETELPRLISQATVEKVPELKWYNDQISLITEKLEDDEDIEVPEELMDAYTLYKETPLLYNDTHTP

SEQ ID NO: 3499 - protein, 109 aa, Saccharomyces cerevisiae
  strain ATCC 204508 / S288c
MRFLPRKSRLLMSMRDFYYGLKKLHFCSFPNDIRPPHKKTFLLHSIRSIEAVFGTSDFIKLLGANSTFRLNKLECVENLSSILKKVFALSVINRKLKHLPKATSLPYEK

SEQ ID NO: 3500 - protein, 296 aa, Saccharomyces cerevisiae
  strain ATCC 204508 / S288c
MDYFNIKQNYYTGNFVQCLQEIEKFSKVTDNTLLFYKAKTLLALGQYQSQDPTSKLGKVLDLYVQFLDTKNIEELENLLKDKQNSPYELYLLATAQAILGDLDKSLETCVEGIDNDEAEGTTELLLLAIEVALLNNNVSTASTIFDNYTNAIEDTVSGDNEMILNLAESYIKFATNKETATSNFYYYEELSQTFPTWKTQLGLLNLHLQQRNIAEAQGIVELLLSDYYSVEQKENAVLYKPTFLANQITLALMQGLDTEDLTNQLVKLDHEHAFIKHHQEIDAKFDELVRKYDTSN

SEQ ID NO: 3501 - protein, 144 aa, Ipomoea nil
MKGGKSKAKSDNKLAVKKQAADTKKTKKAVKDPNKPKRPPSAFFVFMEDFRKTYKEKHPNNKSVAVVGKAGGDKWKQLTAAEKAPFISKAEKRKQEYEKNLQAYNKKQAAGAAEEEESDKSRSEVNDDDEDQDGSGEDDSEDDD

SEQ ID NO: 3502 - protein, 149 aa, Vicia faba
MKGGKSKGESKKAETKLAVNKKGAAATKGGKKPAKGKEPKDPNKPKRPPSAFFVFMADFREQYKKDHPNNKSVAAVGKACGEEWKSLSEEEKAPYVDRALKKKEEYEITLQAYNKKLEGKDDEEGSDKSKSEVNDEDEDEEDEEDEDDD

SEQ ID NO: 3503 - protein, 88 aa, Pinus thunbergii
MINNLSISSSLIPDKQRGSVESQVFYLTNRVLRLTQHLQLHGRDYSSQRGLWKILSKRKQLLVYLSKRDKLRYDDLIGQLGIRGLKTR

SEQ ID NO: 3504 - protein, 63 aa, Actinidia deliciosa
MSDKCGNCDCADSSQCVKKGNSIDIVETDKSYIEDVVMGVPAAESGGKCKCGTSCPCVNCTCD

SEQ ID NO: 3505 - protein, 296 aa, Saccharomyces cerevisiae
  strain ATCC 204508 / S288c
MDSLEARLQFIQVLKNLQKTLHKTRDSITSSSTTTPPSSQQKLNNDPIQFYLRNYRHHYEDFHQCLFDTTMKMDPLDRLDVVIYYVRIIRNLYPHSHSNTNVTKVLNEVLLMDIDLVFELCLPCQDWKSLTNQATCKELFLDLSKLIHYDATSVTHTPSDTTLIDATTWYSVKTERTTKDYKESLQRTESLLKDRDLKKLAFFQQFNSDTTAINPDLQTQPTNANILLHRMEADRELHKRSKETSWYIERPSNDILDESEFKSLWTHFETTDSGFDKDDYKNIKALNDIAKASYIY

SEQ ID NO: 3506 - protein, 109 aa, Saccharomyces cerevisiae
  strain ATCC 204508 / S288c
MSQIAQEMTVSLRNARTQLDMVNQQLAYLDRQEKLAELTKKELESYPTDKVWRSCGKSFILQDKSKYVNDLSHAETVLLDQRKTLKIKKNYLETTVEKTIDNLKALMKN

SEQ ID NO: 3507 - protein, 663 aa, Saccharomyces cerevisiae
  strain ATCC 204508 / S288c
MPFQDYFQKKKAAFINRNNKSNADASALRDINDININFAAKSKNYVFPLTKLPDELMQEVFSHLPQPDRLQLCLVNKRLNKIATKLLYRRIYLNDSNVVKSDFMHLAINWTLLNLPSSLKEEESRDIANCKLKKLIETLQNNIHITEVIQWIRINWDLDSTLQRSILSILCNQGKSLQRLENVTDPACNDIISNGHFSRSNVSSFDMAPPNSLPEMVVPENYIPNLTKYLSQRISSRLSHMTLFIDPLKLFNYLYPLDIKLQIIDLKLHWRREFYNNDYFVKKIRPGNPLTKLSEVFDKRTLKILTIISWNDTLLKRETEMLKDFKEFENLEDLSLISIKQDVHILVDLFSSLTNLKRLKMDFLEEYVPEPTNPHIFLSILLACSKLQFIDLRYDGLIPQIINIQENKFQLNQQCNCTNCQIVFSDILKGKIFMFPEDYYIHDLQDIAAKDIFKMMKYLSLLPYSKACDAYPSVRTQPMNLTNFVTKMNRNLLEYRNSKSQLVPKIVNNPHQHSTVTSTSTAHMSEPEMIIIDDDDDDDEINAAIPPSSDDTAATISTDLELPHESLTKRDIIMCYHALIHHFKSIYVTFLKSFPHLRFLMLNDIPTIVMEENNERIFEPVFYHYDYKSNLYGWSKESNKNLENDSNNNNNNSDTIARIATVM

SEQ ID NO: 3508 - protein, 144 aa, Triticum aestivum
MPKNKGKGGKNRKRGKNEADDDKRELVFKEDGQEYAQVTRMLGNGRCEAICVDGTKRLCHIRGKMHKKVWIAAGDIVLVGLRDYQDDKADVILKYMNDEARLLKAYGELPDTVRLNEGVDVDGPEEGEGDSDYIQFEDEDIDKI

SEQ ID NO: 3509 - protein, 344 aa, Bos taurus
MARPRHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELQVQYQGKCKKTCRDVFCPGSSTCVVDQTNNAYCVTCNRICPEPTSSEQYLCGNDGVTYPSACHLRKATCLLGRSIGLAYEGKCIKAKSCDDIQCTGGKKCLWDFKVGRGRCSLCGELCPESKSEEPVCASDNATYASECAMKEAACSSGVLLEVKHSGSCNSISEDTEDEEEDEDQDYSFPISSILEW

SEQ ID NO: 3510 - protein, 417 aa, Saccharomyces cerevisiae
  strain ATCC 204508 / S288c
MDEVLPLFRDSHIPQIKDYQLELQNDLTKTNEAFQKNLLKNYNKILSLTDSVNDLSLNLKNVDQDFKSLCFNDEKFQLNKLTPLPYQTTTHISPPRDEEKVSIPSQNILVISNWTISINNFCNRIVTSTTPSRIFDELLLNFHELSLIPVPSKFEALVKDKCCRLQKFLVDSMKTLNLTLLQWVKLYNLLNTEFSSKWDDDLLSIFNESLFETLFNDNVQALLISSANSKDHQYHSNQQYKDAIVVDFVNSSTFRDHLIRRTVKEINTHLDTLSTLRAKLKEPETLHKLDIFHDNDTNLNDGTVSPLDDDALKQYIDTAVFYSKGLTNDTTLQIYQTVQPTIEILQNLELYKCPQETLTDLRNKLITQLQEFKTQISSRLPSPLENSTSVVDDFITSYNNHNLLQLVIDQITQLRQQ

SEQ ID NO: 3511 - protein, 271 aa, Saccharomyces cerevisiae
  strain ATCC 204508 / S288c
MGLAATRTKQRFGLDPRNTAWSNDTSRFGHQFLEKFGWKPGMGLGLSPMNSNTSHIKVSIKDDNVGLGAKLKRKDKKDEFDNGECAGLDVFQRILGRLNGKESKISEELDTQRKQKIIDGKWGIHFVKGEVLASTWDPKTHKLRNYSNAKKRKREGDDSEDEDDDDKEDKDSDKKKHKKHKKHKKDKKKDKKDKKEHKKHKKEEKRLKKEKRAEKTKETKKTSKLKSSESASNIPDAVNTRLSVRSKWIKQKRAALMDSKALNEIFMITND

SEQ ID NO: 3512 - protein, 189 aa, Saccharomyces cerevisiae
  strain ATCC 204508 / S288c
MLEAKMVMVVPTIEDQAMIVLHPKILSQSVVMHIKGQNYQLDLVKVKHIMIEVGHLDPQVRTGAMVLIKGITAYVKSIRKTVHNVHNYGFLKSHFKRAKTAAKPTLTKLHLTSATRLQKMKKSRIKDSRRMKQLETNFKRKIIEIHEIAVLPIEPMKIKGTTEIERAILRRFRKVPRVGITSVGTRGNY

SEQ ID NO: 3513 - protein, 246 aa, Saccharomyces cerevisiae
  strain ATCC 204508 / S288c
MESIFGGFGDLVVPRPKEHLGQTDLSFGGKLLPALKICEDGGESGCGGKVWIAGELLCEYILEKSVDHLLSKTVNGTKQFKKVLELGSGTGLVGLCVGLLEKNTFHDGTKVYVTDIDKLIPLLKRNIELDEVQYEVLARELWWGEPLSADFSPQEGAMQANNVDLVLAADCVYLEEAFPLLEKTLLDLTHCINPPVILMAYKKRRKADKHFFNKIKRNFDVLEITDFSKFEHYLKERTHLFQLIRK

SEQ ID NO: 3514 - protein, 68 aa, Sus scrofa
MDPETCPCPTGGSCTCAGSCKCEGCKCTSCKKSCCSCCPAECEKCAKDCVCKGGEGAEAEEEKCSCCQ

SEQ ID NO: 3515 - protein, 93 aa, Triticum aestivum
MTRKKTNPFVAHHLLAKIEKVNMKEEKETIVTWSRASSILPTMVGHTIAIHNGKEHIPIYITNPMVGRKLGEFVPTRHFTSYENARKDTKSRR

SEQ ID NO: 3516 - protein, 298 aa, Lactobacillus johnsonii
MNKTWKKAATVLAFAGIALSATACSGGKAVVTYKGGKITESQYYDKMKESQAGQSTLASMIVSDALESQYGKDVTQKQVDKEYNKYKKQYGSQFDSVLEQNGMTASTFKDNLKTNLLTEAALKHIKKITPAQEKKAWKNYQPEVTVQHILVSKKSTAEDVIKQLQDGGDFKKLAKKYSTDTATKNDAGKLPAFDSTDSTLDSSFKTAAFKLKTGEITTTPVKTQYGYHVIKMIKHPAKGTFKEHKKQIDNQIYQSMSEDQNVMRSVIATVLKRADVSIKDKDLKNVLSQYVSSDSLSK

SEQ ID NO: 3517 - protein, 52 aa, Brassica rapa
MAVPKKRTSISKKRIRKKIWKRKGYWTSLKAFSLGKSLSTGNSKSFFVQQNK

SEQ ID NO: 3518 - protein, 154 aa, Phoca vitulina
MGLSDGEWHLVLNVWGKVETDLAGHGQEVLIRLFKSHPETLEKFDKFKHLKSEDDMRRSEDLRKHGNTVLTALGGILKKKGHHEAELKPLAQSHATKHKIPIKYLEFISEAIIHVLHSKHPAEFGADAQAAMKKALELFRNDIAAKYKELGFHG

SEQ ID NO: 3519 - protein, 180 aa, Lactobacillus plantarum
MAREVVDAMTMRRALTRITYEIIEQNKGVGNLVFIGIKTRGIFLAQRLAQRLKQLEGVDVPVGSLDITLYRDDHHAVDVAGQAKLNGADIPVDINGKHVILVDDVLFTGRTVRAALDALMDHGRPAKISLAVLVDRGHRELPIRPDFIGKNIPTALDEQVSVALEEHDGHDGISIEKLEE

SEQ ID NO: 3520 - protein, 90 aa, Sus scrofa
MPKRKAEGDAKGDKAKVKDEPQRRSARLSAKPAPPKPEPKPKKAPAKKGEKVPKGKKGKADAGKDGNNPAENGDAKTDQAQKAEGAGDAK

SEQ ID NO: 3521 - protein, 97 aa, Zea mays
EVASDDVAAEEAAAAPKIGRRVRVTAPLRVYHVLKAPDLDIQGMEGVVKQYVCVWKGKRVTANFPFKVEFELAVEGQPKPVRFFAHLREDEFEFVDG

SEQ ID NO: 3522 - protein, 171 aa, Sus scrofa
ASQKRPSQRHGSKYLASASTMDHARHGFLPRHRDTGIDSLGRFFGADRGAPKRGSGKDGHHAARTTHYGSLPQKAQHGRPQDENPVVHFFKNIVTPRTPPPSQGKGRGLSLSRFSWGAEGQKPGFGYGGRAPDYKPAHKGLKGAQDAQGTLSKIFKLGGRDSRSGSPMARR

SEQ ID NO: 3523 - protein, 46 aa, Beta vulgaris
ATCRKPSMYFSGACFSDTNCQKACNREDWPNGKCLVGFKCECQRPC

SEQ ID NO: 3524 - protein, 87 aa, Bos taurus
MAKHLKFIARTVMVQEGNVEGAYRTLNRILTMDGLIEDIKRRRYYEKPCRRRQRESYETCRRIYNMEMARKINFLMRKNRADPWQGC

SEQ ID NO: 3525 - protein, 172 aa, Equus caballus
ASQKRPSQRHGSKYLASASTMDHARHGFLPRHRDTGILDSLGRFFGGDRGVPKRGSGKDGHHAARTTHYGSLPQKSRDGRPQDENPVVHFFKINVTPRTPPPSQGKGRGLSLSRFSWGAEGQKPGFGYGARASDYKSTHKGLKGVHDAQGTLSRIFKLGGRDSRSGSPMARR

SEQ ID NO: 3526 - protein, 154 aa, Bubalus bubalis
MGLSDGEWQLVLNAWGKVETDVAGHGQEVLIRLFTGHPETLEKFDKFKHLKTEAEMKASEDLKKHGNTVLTALGGILKKKGHHEAEVKHLAESHANKHKIPVKYLEFISDAIIHVLHDKHPSDFGADAQAAMSKALELFRNEMAAQYKVLGFHG

SEQ ID NO: 3527 - protein, 137 aa, Bos taurus
MGAHLARRYLGDASVEPDPLRMPTFPPDYGFPERKEREMVATQQEMNDAQLVLQQRDYCAHYLIRFLKCKRDSFPNFLACKHERHDWDYCEHLDYVKRMKEFERERRLLQRKKRREQREADMAKGLGPGEVAPEVAL

SEQ ID NO: 3528 - protein, 229 aa, Lactobacillus casei
  strain ATCC 334
MDQNKLKQEAAQRAAEFVEDGMTIGLGTGSTVVYLVEAIAQRIKDEHLNLTGVATSVRTRKQAESLGIPMKALDEVGQIDLTIDGADEVDKHFQGIKGGGRSHLIEKIVAINSARNIWIVDETKLVDTLGKFPLPLEVIPFGSGKLLQRLADEGLKPAYRLNEDGSKALTDSKNYIIDLHLGKIEHPHLLAEWLNKQVGIVEHGLFLDLVKTVVVGTTHGPEILDAHRG

SEQ ID NO: 3529 - protein, 132 aa, Lactobacillus casei
  strain ATCC 334
MVLTDPIADYLTRIRNANMVRHESLVVPASKMKKDISEILKREGFIRDYEVIDDDKQGVIRIFLKYGKNNERVISGLKRISKPGLRSYVKSDAVPKVLNGLGIAIISTSEGVITDKEARAKNVGGEVLAYVW

SEQ ID NO: 3530 - protein, 211 aa, Saccharomyces cerevisiae
  strain ATCC 204508 / S288c
MDSKEYLISYGWKEGEAFREGGLKRPILVKHKRDKKGLGNAPGGNDGEAWWERLFDGHLKNLDVSTDSNNGSIKFTQNEAVATAVSKSSSPLYRWFVKGEGLKGTITNLGKKEEASFVVSSASSSKGKKRRRRDEDDNKVKRKKLKKDKKTSNDSESKKKKKKKSKKESKKGKKSKHSSDEGDKSKHKKSKKSKKHKKEESSARRDRKEHI

SEQ ID NO: 3531 - protein, 61 aa, Lactobacillus casei
  strain ATCC 334
MAKDIITGRHTTFGNKRSHALNSSRRQWKANLHKVRILVDGKPKRVWVSARALKSGKLTRV

SEQ ID NO: 3532 - protein, 77 aa, Saccharomyces cerevisiae
  strain ATCC 204508 / S288c
MIVKVKTLTGKEISVELKESDLVYHIKELLEEKEGIPPSQQRLIFQGKQIDDKLTVTDAHLVEGMQLHLVLTLRGGN

SEQ ID NO: 3533 - protein, 157 aa, Lactobacillus casei
  strain ATCC 334
MAKKHRQKPDNLLAQNKKAGHDYNILDTYEAGIALTGTEIKSVRDGKLNLRDGFARIRNNEAWLENVHISPYKEGNLFNVDPMRNRKLLLHKREIRKLGQMTARQGVTLVPLRMYLKHGYAKVLIGVAEGKHNYDKRETLKRKDQEREVQRALKARY

SEQ ID NO: 3534 - protein, 106 aa, Lactobacillus casei
  strain ATCC 334
MANNEHVTPGEDDQQITLIDEKGNEELYQVLFTFDSEDYGKSYVLLYPASESDDQEVEIQAFSFTPDENGDASSGDLFPIDDDAEWDMVEEVLNTFLADDDSNLKD

SEQ ID NO: 3535 - protein, 250 aa, Lactobacillus gasseri
  strain ATCC 33323 / DSM 20243
MVRELCEVQGLIFKRKKYKEADILTKIMTKDHGIFTIDVRGALRPKSRLGAATLNFSYGKYIVNTNWKGISSLRTFKDVKQLDQLYLDLTKNAYSSYVLDLLDHAFVEYKDIGSFYDLIMKALLKINSGEDVAVITQMVQLKLLNAYGVAPQLDRCLICGKVQGTFDYSLELGGIICSDHFNSVSQRMHLDPKVVALIRTLALIDIDRLGKVKINPQLKKNSGKVIDRMYANYLDLNLKTKKFLDELALF

SEQ ID NO: 3536 - protein, 349 aa, Lactobacillus gasseri
  strain ATCC 33323 / DSM 20243
MTAQINLKDITVQFGPNKAVNNVNLEINKGDIYGVIGFSGAGKSTLVRTINLLQYPSAGSVEVNGTILFKEGKLQVSKKQLQEKRRKIGMIFQNFNLLNEETVIENVAFALQHTHLSDKELEEKSLHLLELVGLKDKSDFYPAQLSGGQRQRVAIARALANDPDILISDEATSALDPKTTNQILDLLYDLNKKLGLTIVLITHEMDAVKRVANKIAVMEKGKVIEKGDLREVFLHPQKQLTRQFVGGALQAQHILNTYNFDKLADNAELYQLVYSINDVTKSVVADLDVSLNTKASILYGNVEVLSGEPIGTLAILLNLDEQKQKEAIKFLESKNVVVTKLDKGVLTND

SEQ ID NO: 3537 - protein, 104 aa, Lactobacillus gasseri
  strain ATCC 33323 / DSM 20243
MSEKINANQDNDRQITLVDDQGNEELFEILFTFTSEDYGKSYVLLYPAAVSDDDDVEVQAFSYDADEDGDVTSSDLHEISDDDEWNMVQGVLNTFLSDDRLSGE

SEQ ID NO: 3538 - protein, 73 aa, Lactobacillus gasseri
  strain ATCC 33323 / DSM 20243
MAKEDVIEVEGKVVDTLPNAMFKVELENGATILAHVSGKIRMHYIRILPGDRVTVELSPYDLTKGRITYRFIK

SEQ ID NO: 3539 - protein, 349 aa, Saccharomyces cerevisiae
  strain ATCC 204508 / S288c
MSPLNVGIVGTGIFARDRHLPSYQEFPDKFKVIAAFNRHKAKALDFAKVADIPENKVYDNLDEILNDPHVDYIDALLPAQFNADIVEKAVKAGKPVILEKPIAANLDQAKEIVKIAESTPLPVGVAENWLYLPCIKIAKEQIEKIGPVVAFTHNSTGPFVTQNKYLTTTWRQKPEHIGGFLSDGGVHQLALVISLLGEFGSVSALTRQVRERSGADDIVFATVQLKNKEVIGSFTYGSAFGATEKSVFLKVYGKNGTVTVDLSDKKDPVVKVKLGGSAEDNGDEQIFKVDNDESFGVNAEFLNFHEAVSKKDKSLYLGTPRTAFHHLACVDAFLKSSAKNGDYVKIEQP

SEQ ID NO: 3540 - protein, 107 aa, Lactobacillus delbrueckii
  subsp. bulgaricus
  strain ATCC BAA-365
MAFEVSAEDQDRQLTLIDEDGNEELFEVLFTFHSDDNDKSYILLYPAAVEDDDEIEVQAFSYDADEDGDVTSSDLHEITSDAEWDMVQGVLNTFLEDDRLSGDDSAE

SEQ ID NO: 3541 - protein, 205 aa, Saccharomyces cerevisiae
  strain ATCC 204508 / S288c
MRWWPWSNQTEDQKQQQQPQGKADGDRVLTNYSRGQKILLEDTPPKFADDLSNSQLAKKQERATLKEAWDSIRWSDFSLQKLTSIPCFRDAGMLGFSSMFLMGSIIFIYHKSPTKATNWAMSSLILGSIVGWEQCRLKRQKSFQIAQLAKETVAKKEKPMLHNVPHDPSLPGQWEAAKNEKQSQFEQSNQNLSQASSEKKWYKFW

SEQ ID NO: 3542 - protein, 283 aa, Lactobacillus delbrueckii
  subsp. bulgaricus
  strain ATCC BAA-365
MGEILDGKKLARELGEKLGSEVDSLKEHGVSPKLCVINIGDDPASKVYVASKKRKAEKLGIKQVVYQLPADESEEDVLKLIDSLNADPEVSSLMVQLPVPPQINADRVIERIDPEKDVDCLTPANIGRLWQGKHFVEPATAAGIIALLDHYQIDLTGKNAVIVGRSNIVGKPLAALMLERNASVSILHSRSRNLADLTKQADILVCAVGKAEMIKADMVKEGAVVIDVGINRVDGHLVGDVDFAPVKEKASWITPVPGGVGPLTVEFLMEEVIKLTRRQHGLD

SEQ ID NO: 3543 - protein, 189 aa, Lactobacillus delbrueckii
  subsp. bulgaricus
  strain ATCC BAA-365
MGLADFKDVDRNELSMIEVAHAILEDRGERMAFADIVNEVQKYLNKSDEEIRQRLPQFYTDMNTDGRFISMGENVWALRTWFKFEAVDEEVDHPEDDGDEESTRKHHKKVNTFLATTEGDDVIDYENDDPEDEDLSDDSDADEDDADDNSGDDYDDNEDDDDDDSLLDGIEDQLSQMDDDDLDDDEDEE

SEQ ID NO: 3544 - protein, 135 aa, Pisum sativum
MVKFLKPNKAVILLQGRYAGKKAVIVKTFDDGTREKPYGHCLVAGIKKFPSKVIKKDSAKKTAKKSRVKAFVKLVNYQHLMPTRYTLDVDLKDAVVPDVLQSKDKKVTALKETKKSLEERFKTGKNRWFFTKLRF

SEQ ID NO: 3545 - protein, 59 aa, Zea mays
MAVPKKRTSMSKKRIRKNLWKKKTYFSIVQSYSLAKSRSFSRGNEHPKPKGFSGQQANK

SEQ ID NO: 3546 - protein, 122 aa, Saccharomyces cerevisiae
  strain ATCC 204508 / S288c
MFLTFSMCVNWIIVKMPNRSEELDRLLDKIINSPHRTEASKTLQEIENNQSYILNVQLKKLLRLHDDSFKNKCVSPINYMLEKYTPYMGHTEALQKEAELVDRDLRILEMTYQLIEKNRNSK

SEQ ID NO: 3547 - protein, 153 aa, Saccharomyces cerevisiae
  strain ATCC 204508 / S288c
MNSEQLLHNYVSDSLLTTLISFQEFKQQLQSYTSDEQQLQHWYELLQARDARVTSELEARIKQFFITLRSRLLRFLESEQLSHSLSLETLIDALYKINDLLQQRLQILDDAIQEKTSELAEFENMVRSPSAGDNAIPGLLQIIQSYINLLEEN

SEQ ID NO: 3548 - protein, 107 aa, Saccharomyces cerevisiae
  strain ATCC 204508 / S288c
MSRHQFDLIMCLKQPGVQTGLLCEKCDGKCPICDSYVRPKRKVRVCENCSFGKQAKNCIICNLNVGVNDAFYCWECCRLGKDKDGCPRILNLGSNRLDRHFEKKKKV

SEQ ID NO: 3549 - protein, 181 aa, Saccharomyces cerevisiae
  strain ATCC 204508 / S288c
MPYKTAIDCIEELATQCFLSKLTDDDVSTFRRVCSKENDIIKLALRIPRTIDYTSILRLLYDTLPLRSLSFNEALPLFCYSIDPAQQRQCDLRFYLRDVVKLARPRKRLEMQKALLQWLPSLLSDVTLQLLNDIRIRFEEIQPNIRQTVLQIYDRTCYPSLNFEHPNLGVFPETDSIFEPV

SEQ ID NO: 3550 - protein, 121 aa, Saccharomyces cerevisiae
  strain ATCC 204508 / S288c
MSNEVDRMDVDEDESQNIAQSSNQSAPVETKKKRFEIKKWTAVAFWSWDIAVDNCAICRNHIMEPCIECQPKAMTDTDNECVAAWGVCNHAFHLHCINKWIKTRDACPLDNQPWQLARCGR

SEQ ID NO: 3551 - protein, 113 aa, Saccharomyces cerevisiae
  strain ATCC 204508 / S288c
MKLVLFKIAVALLYLLSFFLHRLHLRLRHLHRRRRRRHHRRHHRRHHHHRRRRRRRRRRRRRHHRHHHHRHRRRRHYLHLYHQYRSSYYHPPHRYLHPLLLPFPQKHRDNHLV

SEQ ID NO: 3552 - protein, 45 aa, Citrus sinensis
MLLLKHRRIEILDQNTMYGWYELLKQEFLNSEPPELLLTTSKNFH

SEQ ID NO: 3553 - protein, 136 aa, Citrus sinensis
MGKDTIADIITSIRNADMNRKGTVRIASTNITENVVKILLREGFIENARKLVENKNKKEFLVLTLRHRRNRKGPYRPILNLKRISRPGLRIYFNYRRIPRILDGMGIVILSTSRGIMTDRAARLERIGGEILCYIW

SEQ ID NO: 3554 - protein, 117 aa, Citrus sinensis
MTRIRRGYIARRRRTKMRLFVSSFRGAHSRLSRTITQQKIRALVSAHRDRDRKKRDFRRLWITRINAVIRGNLVSYSYSRLIYNLYKAQLVLNRKILAQIAISNRNCLYMISNEIIK

SEQ ID NO: 3555 - protein, 222 aa, Bos taurus
MFPFKVRKWMGLACFRSLVVSSSSIRQKKLIHKLQEEKAFREEMRHFREKIEDFREEMWNFRSKMRAFRGEILGFWEEDRLFWEEEKTFWKEEKAFWEMEKSFREEEKAFWKKYRIFWKEDRAFWKEDNALWERDRNLLQEDKALWEEEKALWVEERALLEEEKVLWEDKKTLWEEENALWEEEKAAWVEGVVPVVEQQVLEGGHHHVSGRPRSPASSRGRA

SEQ ID NO: 3556 - protein, 156 aa, Bos taurus
MMVLDKEDGVPMLSVQPKGKQKGCAGCNRKIKDRYLLKALDQYWHEDCLKCACCDCRLGEVGSTLYTKANLILCRRDYLRLFGTTGNCAACSKLIPAFEMVMRARDNVYHLDCFACQLCNQRFCVGDKFFLKNNMILCQMDYEEGQLNGTFDSHVQ

SEQ ID NO: 3557 - protein, 208 aa, Bos taurus
MEAPPVTMMPVTGGTINMMEYLLQGSVLDHSLESLIHRLRGLCDNMEPETFVDHEMVFLLKGQQASPFVLRARRSLDRAGAPWHLRYLGQPEMGDKNRHALVRNCVDIATSENLTDFLMEMGFRMDHEFVARGHLFRKGIMKIVVYKIFRILVPGNTDNTEALSLSYLVELSVVAPAGQDMVSDDMRNFAEQLKPLVHLEKIDPKRLM

SEQ ID NO: 3558 - protein, 146 aa, Bos taurus
MTLTKGSFTYSSGEEYRGEWKEGRRHGFGQLMFADGGTYLGHFENGLFNGFGVLTFSDGSRYEGEFAQGKFNGVGVFIRHDNMTFEGEFKNGRVDGLGLLTFPDGSHGIPRNEGLFENNKLLRREKCSAVVQRAQSASKSARSLTA

SEQ ID NO: 3559 - protein, 832 aa, Saccharomyces cerevisiae
  strain ATCC 204508 / S288c
MGSSLRSFIKDVRGAKTLADERAIITKQSAKIRTKLRDDHLPHEKRRVNIQKLLYLYILGEKTHFGQVESINLIASDDFVDKRLGYLAATLLLDESEDLLTLLTNMLNNDLHHPNKYAVSLALTSLGFLSSPELARDLYPDVENIIKNSRDPFLLKKALQCAAKLIFKDVSLLEIFNIEDITKILSSHSICTHGVLLGVTKIIQSILLIGLNRKKDEDEDEDGIDYSNDILSPLSLLLRDFFIRLENMNSKNIEPGYDVQGICDPFLQCEIIYTLKLYFQVGELLNSNNVLDYKDNFCDLLTRIATNTDSTKNSGQAILYETVKTIFSLDLNQPLRVLGINILAKFLAGKDNNTKYVSLNTLLKVVPQEPTAVQRHRKFISHCLQDTDVSIRMRALELSFAILDDSNLVELVNELMKFLAKQDEDSKDLIIYTIDHLIDTFDTRVVKDESWKLDVFFNILKLVGSFINYEKINDILIIINNTSQLSDKSEFLRKMLTISLNGTSAEISEENIGWQLVLIWCIGEYGDLVLNEGNKNGADIINESSITDYLLTLQELYTATNLKIINYILTAALKLSVRFHDAKNIEKLRQLILSYTDSTDLSLQMKSNQYEIFFNQSISVKKIILETMPKFEKITEEQDNGKALSKNLISNEPVDLLSDLLGEDSKAESKASTGDNVKPIDILEEIFGEKNDIAQVPKNANKEESINHSSAVEANSGVTLPLDANKIYDSSSLNVYASLLSANSGLAHLDLYFQAKSLISDLKTFCAVPKAQKLTLGQLYPSSTINASQICKQSLKISGSGKLKLRVKLDFHLNGSSSITNEQFDHKFDETL

SEQ ID NO: 3560 - protein, 117 aa, Populus alba
MTRIRRGYIARRRRTKIRLFTSSFRGAHSRLTRTIIQQRIKALFSAYRDRDRHKRNFRCLWVTRINAAIRENAVSYSYSTLINNLYKRQLLLNRKILAQLAILNRNCLYLISNDMIK

SEQ ID NO: 3561 - protein, 85 aa, Bos taurus
MPMVTRRLRDPDVNPCLSESDASTRCMAENNYDKESCSSHFLKYKNCRKFWNSVMIQRRQNGVKPPMPTAAERDEILGGLGKMPY

SEQ ID NO: 3562 - protein, 197 aa, Lactobacillus delbrueckii
  subsp. bulgaricus
  strain ATCC 11842 / DSM 20081
MYEYFEGTITVVNPAYVVIEVAGIGYRILTPTPYAYKDGDKARIYVEQVVRENGMTLYGFKSQQDKVLFNKLNEVSGIGPKSALAIMAAEDNGALASAIESGEVSYLTRFPGIGKKTASQIVLDLRGKMGNYVAENLFTEDEPVKSVFPALEDALLALGALGYSQKEVDRIKPKLKKLPEMSADEYIKQGLGFLLKK

SEQ ID NO: 3563 - protein, 61 aa, Lactobacillus delbrueckii
  subsp. bulgaricus
  strain ATCC 11842 / DSM 20081
MAKDFVTGKKTTFGNTRSHALNSSSRSWKPNLQKVRILVNGKPKRVWVSTKTLKSGKVTRV

SEQ ID NO: 3564 - protein, 189 aa, Lactobacillus delbrueckii
  subsp. bulgaricus
  strain ATCC 11842 / DSM 20081
MGLADFKDVDRNELSMIEVAHAILEDRGERMAFADIVNEVQKYLNKSDEEIRQRLPQFYTDMNTDGRFISMGENVWALRTWFKFEAVDEEVDHPEDDGDEESTRKHHKKVNAFLATTEGDDVIDYENDDPEDEDLSDDSDADEDDADDNSGDDYDDNEDDDDDDSLLDGIEDQLSQMDDDDLDDDEDEE

SEQ ID NO: 3565 - protein, 279 aa, Bos taurus
MTERFDCHHCEDSLFGRKYVLREEQPYCVACFEALFASTCEECGKLIGCDCKDLSYKDRHWHEACFHCSRCRGSLVDKPFAAKEDQLLCTDCYSQEYSSRCQECKKSIMPGTRKMEYKGSSWHETCFICHRCQQPIGTKSFIPKDSENFCVPCYERQYALQCVQCKKPITTGGVTYREQPWHRECFVCTACKKPLSGQRFTSRDEFAYCLGCFCDLYAKKCAGCANPISGLGGTKYISFEERQWHNDCFNCKKCSLSLVGRGFLTERDDILCPDCGKDI

SEQ ID NO: 3566 - protein, 145 aa, Bos taurus
MLSVQPDTKPKGCAGCNRKIKDRYLLKALDKYWHEDCLKCACCDCRLGEVGSTLYTKANLILCRRDYLRLFGVTGNCAACSKLIPAFEMVMRAKDNVYHLDCFACQLCNQRFCVGDKFFLKNNMILCQTDYEEGLMKEGYAPQVR

SEQ ID NO: 3567 - protein, 351 aa, Bos taurus
MRPPAPAVLGLLLLLLPTGEATKKPTPCKRCRELVDKFNQGMVDTAKKNFGGGNTAWEEKTLSKYEFSEVRLLEIVEGLCEASDFECNQLLEEQEELLEAWWLRLKKKHPDLFEWFCVQTLKACCSPGTYGPDCLACQGGSERPCSGNGHCVGDGTREGDGSCQCHLGYQGPLCSDCMDGYFRSPTSETHSICSACDEACKTCVGPTNRDCGQCEVGWVRQDDACVDVDECAAEPPPCEDTQYCENVNGSFVCEECDPTCMGCTGKGPTQCRECIAGYSKESGQCEDIDECSLAEKPCLRDNENCYNTPGSFVCVCPDGFEEAEDTCVQTRPAGAEATEASPTQPPSREDL

SEQ ID NO: 3568 - protein, 117 aa, Gossypium hirsutum
MTRIKRGYIARRRRKKISLFASSFRGAHSRLTRTITQQRIRALVSAHRDRDRKKRDFRRLWITRINAVIRGVGVSYSYSRLIHNLYKKQLLLNRKILAQIAISNRNCLYMISNEIRK

SEQ ID NO: 3569 - protein, 108 aa, Bos taurus
MLLFCPGCGNGLIVEEGQRCHRFACNTCPYVHNVTRKVTNRKYPKLKEVDDELGGAAAWENVDSTAEPCPKCEHPRAYFMQLQTRYADEPMTTFYKCCNAQCGHRWRD

SEQ ID NO: 3570 - protein, 92 aa, Solanum lycopersicum
MTRSLKKNPFVANHLLKKIDKLNTKAEKEIIVTWSRASTIIPTMIGHTIAIHNGKEHLPIYITDSMVGHKLGEFAPTLNFRGHAKSDNRSRR

SEQ ID NO: 3571 - protein, 68 aa, Bos grunniens
MDPETCPCPTGGSCTCSDPCKCEGCTCASSKKSCCSCCPAECEKCAKDCVCKGGEGAEAEEKKCSCCQ

SEQ ID NO: 3572 - protein, 165 aa, Bos taurus
MFLTVKLLLGRRCSLKVSGQESVAMLKKLVSERLHVPEEQQHLLFRGQLLADDKRLSDYRIGPNASISVVVRPLEKPAPEDTRLPQPLWHHLGQVLAKHFGPQDTEAMLQLLRREHEECLQRISLGDLEQLARYLLTKEPLAQPTGEREPEVLSPNKEEEKEAVQ

SEQ ID NO: 3573 - protein, 127 aa, Bos taurus
MAKSLRSKWKRKMRAEKRKKNAPKELSRLKSILKIDGDVLMKDVQEIATVVEPKHCQEKTQCVVKDETDDMKMETDIKRNKKTLLDQHGQYPIWMNQRQRKRLKAKRERKKGKSKVKAMKAAKGLTW

SEQ ID NO: 3574 - protein, 284 aa, Bos taurus
MTTPQFYCQYCMASLLGKKYVLKDDNPYCVSCYDRIFSNYCEECKEPIESGSKDLCYKGHHWHEGCFNCTKCNHSLVEKPFAAKDERLLCSECYSNECSSKCFHCKKTIMPGSRKMEFKGNYWHETCFVCEHCRQPIGTKPLISKESGNYCVPCFEKEFAHYCSFCKKVITSGGITFRDQPWHKECFLCSGCRKELCEEEFMSRDDYPFCLDCYNHLYAKKCAACTKPITGLRGAKFICFQDRQWHSECFNCGKCSVSLVGEGFLTHNKEIFCRKCGSGVDTDI

SEQ ID NO: 3575 - protein, 101 aa, Bos taurus
MSMEKMGKVEEHFQRALELKKMVHRWRNSHTHCLWQITLSQRRNPYAILRMQDTMVQELALANKQLLMVRQAALHQLFEKEHQQYQQELNEKGKAFYMERL

SEQ ID NO: 3576 - protein, 339 aa, Bos taurus
MKDSLVLLSRILAHPDSRCWFLAWNPAGTLLASCGGDRSVRIWGREGDSWICKSVLCEGHQRTVRKVAWSPCGNYLASASFDATTCIWKKNEDDFECVTTLEGHENEVKSVAWAPSGNLLATCSRDKSVWVWEVDEEDEYECVSVLNSHTQDVKHVVWHPSQELLASASYDDTVKLYREEEDDWVCCATLEGHESTVWSLAFDPSGQRLASCSDDRTVRIWRQYLPGNEQGVACSGSEASWKCVCTLSGFHSRTIYDVAWCQLTGTLATACGDDAIRVFEEDPGSDPQQPTFSLTAHVPQAHSQDVNCVAWNPKERGLLASCSDDGELAFWKYQPSEGI

SEQ ID NO: 3577 - protein, 92 aa, Lactuca sativa
MTRSLKKNPFVANNLLKKINKLNTKAEKEIIITWSRASTIIPIMVGHTIAIHNGKEHLPIYITDRMVGHKLGEFAPTLNFRGHAKSDNRSRR

SEQ ID NO: 3578 - protein, 37 aa, Lactuca sativa
MKIRASVRKICEKCRLIRRRGRIRVICSNPRHKQRQG

SEQ ID NO: 3579 - protein, 98 aa, Saccharomyces cerevisiae
  strain ATCC 204508 / S288c
MSGNPGSSLSALRPTPPERGSFPLDHDGECTKYMQEYLKCMQLVQNENAMNCRLLAKDYLRCRMDHQLMDYDEWSHLGLPEDAPGNNGKTIKDATDNK

SEQ ID NO: 3580 - protein, 38 aa, Saccharomyces cerevisiae
  strain ATCC 204508 / S288c
MNVIFKLYLTIDAPKKKKVTVRDFLSIRYSMPYRLASN

SEQ ID NO: 3581 - protein, 85 aa, Saccharomyces cerevisiae
  strain ATCC 204508 / S288c
MPQKPLKVTKKAKDPRRVTKKQKNLRKAAPLQLKSKKKSLQHLKKLKKSSSLTETTERLVASKVGHLELLRGTRKELEKGKKNSK

SEQ ID NO: 3582 - protein, 53 aa, Saccharomyces cerevisiae
  strain ATCC 204508 / S288c
MHILTRSSKNAFPRSRSRQDIHISSHIHRDTSNSALLKILVITRTRLDSFVKT

SEQ ID NO: 3583 - protein, 49 aa, Saccharomyces cerevisiae
  strain ATCC 204508 / S288c
MWRRRREPWEELSFLLNSLSPRNWFIRRWGLMAGRGQHLCWLRCACDGP

SEQ ID NO: 3584 - protein, 45 aa, Saccharomyces cerevisiae
  strain ATCC 204508 / S288c
MKMNYHLSTSSYTTSMLSCTVLDDDIRYEKLSWKLDEAEMQGLIM

SEQ ID NO: 3585 - protein, 104 aa, Bos taurus
MAEGEGWRPPRPCEAYRAEWELCRSAGHFLRHYYVHGERPACGQWRRDLASCREWEERRSAEAQADSLPPGPEGEPRVAGAGPNAVTGILTRNQGTERPHGDTR

SEQ ID NO: 3586 - protein, 170 aa, Bos taurus
MSSNECFKCGRSGHWARECPTGGGRGRGMRSRGRGFQFVSSSLPDICYRCGESGHLAKDCDLQEDACYNCGRGGHIAKDCKEPKREREQCCYNCGKPGHLARDCDHADEQKCYSCGEFGHIQKDCTKVKCYRCGETGHVAINCSKTSEVNCYRCGESGHLARECTIEATA

SEQ ID NO: 3587 - protein, 148 aa, Bos taurus
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGLKLRGKDIGKPIEKGPRAK

SEQ ID NO: 3588 - protein, 73 aa, Bos taurus
MIEVVCNDRLGKKVRVKCNTDDTIGDLKKLIAAQTGTRWNKIVLKKWYTIFKDHVSLGDYEIHDGMNLELYYQ

SEQ ID NO: 3589 - protein, 86 aa, Bos taurus
MSLPLNPKPFLNGLTGKPVMVKLKWGMEYKGYLVSVDGYMNMQLANTEEYIDGALSGHLGEVLIRCNNVLYIRGVEEEEEDGEMRE

SEQ ID NO: 3590 - protein, 92 aa, Acorus calamus
MTRSLKKNPFVANHLLEKIEKLNMKEEKEIIVTWSRASTIIPTMIGHTIAIHNGKEHLPIYITDRMVGHKLGEFAPTLTFRGHARNDNKSRR

SEQ ID NO: 3591 - protein, 139 aa, Bos taurus
MLPLSLLKTAQNHPMLVELKNGETYNGHLVSCDNWMNINLREVICTSRDGDKFWRMPECYIRGSTIKYLRIPDEIIDMVKEEVVAKGRGRGGLQQQKQQKGRGMGGAGRGVFGGRGRGGIPGTGRGQPEKKPGRQAGKQ

SEQ ID NO: 3592 - protein, 177 aa, Lactobacillus johnsonii
MTKYSTELKIEIVSKYLNHEDSIKGLAKQYNIHWTLIRRWVDKAKCQGLAALSVKHTKTTYSSDFKLNVVRYYLTHSIGVSKVAAKFNISDSQVYNWAKKFNEEGYAGLLPKQKGRPRKVPKKSKKTTKKLELSEKQKYEEKILKQEAELERLRVENLVLKKVAARYPRYPTNKKHN

SEQ ID NO: 3593 - protein, 37 aa, Cucumis sativus
MKIRASIRKICEKCRLIRRRRRIMVICSNPRHKQRQG

SEQ ID NO: 3594 - protein, 222 aa, Bos taurus
MGLFGKTQEKPPKELVNEWSLKIRKEMRVVDRQIRDIQREEEKVKRSVKDAAKKGQKDVCVVLAKEMIRSRKAVSKLYASKAHMNSVLMGMKNQLAVLRVAGSLQKSTEVMKAMQSLVKIPEIQATMRELSKEMMKAGIIEEMLEDTFESMDDQEEMEEAAEMEIDRILFEITAGALGKAPSKVTDALPEPEPLGAMAASEDEEEEEEALEAMQSRLATLRS

SEQ ID NO: 3595 - protein, 152 aa, Bos taurus
MAKSKNHTTHNQSRKWHRNGIKKPRSQRYESLKGVDPKFLRNMRFAKKHNKKGLKKMQANNAKAMSARAEAVKALVKPKEIKPKMPTGGSRKLSRLAYIAHPKLGKRARARIAKGLRLCRPKSQAKASTKAKPPAAAAPAAKGAQAPTKAPE

SEQ ID NO: 3596 - protein, 79 aa, Bos taurus
MSEFWHKLGCCVVEKPQPKKKRRRIDRTMIGEPMNFVHLTHIGSGEMGAGDGLAMTGAVQEQMRSKGNRDRPWSNSRGL

SEQ ID NO: 3597 - protein, 133 aa, Bos taurus
MNYMPGTASLIEDIDKKHLVLLRDGRTLIGFLRSIDQFANLVLHQTVERIHVGKKYGDIPRGIFVVRGENVVLLGEIDLEKESDTPLQQVSIEEILEEQRVEQQTKLEAEKLKVQALKDRGLSIPRADTLEEY

SEQ ID NO: 3598 - protein, 567 aa, Bos taurus
MHGRLKVKTSEEQAEAKRLEREQKLKLYQAATQTVFQKRQAGELDESVLELTSQILGANPDFATLWNCRREVLQQLEVQKSPEELATLVKAELGFLESCLRVNPKSYGTWHHRCWLLSRLPEPNWARELELCARFLEVDERNFHCWDYRRFVAAQAAVPPAEELAFTDSLITRNFSNYSSWHYRSCLLPQLHPQPDSGPQGRLPEDVLLKELELVQNAFFTDPNDQSAWFYHRWLLGRADPQDALRCLHVSRDEACLTVSFSRPLLVGSGMETLLLMVDESPLAVEWRTPEGRNRPSHIWLCDLPATSLNDQLPQHTFRVIWTAGDAQKECVLLKGRQEGWCRDSATDEQLFRCELSVEKSTVLQSELESCKELQELEPENKWCLLTIILLMRALDPLQYEKETLQYFQTLKAVDPMRAAYLDDLRSKFLLENSVLKMEYAEVRVLHLGHKDLTVLCHLEQLLLVTHLDLSHNRLRALPPALAALRCLEVLQANDNAIESLDGVTNLPRLQELILCNNRLQQPAVLQPLTSCPRLTLLNLQGNPLCQAEGSSEHLAELLPSVSSILT

SEQ ID NO: 3599 - protein, 529 aa, Gallus gallus
MSSNLGKEKDCKEKDPKVPSSKEREKESKASGGFGKESKEKEPKTKGKDAKDGKKDSSSTQPGVAFSVDNTIKRPNPATGTRKKSSNAEVIKELNKCREENSMRLDLAKRSIHMLPSAVKELTQLTELYLYSNKLQSLPAEVGCLVNLVTLALSENSLTSLPDSLDNLKKLRMLDLRHNKLREIPSVVYRLTSLATLYLRFNRITTVEKDIKTLSKLTMLSIRENKIKQLPAEIGELCNLITLDVAHNQLEHLPEEIGSCTQITNLDLQHNELLDLPETIGNLSSLSRLGLRYNRLSAIPKSLAKCSELDELNLENNNISTLPEGLLSSLVKLTSLTLARNCFQSYPVGGPSQFSTIYSLNMEHNRINKIPFGIFSRAKVLSKLNMKDNQLTSLPLDFGTWTSMVELNLATNQLTKIPEDVSGLVSLEVLILSNNLLKKLPHGIGNLRKLRELDLEENKLESLPNEIAYLKDLQKLVLTNNQLTTLPRGIGHLTNLTHLGLGENLLTHLPEEIGKILFFFFFNVSFLFV

SEQ ID NO: 3600 - protein, 239 aa, Lactobacillus acidophilus
MKVIVTENKIQGSAKAFEIFEKGIKNGAKVLGLATGSTPEILYQNWVKSDLNCDDLTSINLDEYVGLTPDNPQSYHYFMQKHLFDKKTFKKTYIPDGMTKDVPAYCKEYDQIIKDNPIDIQLLGIGQNGHIAFNEPGTPFDIGTHEVKLTENTIKANARFFDNEDEVPKSAICMGTANIMDSKKIVLMAFGEKKAKAIKEMIEGPITEEVPASILQKHPDVTVIVDTYAAQELDDKYKN

SEQ ID NO: 3601 - protein, 61 aa, Lactobacillus acidophilus
MAKDYVTGKKTTFGNKRSHSLNPTRRAWKPNLQKVRILVDGKPKRVWVSTKALKSGKVTRV

SEQ ID NO: 3602 - protein, 157 aa, Lactobacillus acidophilus
MAKVESFTLDHTKVKAPYVRLITVEEGPKGDKISNYDLRLVQPNENAIPTGGLHTIEHLLASLLRDRLDGVIDCSPFGCRTGFHLIVWGEHSTTEVAKALKSSLEEIRDTITWEDVPGTTIKTCGNYRDHSLFTAKEWCRDILEKGISDDPFERNVI

SEQ ID NO: 3603 - protein, 353 aa, Lactobacillus acidophilus
MSIIELKNVDVDFPQKKGKLVKAVNSVSLSIEKGDIYGIVGFSGAGKSTLVRTINLLQKPSAGDIEVDGTQFVKDGKQVISNKELQLKRRNIGMIFQGFNLLNETTVLENVAFALKHEKLSDDELEKKSLELLELVDLKEKANFYPSELSGGQKQRVAIARALANNPDILISDEATSALDPQNTQQILDLLKRLNKQFNLTVILITHEMDAVKKIATKVAVMEHGQVIEKGSLRQVFLHPKQELTKKFVGGSLEAISTLNSLHLDKLSKNESIYQLVYSVNNVAKSIIIELYKEIGVEVSMLYGNVELLNDEPIGTLVVLIKGDQEKQKQAKEFLQKQDVTLTRLDEKGNIYD

SEQ ID NO: 3604 - protein, 103 aa, Lactobacillus acidophilus
MAAQVNGDDNDRQITLIDDQGNEELYEVLFTFHSDDYDKSYVLLYPAAVGDDEDIEVQAFSYDADDTGDVTSSDLHEIESDDEWNMVQGVLNTFLDDDRLSGK

SEQ ID NO: 3605 - protein, 73 aa, Lactobacillus acidophilus
MAKDDVIEVEGKVVDTLPNAMFKVELENGATILAHVSGKIRMHYIRILPGDRVTVELSPYDLTKGRITYRFIK

SEQ ID NO: 3606 - protein, 77 aa, Lactobacillus acidophilus
MFVKTGDKVKVIAGKDKGKEGTVLSVNVKKNRVVVKGVNKIKKHQKPSQTNANGGVVESEGSIHASNVKVISKKEDK

SEQ ID NO: 3607 - protein, 184 aa, Lactobacillus acidophilus
MGLDKFKDKNRDELSMIEVARAILEDNGKRMAFADIVNAVQKYLNKSDEEIRERLPQFYTDMNTDGEFISMGENVWALRSWFPYESVDEEVNHPEDEEEDDSRKHHKKVNAFLASATGDDDIIDYDNDDPEDDDLDAATDDSDDDYSDDDSDYDEDNDDADDVLPDGIEGQLSQLNDEDDDEDD

SEQ ID NO: 3608 - protein, 158 aa, Lactobacillus reuteri
MAKVESFTLDHTKVKAPYVRLITVEEGAKGDKISNYDLRLVQPNENAIPTAGLHTIEHLLAGLLRDRLDGVIDCSPFGCRTGFHLITWGEHSTTEVAKALKSSLEEIAYKTKWEDVQGTTIESCGNYRDHSLFSAKEWSKKILDEGISDKPFERHVVD

SEQ ID NO: 3609 - protein, 114 aa, Gallus gallus
MAKSLRSKWKRKMRAEKRKKNAPKELERLKSILRTGADVVMEEVKEVATVLPAKEALEKQDDCKMDVDNKRNKKTLLDQHGQYPIWMNSRQRKKLKAQRLKGKKKSKLPKGLAW

SEQ ID NO: 3610 - protein, 301 aa, Gallus gallus
MEDATEMSGGAEEFAEGSKINASKNQQDDGKMFIGGLSWDTSKKDLTEYLSRFGEVVDCTIKTDPVTGRSRGFGFVLFKDAASVEKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGKSNASGGRGGGRGRGRGQGQNWNQGFNNYYDQGYGNYNSAYSDQSYSGYGGYDYSGYNYPNYGYGPGYTDYSGQQSTYGKASRGGGNHQNNYQPY

SEQ ID NO: 3611 - protein, 98 aa, Gallus gallus
MPKRKSPEGAEGKDAAKVTKQEPTRRSARLSAKPAPPKPEPKPRKTTKKEPGTKANKGAKGKKDEKQEAAKEGTTPSENGENKAEEAQKTESVGDKNE

SEQ ID NO: 3612 - protein, 110 aa, Gallus gallus
MAHSAPLGLLEQGCPIQVEHDRKRRQFTVRLNGCHDRAVLLYEYVGKRIVDLQHTEVPDAYRGRGIAKHLAKAALDFVVEEDLKAHLTCWYIQKYVKENPLPQYLEHLQP

SEQ ID NO: 3613 - protein, 78 aa, Gallus gallus
MSDFWHKLGCCVVEKPQPKKRRRRIDRSMIGEPMNFVHLTHIGSGDMAAGEGLPMTGAVQEMRSKGGRERQWSSSRVL

SEQ ID NO: 3614 - protein, 599 aa, Gallus gallus; identical to SEQ ID NO: 721

SEQ ID NO: 3615 - protein, 125 aa, Ovis aries [sequence omitted]

SEQ ID NO: 3616 - protein, 73 aa, Saccharomyces cerevisiae
  strain ATCC 204508 / S288c
MIEVVVNDRLGKKVRVKCLAEDSVGDFKKVLSLQIGTQPNKIVLQKGGSVLKDHISLEDYEVHDQTNLELYYL

SEQ ID NO: 3617 - protein, 131 aa, Gallus gallus
MPRPKPRSPRRRGRPPPAAPPPPPARPRARRYRPGQRALREIRRYQSSTALLLRRQPFARVVREICLLFTRGVDYRWQAMALLALQEAAEAFLVHLLEDAYLCSLHARRVTLYPKDLQLARRLRGLQGEGF

SEQ ID NO: 3618 - protein, 282 aa, Lactobacillus johnsonii
MKKLLEGKTPANEIKENLIEEIKKLKSDGINPTLCVIEVGDDPASKIYLRVKRNLAKKVGIKEIGLHFPANTSQAELLEKIEDLNQDPSINGIMVQLPVPPQIDPRAIFETIAPEKDADGFSPLNLGRLWEGQSDVIPATVRSILTLIDYYGIEMAGKNTVIIGRSVIVGKPLAAVLVERDATVTIAHSKTKNLSELTKNADVIISDVGKAHLVTEDMVKEGAVIIDVGMNRENGKLMGDVDFDMVAPKAKAITPVPGGVGPLTVASLMKQAVILTRKQHGR

SEQ ID NO: 3619 - protein, 349 aa, Lactobacillus johnsonii
MAAQIDLKNITVQFGQNKAVNDVSLEINKGDIYGVIGFSGAGKSTLVRTINLLQYPSAGSVEVNGTVLFKDNKLQISKKQLQEKRRKIGMIFQNFNLLNEETVIENVAFALQHSRLSDQELEKKSLHLLELVGLKDKADFYPAQLSGGQQQRVAIARALANDPDILISDEATSALDPKTTNQILDLLYDLNKKLGLTVVLITHEMDAVKRVANKIVVMEKGKVIEKGELREVFLHPQKQLTRQFVGGALQAQHILNTYNFDKLAENAELYQLVYSINDVTKSVVADLDVSLNTKASILYGNVEVLSGEPIGTLAILLNLNELKQKEAIKFLESKNVVVTKLDKGVLTND

SEQ ID NO: 3620 - protein, 250 aa, Lactobacillus johnsonii
MARELCEVQGLIFKRKKYKEADVLTKIMTKDHGIFTIDVRGALRPKSRLGAATLNFSYGKYIVNTNWKGISTLRTFKDVKQLDQLYLDLTKNAYSSYVLDLLDHAFVEYKDIGSFYDLIIKALLKINSGEDAAIITQMVQLKLLNAYGVAPQLDRCLICGKVQGKFDYSLELGGIICSDHFNSVSQRMHLDPKVVALIRTLALVDIDRLGKIKINPQLKKDSGKVIDRMYVNYLDLNLKTKKFLDELALF

SEQ ID NO: 3621 - protein, 180 aa, Lactobacillus johnsonii
MGLDDFQGQNKDELSMIEVARAILQDSGKRMAFADIVNAVQNFLGKSDEEIRERLPQFYTDMNTDGEFISMGHNVWALRSWFPYESVDEEVNHPEDEEDVPRKKHHKKVNAFIGDSDDDDIIDYDSDDPEDEDLDVDEEDTNEDDYSDDDLDDADDNELDDGIEGQLSELHQDDLDDDDE

SEQ ID NO: 3622 - protein, 195 aa, Oryza sativa
  subsp. japonica
MAAESIDAELRLGLPGSGGGDGVAAKKRRSASSTVKSEASGTACCGGAGARDVEDGASPASKVQVVGWPPVGSYRRSTFQSSSSSTAAAAKGKGGGETDQGRKNKGGGLYVKVSMDGAPYLRKVDLRMYGGYRELRDALDALFGCFSADASASAAHFAVAYEDKDGDLMLAGDVPWDMFISSCKKLRIMRGSEAR

SEQ ID NO: 3623 - protein, 88 aa, Pinus koraiensis
MIKNLSISSSLIPDKQRGSVESQVFFLTNRVLRLTQHLQLHGRDYSSQRGLWLILSKRKQLLVYLSKRDKLRYDDLIGQLSIRRLKTR

SEQ ID NO: 3624 - protein, 98 aa, Lactobacillus plantarum
MSQNQDRKDNDVITLVDDEGNETLFNILFTFDSEDFGHSYILLYPADAAADDEVDIQAYIFNPEDGDNGELQLIESDDEWDMVEQVLNTFLADDGGMQ

SEQ ID NO: 3625 - protein, 141 aa, Lactobacillus plantarum
MFFGEFEHALDAKGRLIIPAKFRELLGTSFVITRGMDGCIFGYPAERWATLQAQLDDLPLTRKDARAFVRFFYAAAAECELDKQGRVMIPATLRQYAKLEKQCVIVGVSDRFEIWGAEHWQQFETETAANFDDLAENLIDF

SEQ ID NO: 3626 - protein, 115 aa, Lactobacillus plantarum
MEIEKNYRINSLFEFYEPLLTNKQKAYIQLYYADDYSLGEIAAEFSVSRQAVYDNIKRTEKILEGYEAKLHLYHDFVERNHEVDAISDYIKQNYHGDTQLIKMIQQLVNLEADSE

SEQ ID NO: 3627 - protein, 61 aa, Lactobacillus plantarum
MAKDYVTGKRTHFGNTRSHALNHSRRSWKANLQKVRILVDGKPKKVWVSARTLKSGKVTRV

SEQ ID NO: 3628 - protein, 298 aa, Lactobacillus plantarum
MKKWLIALAGVLLTFTLAGCGSKTVASTSGGKITESQYYSSMKGTSSGKQVLQQMILNKVLEKDYGSKVSTKQVTKQYNTYKSQYGSSFSTVLSQNGLTTKTFKEQLRSNLLLKEAVKDKVKITDKALKKQWKSYEPKVTVQHILVAKSATADKVLDALKKDSSQANFTKLAKKYSTDTTTKNDGGKLSAFDNTNTSYSSKFLTAAFKLKNGEYTTSAVKTSNGYEIIRMIKNPGKGKMSDHTADLKKQIWDNDMSDSTVLQNVVSKVLKGGNVSIKDNDLKDILSSYLSTSSSSSSN

SEQ ID NO: 3629 - protein, 60 aa, Lactobacillus plantarum
MAQLKITLVRSAAHRLPKQRKIVKELGLGRINSSVVKPDDAATRGQIFHIAHLVDVEIIK

SEQ ID NO: 3630 - protein, 199 aa, Lactobacillus plantarum
MELKQFDGQKKSELSLIEVAHAILSQHGDVMAFADLTNAVQSYLGKSDEEIRERLSQFYTDLNIDGSFISLGDNMWGLRAWYPFESIDEAVIHTDDDEDEDRPKRKKVNAFLADAGDDDDVIDYDDDDPEDDDNYDDDDDQDDDTDDSASSKYDELAGVDDTDDDVADETLPDGIEGQLSELNDDDDDDDYDDEDDESK

SEQ ID NO: 3631 - protein, 447 aa, Oryza sativa; identical to SEQ ID NO: 766
  subsp. japonica

SEQ ID NO: 3632 - protein, 145 aa, Equus caballus
MTSRALLLLASALLGTPGLTFSGLNPESYDLATAHLSDGEQFCQGLTQEDLQGDLLTERERQGIACWSCRKILQKLEDLVGEQPNEATINEAASRVCRNLGLLRGACKKIMRTCLRLISRDILAGKKPQEVCVDIKLCKHKAGLI

SEQ ID NO: 3633 - protein, 295 aa, Glycine max
MEFWGVEVKVGQTVTVDPMDPVDSYIHISQVALGEAKKDKPNEPVVLYLKVGEQKIVLGTLSRDGIPHLSLDLVLDSDSELSHTSKSASVFFCGYKVLTGNDNASDFSDSSEEDEELALEGQDNGKPELKAEGAKVTKPSKSIPKIGAPAKAADPKKDEDDDSDDESDDDLAGEDESGSSDEMDDDSNSEEESDGDDEETPAKKVDQGKKRPNESAAKTPISAKKAKTATPEKTDGKKSVHVATPHPSKKGGKTPNSTKGQTPNSAGQLSCASCKKSFTNEAGLQQHKKAKHGGQ

SEQ ID NO: 3634 - protein, 745 aa, Bos taurus; identical to SEQ ID NO: 720

SEQ ID NO: 3635 - protein, 49 aa, Saccharomyces cerevisiae
  strain ATCC 204508 / S288c
MCDWKGRDNCPAPARKTSCVSRAALHSNVRWKWCEKSTLDRASNCWRGT

SEQ ID NO: 3636 - protein, 39 aa, Saccharomyces cerevisiae
  strain ATCC 204508 / S288c
MKVLDDWFSRKFSKAVHGNNHGTISLSTLSYIRVHKLVK

SEQ ID NO: 3637 - protein, 311 aa, Coturnix japonica
MAGELSIGAELPTSPLAMEYVNDFDLMKFDVKKEPLGRNDRSGRHCTRLQPAGSVSSTPISTPCSSVPSSPSFSPTEQKTHLEDLYWMANSYQQMNPEALNLTPEDAVEALIGSHQVSQQLQGFESFRAHHHHHHHHQHHHHQYPAVTHEDLAGSGHPHHHHHHHHHASPTPSTSSSSSQQLQTSHQQHPPSSSVEDRFSDDQLVSMSVRELNRHLRGFTKDEVIRLKQKRRTLKNRGYAQSCRYKRVQQKHHLENEKTQLIQQVEQLKQEVTRLARERDAYKLKCEKLASNGFREAGSTSDNPSSPEFFM

SEQ ID NO: 3638 - protein, 311 aa, Gallus gallus
MAGELSIGAELPTSPLAMEYVNDFDLMKFDVKKEPLGRNDRSGRHCTRLQPAGSVSSTPISTPCSSVPSSPSFSPTEQKTHLEDLYWMANSYQQMNPEALNLTPEDAVEALIGSHQVSQQLQGFESFRAHHHHHHHHHQHHHQYPAVTHEDLAGSGHPHHHHHHHHQASPTPSTSSSSSQQLQTSHQQHPPSSSVEDRFSDDQLVSMSVRELNRHLRGFTKDEVIRLKQKRRTLKNRGYAQSCRYKRVQQKHHLENEKTQLIQQVEQLKQEVTRLARERDAYKLKCEKLASNGFREAGSTSDNPSSPEFFM

SEQ ID NO: 3639 - protein, 144 aa, Bos taurus
MAASKVKQDMPPVGGYGPIDYKRNLPRRGLSGYSMFAVGIGALLFGYWSMMKWNRERRRLQIEDFEARIALMPLLQAEKDRRVLQMLRENLEEEATVMKDVPGWKVGESVFHTTRWVTPMMGELYGLRASEEVLSATYGFIWYT

SEQ ID NO: 3640 - protein, 303 aa, Zea mays
MEFWGLEVKPGSTVKCEPGHGFILHVSQAALGESKKSDSALMYVKVDDKKLAIGTLSIDKYPQIQFDLVFNKEFELSHTSKTTSVFFSGYKVEQPIEGDEMDLDSEDEEEELNIPVIKENGKADGKEEQKNQEKAVAATASKSSLGLEKKSKDDSDDSDEDESDDSDEDDSDDSDEGEGLSPDEGDDDSSDEDDTSDDDEEETPTPKKPEAGKKRGAENALKTPLSDKKAKVATPPAQKTGGKKGATHVATPHPAKGKTPANNDKLTEKSPKSGGSVPCKSCSKTFNSEMALQAHSKAKHGAK

SEQ ID NO: 3641 - protein, 1474 aa, Ovis aries; identical to SEQ ID NO: 756

SEQ ID NO: 3642 - protein, 1462 aa, Ovis aries; identical to SEQ ID NO: 757

SEQ ID NO: 3643 - protein, 111 aa, Bifidobacterium adolescentis
  strain ATCC 15703 / DSM 20083 / NCTC 11814 / E194a
MAAKIKSGDLVKVIRGKDRGKEGTVKQVLKDDRLIVEGVQIVKKHVRATQQGQQAGIVAVEAPIHRSNVMVIDPETKQPTRVRIVEKEEARDGKVKTVRVRVAKKSGKELA

SEQ ID NO: 3644 - protein, 37 aa, Bifidobacterium adolescentis
  strain ATCC 15703 / DSM 20083 / NCTC 11814 / E194a
MKVSPSVKRICENCRVIRRHGRVMVICVNPRHKQRQG

SEQ ID NO: 3645 - protein, 125 aa, Bifidobacterium adolescentis
  strain ATCC 15703 / DSM 20083 / NCTC 11814 / E194a
MARLAGVDIPNEKRIEIALTYIFGVGRTRAKETLAATGINPDIRVKDLTDEQLITLRDYLEGNYKIEGDLRREIDADIRRKIQINCYQGQRHRKGLPVRGQRTKTNARTRKGPKRTVAGKKKATK

SEQ ID NO: 3646 - protein, 86 aa, Bifidobacterium adolescentis
  strain ATCC 15703 / DSM 20083 / NCTC 11814 / E194a
MANIKSQKKRVLTNEKAHKRNVAVKSSLKTAVRATREAIAAGDKAAAEAAYKVAAQKLDKAAGAGVIHKNQAANRKSGLAVAINAL

SEQ ID NO: 3647 - protein, 64 aa, Bifidobacterium adolescentis
  strain ATCC 15703 / DSM 20083 / NCTC 11814 / E194a
MPKMKTNSAASKRVRVTGSGKLMHAGSAMRHNLEHKSARKRRELKADGVLATSQSKNMKKLLGR

SEQ ID NO: 3648 - protein, 64 aa, Bos taurus
MSGREGGKKKPLKQPKKQAKEMDEEDKAFKQKQKEEQKKLEELKAKAAGKGPLATGGIKKSGKK

SEQ ID NO: 3649 - protein, 344 aa, Aspergillus niger; identical to SEQ ID NO: 420
  strain CBS 513.88 / FGSC A1513

SEQ ID NO: 3650 - protein, 427 aa, Aspergillus niger; identical to SEQ ID NO: 409
  strain CBS 513.88 / FGSC A1513

SEQ ID NO: 3651 - protein, 149 aa, Oryza sativa
  subsp. indica
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYDEFVKVMMAK

SEQ ID NO: 3652 - protein, 65 aa, Oryza sativa
  subsp. indica
MSDKCGHCDCADKSQCVKKGTSYGVVIVDAEKSHFEMAEEVGYEENDGKCKCTTGCSCAGCNCGK

SEQ ID NO: 3653 - protein, 200 aa, Oryza sativa
  subsp. indica
MASHQDQASYRAGETKAHTEEKAGQVMGASKDKASEAKDRASEAAGHAAGKGQDTKEATKEKAQAAKERASETAQAAKDKTSGTAQAARDKAAESKDQTGGFLGEKTEQAKQKAAETAGAAKQKTAETAQYTKDSAIAGKDKTGSVLQQASEQVKSTVVGAKDAVMSTLGMTEDKAGTDDGANKDTSATAAATETTARDH

SEQ ID NO: 3654 - protein, 65 aa, Oryza sativa
  subsp. japonica
MSDKCGNCDCADKSQCVKKGTSYGVVIVDAEKSHFEMAEEVGYEENDGKCKCTTGCSCAGCNCGK

SEQ ID NO: 3655 - protein, 216 aa, Phaseolus vulgaris
MGQKINPLGFRLGTTQSHDSIWFAQPTKYSENIQEDKKIRDWIKNYIQKNIRISSGVEGIGEIKIQKRIDLIQVIIYMGFPKLLIEGKPHKIEEFQTNMHKKLNCVNKKLNIAIVKITNAYKHPNILAEFIAGQLKNRVSFRKAMKKAIELTEQAGTKGVQVQIAGRIDGKEIARVEWIREGRVPLQTIRAKIEYCCYTVRTIYGILGIKVWIFSK

SEQ ID NO: 3656 - protein, 53 aa, Phaseolus vulgaris
MAVPKKRTSISKKIIRNTLWKKKGYFTALKAFSLAQSLFTGNSKSFFCNKYKR

SEQ ID NO: 3657 - protein, 90 aa, Phaseolus vulgaris
MVKNSFIPVLSQEKKGKNPGLVEFQIFQFTNRIRRLTSHFELHPKDYSSQTGLRKILGKRQRLLSYLSKKDGIQYKKLINQFDIRQSQIR

SEQ ID NO: 3658 - protein, 400 aa, Bos taurus
MLEAMAEPSPEDPPPTLKPETQPPEKRRRTIEDFNKFCSFVLAYAGYIPPSKEESDWPASGSSSPLRGESAADSDGWDSAPSDLRTIQTFVKKAKSSKRRAAQAGPTQPGPPRSTFPRLQAPDSATLLEKMKLKDSLFDIDGPKMASPLSPTSLTHASRPPAALTPVPLSQGDLSQPPRKKDRKNRKLGPGGATGFGVLRRPRPAPGDGEKRSRIKKSKKRKLKKAERGDRLPPPGPPRAPPSDTDSEEEEEEEEEEEEMAAMVGGEAPAPVLPTPEAPRPPATVHPEGAPPTDGESKEVGSTETSQDGDASSSEGEMRVMDEDIMVESGDDSWDLITCYCRKPFAGRPMIECSLCGTWIHLSCAKIKKTNVPDFFYCQKCKELRPEARRLGGPPKSGEP

SEQ ID NO: 3659 - protein, 96 aa, Lactobacillus reuteri
  strain DSM 20016
MASEKYYIYVLYCADNSFYCGFTNNVKRRFHTHQTYQGAKYTRVKKRHPLKLIYSEEFESKHDALSAEYYFKHQTRRQKEKFLLDHGVDLLKLRRN

SEQ ID NO: 3660 - protein, 65 aa, Lactobacillus reuteri
  strain DSM 20016
MPKMKSNRAAAKRFKRTANGGFKSGNSFTSHRFHGKTKKQRRQLRGLSMMDKTNVKRYKKLLPFK

SEQ ID NO: 3661 - protein, 39 aa, Lactobacillus reuteri
  strain DSM 20016
MKVRPSVKKMCEHCKIVKRNGRVMVICSANPKHKQRQGK

SEQ ID NO: 3662 - protein, 92 aa, Lactobacillus reuteri
  strain DSM 20016
MGRSLKKGPFADASLLKKVKEQEGSEKKTVIKTWSRRSTIFPSFIGYTFAVYDGRKHVPVYVQEDMVGHKLGEFVPTRTFHGHASDDKKTGK

SEQ ID NO: 3663 - protein, 116 aa, Bos taurus
MAAAAPGSGAAREEEGTGGDAATPQPPAPTSAPGARLSRLPLARVKALVKADPDVTLAGQEAIFILARAAELFVETIAKDAYCCAQQGKRKTLQRRDLDNAIEAVDEFAFLEGTLD

SEQ ID NO: 3664 - protein, 142 aa, Bos taurus
MSKNVVIAEQEKNNEHCPEDINDKLSESTDDDGEDTSDEDKEEDSNPNKDTHAPLELMTEFLRAEMGHDYHLAKKLCQMILIYEPENPEAKEFFSLIEEMLLMEKAQNLEEDDDESEEDNSESEGESTEDPSEESSDECEDG

SEQ ID NO: 3665 - protein, 90 aa, Ipomoea purpurea
MVKNLFISVISQEETKENRGSVEFQIFNFTNKIQRLTSHLKLHKKDYLSQKGLRKILGKRQRLLAYLSKKNKVRYKELIEKLDIRETKTH

SEQ ID NO: 3666 - protein, 569 aa, Solanum lycopersicum; identical to SEQ ID NO: 837

SEQ ID NO: 3667 - protein, 92 aa, Carica papaya
MIKNSFISFQEKKKENSGSVEFQVFSFTNKIRRLTSHLELHRKDYLSQRGLRKILGKRQRLLSYLSKKNRVRYKELINQLDIRESKKISFLN

SEQ ID NO: 3668 - protein, 121 aa, Lactobacillus reuteri
  strain JCM 1112
MAFDKDAIIASLKEASISDLNDLVKAIEEEFDVSAAAPVAVAGAAGGDAAAKDSFTVELTEPGSAKVKVIKAVKDITGLGLKDAKDLVDGAPSAIKEDVKEDEANDIKEKLEAAGATVTLK

SEQ ID NO: 3669 - protein, 70 aa, Lactobacillus reuteri
  strain JCM 1112
MTFKVYYQADKTKRPVRENTQSLYIEADSEAEALLMVEHNTDYNIEFVEQLDEKALAYEKQNPNFKLTTF

SEQ ID NO: 3670 - protein, 89 aa, Lactobacillus reuteri
  strain JCM 1112
MAKKSKIAKLHHQEALVKKYAEKRKELKAKGDYIGLSKLPRNSSAVRLHNRDRYDGRPHAYMRKFGMSRIKFRELAHKGQIPGVRKASW

SEQ ID NO: 3671 - protein, 123 aa, Lactobacillus reuteri
  strain JCM 1112
MVVNIYDTANELSRQLRETQEYQGLQKAFEALKADGDTFDTFKKFQQAQADAQHKQMTGQQPTDDEIKNIQNLAKEVSGKKVVQDLMNQERQVDSMLQQLNKTITSPIQDLYSEVMPKMPGQE

SEQ ID NO: 3672 - protein, 66 aa, Welwitschia mirabilis
MPAKTGPRVVVFLECFHCTQKGAQKKFPGVFRYITKKNRHNKSTPLELKKFCPFCLKHTIHKERKK

SEQ ID NO: 3673 - protein, 73 aa, Welwitschia mirabilis
MTNMTNQISNNTGSVQSQVRFLTDRIQKLSRHLGTHKKDFSCQRSIRKLLIKRKRLLLYLYKKDKTGYNQVKS

SEQ ID NO: 3674 - protein, 111 aa, Bifidobacterium longum
  strain DJO10A
MAAKIKSGDLVKVIRGKDRGKEGTVKQVLSNDRLIVEGVQIVKKHVRATQQGQQAGIVSTEAPIHRSNVMVIDPETKQPTRVGITVKEEARDGKVKTVRVRVAKKSGKELA

SEQ ID NO: 3675 - protein, 64 aa, Bifidobacterium longum
  strain DJO10A
MPKMKTNSAASKRAKITGTGKVKHVGSAMRHNLEHKSARKRRELSADDVLRGGQAKKLHQLLQK

SEQ ID NO: 3676 - protein, 67 aa, Bifidobacterium longum
  strain DJO10A
MPQQFEQPQAQQAATQEDDALATTQAAAQTESADQADVLDDILDDIESTLETNAEEYVNSFVQKGGE

SEQ ID NO: 3677 - protein, 87 aa, Bifidobacterium longum
  strain DJO10A
MKTFESLFAELSEKAQTRPEGSLTVDELDKGTHFIGKKIIEEAGETWMAAEYEGADRTAEEMSQLLYHVQVMMIKHGLTLEDVYKHL

SEQ ID NO: 3678 - protein, 86 aa, Bifidobacterium longum
  strain DJO10A
MANIKSQKKRVLTNEKAHLRNVAVKSGLKTAIRATREAIAAGDKAAAEAAYKVAAQKLDKAAGAGVIHKNQAANRKSGLAVAINAL

SEQ ID NO: 3679 - protein, 106 aa, Saccharomyces cerevisiae
  strain RM11-1a
MSKLGPLARSVKWTLSVGVIGSVFYLYRYSNNGYFYDHDATWLKQDHQVQDLVDRKEVVPGETRNRKLVVTDDGTAWSRTMGESIKDIWNEQIRNSVDWIYSWGKN

SEQ ID NO: 3680 - protein, 99 aa, Lactobacillus casei
  strain BL23
MGNMQGMMKQMQKMQKEMQAAQRELYATEFEGKSASDMVTVKFTGEKIMKDIQIKPEAIDPDDPDMLQDLIIEAVNQAMGTIDKETQDKMGKYTRGLPM

SEQ ID NO: 3681 - protein, 114 aa, Lactobacillus casei
  strain BL23
MANVYDTANQMAADIKTTQEFQDLKKAFDLLKLDTVAYGLFQQFQQKQYEMQQKSMQGQDFTDDEVKSLQELGDKMRDIQPIQNLMAKEQGLSQMMDELNKIISQPIIDVYQGK

SEQ ID NO: 3682 - protein, 86 aa, Bifidobacterium longum
  subsp. infantis
  strain ATCC 15697 / DSM 20088 / JCM 1222 / NCTC 11817 / S12
MANIKSQKKRVLTNEKAHLRNVAVKSGLKTAIRATREAIAAGDKAAAEAAYKVAAQKLDKAAGAGVIHRNQAANRKSGLAVAINAL

SEQ ID NO: 3683 - protein, 67 aa, Bifidobacterium longum
  subsp. infantis
  strain ATCC 15697 / DSM 20088 / JCM 1222 / NCTC 11817 / S12
MPQQFEQPQAQQAVTQEDDALATTQAATQTESTDQADVLDDILDDIESTLETNAEEYVNSFVQKGGE

SEQ ID NO: 3684 - protein, 98 aa, Bifidobacterium animalis
  subsp. lactis
  strain AD011
MPTFTREEIVHLGDLARIALTDEEITRMQSELNVIADAIDSVQEVATADVEPTANPVPLEAYLRPDVPATPLTQAEALSGAPVAEDGMFVAPRILGEE

SEQ ID NO: 3685 - protein, 63 aa, Bifidobacterium animalis
  subsp. lactis
  strain AD011
MPKMKTKTAAAKRVRLTATGKVMHAGSGMRHNLEHKSARKRRALKRDDVLQTAQAKKMKGLLG

SEQ ID NO: 3686 - protein, 86 aa, Bifidobacterium animalis
  subsp. lactis
  strain AD011
MANIKSQKKRVRTNEKAHQRNVAVKSALKTYIRRTREAIASGDKAAAEAAFAIAGRKLDQAAGKGVIAKNQAANRKSSLALQINAM

SEQ ID NO: 3687 - protein, 44 aa, Bifidobacterium animalis
  subsp. lactis
  strain AD011
MKRTFQPNNRRRHMKSGFRVRMRTRAGRALINRRRAKGRKSLSA

SEQ ID NO: 3688 - protein, 111 aa, Bifidobacterium animalis
  subsp. lactis
  strain AD011
MVAKIKSGDLVKVIRGKDRGKEGTVKRVLKDDRLIVEGVQIVKKHVRATQQGQQAGIVSVEAPIHRSNVMVIDPETKQPTRVGVVIKEEARDGKVKTVRVRVAKKSGKELA

SEQ ID NO: 3689 - protein, 538 aa, Bacillus megaterium; identical to SEQ ID NO: 665
  strain DSM 319

SEQ ID NO: 3690 - protein, 291 aa, Bacillus amyloliquefaciens; identical to SEQ ID NO: 662
  strain ATCC 23350 / DSM 7 / BCRC 11601 / NBRC 15535 / NRRL B-14393

SEQ ID NO: 3691 - protein, 256 aa, Bacillus amyloliquefaciens; identical to SEQ ID NO: 668
  strain ATCC 23350 / DSM 7 / BCRC 11601 / NBRC 15535 / NRRL B-14393

SEQ ID NO: 3692 - protein, 265 aa, Bacillus amyloliquefaciens; identical to SEQ ID NO: 656
  strain ATCC 23350 / DSM 7 / BCRC 11601 / NBRC 15535 / NRRL B-14393

SEQ ID NO: 3693 - protein, 550 aa, Saccharomyces cerevisiae; identical to SEQ ID NO: 820
  strain FostersB
  MOD_RES (455)..(455): Any amino acid

SEQ ID NO: 3694 - protein, 894 aa, Glycine max; identical to SEQ ID NO: 801

SEQ ID NO: 3695 - protein, 284 aa, Arthrospira platensis C1; identical to SEQ ID NO: 607

SEQ ID NO: 3696 - protein, 267 aa, Glycine max; identical to SEQ ID NO: 830

SEQ ID NO: 3697 - protein, 125 aa, Saccharomyces cerevisiae
  strain ATCC 204508 / S288c
MEKDEEDEESEEAEEELLVLESDEKLNDVNDMEAMLVDELVCDTRDLLDVDEVREDESALEEETILDDKMELEELTLLTEERAVDTAEEFEDDDCTKNCARIVDMHDSIKSNKRKLFLVVKDNIL

SEQ ID NO: 3698 - protein, 25 aa, Glycine max
MGGVGKTKRMRRLKRKRRKMRQRSK

SEQ ID NO: 3699 - protein, 91 aa, Bos taurus
MGLEDEQRMLTGSGDPKEEEEEEEELVDPLTTVREQCEQLEKCVKARERLELCDERVSSRSQTEEDCTEELLDFLHARDHCVAHKLFNSLK

SEQ ID NO: 3700 - protein, 96 aa, Brassica napus
ATYKVKFITPEGEQEVECDDDVYVLDAAEEAGIDLPYSCRAGSCSSCAGKVVSGFVDQSDESFLDDDQIAEGFVLTCAAYPTSDVTIETHKEEELV

SEQ ID NO: 3701 - protein, 49 aa, Bos taurus
GQFLEDPSVLTKEKLKSELVANNVTLPAGEQRKDVYVELYLQHLTALKR

SEQ ID NO: 3702 - protein, 49 aa, Bos taurus
PEFLEDPSVLTKEKLKSELVANNVTLPAGEQRKDVYVELYLQSLTALKR

SEQ ID NO: 3703 - protein, 49 aa, Bos taurus
PEFLEDPSVLTKEKLKSELVANNVTLPAGEQRKEVYVELYLQHLTALKR

SEQ ID NO: 3704 - protein, 51 aa, Bos taurus
MARYRCCLTHSGSRCRRRRRRRCRRRRRRFGRRRRRRVCCRRYTVIRCTRQ

SEQ ID NO: 3705 - protein, 106 aa, Saccharomyces cerevisiae
  strain ATCC 204508 / S288c
MVNVPKTRKTYCKGKTCRKHTQHKVTQYKAGKASLFAQGKRRYDRKQSGFGGQTKPVFHKKAKTTKKVVLRLECVKCKTRAQLTLKRCKHFELGGEKKQKGQALQF

SEQ ID NO: 3706 - protein, 79 aa, Bos taurus
MSAKKSPEELKGIFEKYAAKEGDPNQLSKEELKLLLQTEFPSLLKGPSTLDELFEELDKNGDGEVSFEEFQVLVKKISQ

SEQ ID NO: 3707 - protein, 88 aa, Bos taurus
ESSFPATFVPLPADSEGGEDEDLQCVCLKTTSGINPRHISSLEVIGAGTHCPSPQLLATKKTGRKICLDQQRPLYKKILKKLLDGDES

SEQ ID NO: 3708 - protein, 149 aa, Triticum aestivum
MADQLTDEQIAEFKEAFSLFDKDGDGCITTKELGTVMRSLGQNPTEAELQDMINEVDADGNGTIDFPEFLNLMARKMKDTDSEEELKEAFRVFDKDQDGFISAAELRHVMTNLGEKLTDEEVDEMIREADVDGDGQINYEEFVKVMMAK

SEQ ID NO: 3709 - protein, 93 aa, Triticum aestivum
MASGQQERSQLDRKAREGETVVPGGTGGKSLEAQENLAEGRSRGGQTRREQMGEEGYSQMGRKGGLSTNDESGGDRAAREGIDIDESKFKTKS

SEQ ID NO: 3710 - protein, 51 aa, Saccharomyces cerevisiae
  strain ATCC 204508 / S288c
MAAQKSFRIKQKMAKAKKQNRPLPQWIRLRTNNTIRYNAKRRNWRRTKMNI

SEQ ID NO: 3711 - protein, 59 aa, Saccharomyces cerevisiae
  strain ATCC 204508 / S288c
MAKSKNHTAHNQTRKAHRNGIKKPKTYKYPSLKGVDPKFRRNHKHALHGTAKALAAAKK

SEQ ID NO: 3712 - protein, 161 aa, Coturnix japonica
MDDIYKAAVEQLTEEQKNEFKAAFDIFVLGAEDGCISTKELGKVMRMLGQNPTPEELQEMIDEVDEDGSGTVDFDQFLVMMVRCMKDDSKGKTEEELSDLFRMFDKNADGYIDLEELKIMLQATGETITEDDIEELMKDGNKNNDGRIDYDEFLQFMKGVE

SEQ ID NO: 3713 - protein, 177 aa, Saccharomyces cerevisiae
  strain ATCC 204508 / S288c
MTSNSDGSSTSPVEKPITGDVETNEPTKPIRRLSTPSPEQDQEGDFDEEDDDDKFSVSTSTPTPTITKTKDSSDTSTVTRRKQPIRYIENKTRRHVTFSKRRHGIMKKAYELSVLTGANILLLILANSGLVYTFTTPKLEPVVREDEGKSLIRACINASDTPDATDTSPAQEQSPAN

SEQ ID NO: 3714 - protein, 559 aa, Saccharomyces cerevisiae
  strain ATCC 204508 / S288c
MMEEFSYDHDFNTHFATDLDYLQHDQQQQQQQQHDQQHNQQQQPQPQPIQTQNLEHDHDQHTNDMSASSNASDSGPQRPKRTRAKGEALDVLKRKFEINPTPSLVERKKISDLIGMPEKNVRIWFQNRRAKLRKKQHGSNKDTIPSSQSRDIANDYDRGSTDNNLVTTTSTSSIFHDEDLTFFDRIPLNSNNNYYFFDICSITVGSWNRMKSGALQRRNFQSIKELRNLSPIKINNIMSNATDLMVLISKKNSEINYFFSAMANNTKILFRIFFPLSSVTNCSLTLETDDDIINSNNTSDKNNSNTNNDDDNDDNSNEDNDNSSEDKRNAKDNFGELKLTVTRSPTFAVYFLNNAPDEDPNLNNQWSICDDFSEGRQVNDAFVGGSNIPHTLKGLQKSLRFMNSLILDYKSSNEILPTINTAIPTAAVPQQNIAPPFLNTNSSATDSNPNTNLEDSLFFDHDLLSSSITNTNNGQGSNNGRQASKDDTLNLLDTTVNSNNNHNANNEENHLAQEHLSNDADIVANPNDHLLSLPTDSELPNTPDFLKNTNELTDEHRWI

SEQ ID NO: 3715 - protein, 165 aa, Gossypium hirsutum
MQSMKDAAASAKAGMEKAKASMQEKVDQMKTRDPNEKEMARERKEERQEDAELRKQEARHHNATAGHVGGGGIGGTGYTTAGYNIGDTGGYGGTGGHDNRGYPTAGSGYDTGRQDDLSSMGFGGDTEGAYGTTGNQDFPNAASNNAGTRRNTRGGTQDDPYYRSY

SEQ ID NO: 3716 - protein, 49 aa, Capra hircus
YLDPGLGAPAPYPDPLEPKREVCELNPDCDELADHIGFQEAYRRFYGIA

SEQ ID NO: 3717 - protein, 200 aa, Oryza sativa
  subsp. japonica
MASHQDQASYRAGETKAHTEEKAGQVMGASKDKASEAKDRASEAAGHAAGKGQDTKEATKEKAQAAKERASETAQAAKDKTSSTSQAARDKAAESKDQTGGFLGEKTEQAKQKAAETAGAAKQKTAETAQYTKDSAIAGKDKTGSVLQQASEQVKSTVVGAKDAVMSTLGMTEDEAGTDDGANKDTSATAAATETTARDH

SEQ ID NO: 3718 - protein, 33 aa, Saccharomyces cerevisiae
  strain ATCC 204508 / S288c
MATKGNLKRQTKYFSTIAYTETRGEATLRANYQ

SEQ ID NO: 3719 - protein, 46 aa, Saccharomyces cerevisiae
  strain ATCC 204508 / S288c
MRSHFDTEYLGDLARKFKCTISWNYDIRFIVQYKVQRVILITHLNV

SEQ ID NO: 3720 - protein, 67 aa, Bifidobacterium longum
MPQQFEQPQAQQAATQEDDALATTQAAAQTESTDQADVLDDILDDIESALETNAEEYVNSFVQKGGE

SEQ ID NO: 3721 - protein, 833 aa, Saccharomyces cerevisiae
  strain ATCC 204508 / S288c
MNNAANTGTTNESNVSDAPRIEPLPSLNDDDIEKILQPNDIFTTDRTDASTTSSTAIEDIINPSLDPQSAASPVPSSSFFHDSRKPSTSTHLVRRGTPLGIYQTNLYGHNSRENTNPNSTLLSSKLLAHPPVPYGQNPDLLQHAVYRAQPSSGTTNAQPRQTTRRYQSHKSRPAFVNKLWSMLNDDSNTKLIQWAEDGKSFIVTNREEFVHQILPKYFKHSNFASFVRQLNMYGWHKVQDVKSGSIQSSSDDKWQFENENFIRGREDLLEKIIRQKGSSNNHNSPSGNGNPANGSNIPLDNAAGSNNSNNNISSSNSFFNNGHLLQGKTLRLMNEANLGDKNDVTAILGELEQIKYNQIAISKDLLRINKDNELLWQENMMARERHRTQQQALEKMFRFLTSIVPHLDPKMIMDGLGDPKVNNEKLNSANNIGLNRDNTGTIDELKSNDSFINDDRNSFTNATTNARNNMSPNNDDNSIDTASTNTTNRKKNIDENIKNNNDIINDIIFNTNLANNLSNYNSNNNAGSPIRPYKQRYLLKNRANSSTSSENPSLTPFDIESNNDRKISEIPFDDEEEEETDFRPFTSRDPNNQTSENTFDPNRFTMLSDDDLKKDSHTNDNKHNESDLFWDNVHRNIDEQDARLQNLENMVHILSPGYPNKSFNNKTSSTNTNSNMESAVNVNSPGFNLQDYLTGESNSPNSVHSVPSNGSGSTPLPMPNDNDTEHASTSVNQGENGSGLTPFLTVDDHTLNDNNTSEGSTRVSPDIKFSATENTKVSDNLPSFNDHSYSTQADTAPENAKKRFVEEIPEPAIVEIQDPTEYNDHRLPKRAKK

SEQ ID NO: 3722 - protein, 37 aa, Spinacia oleracea
MKIRASVRPICEKCRLIRRRGRIIVICSNPKHKQRQG

SEQ ID NO: 3723 - protein, 731 aa, Saccharomyces cerevisiae
  strain ATCC 204508 / S288c
MDKLVVNYYEYKHPIINKDLAIGAHGGKKFPTLGAWYDVINEYEFQTRCPIILKNSHRNKHFTFACHLKNCPFKVLLSYAGNAASSETSSPSANNNTNPPGTPDHIHHHSNNMNNEDNDNNNGSNNKVSNDSKLDFVTDDLEYHLANTHPDDTNDKVESRSNEVNGNNDDDADANNIFKQQGVTIKNDTEDDSINKASIDRGLDDESGPTHGNDSGNHRHNEEDDVHTQMTKNYSDVVNDEDINVAIANAVANVDSQSNNKHDGKDDDATNNNDGQDNNTNNDHNNNSNINNNNVGSHGISSHSPSSIRDTSMNLDVFNSATDDIPGPFVVTKIEPYHSHPLEDNLSLGKFILTKIPKILQNDLKFDQILESSYNNSNHTVSKFKVSHYVEESGLLDILMQRYGLTAEDFEKRLLSQIARRITTYKARFVLKKKKMGEYNDLQPSSSSNNNNNNDGELSGTNLRSNSIDYAKHQEISSAGTSSNTTKNVNNNKNDSNDDNNGNNNNDASNLMESVLDKTSSHRYQPKKMPSVNKWSKPDQITHSDVSMVGLDESNDGGNENVHPTLAEVDAQEARETAQLAIDKINSYKRSIDDKNGDGHNNSSRNVVDENLINDMDSEDAHKSKRQHLSDITLEERNEDDKLPHEVAEQLRLLSSHLKEVENLHQNNDDDVDDVMVDVDVESQYNKNTTHHNNHHSQPHHDEEDVAGLIGKADDEEDLSDENIQPELRGQ

SEQ ID NO: 3724 - protein, 124 aa, Saccharomyces cerevisiae
  strain ATCC 204508 / S288c
MIRRAPTTLQLSHDDVTSLIDDLNEQKLKQQLNIEKTKYFQGKNGGSLHSNTDFQDTSQNIEDNNNDNDNDIDEDDDMSSYNDKAASVAHTRVLNSLHLSTDSNTAHETSNANDNHNPFYIREE

SEQ ID NO: 3725 - protein, 98 aa, Raphanus sativus
SAVYKVKLIGPDGQENEFDVPDDQYILDAAEEAGVDLPYSCRAGACSTCAGKIEKGQVDQSDGSFLEDHHFEKGYVLTCVAYPQSDLVIHTHKEEELF

SEQ ID NO: 3726 - protein, 98 aa, Raphanus sativus
SAVYKVKLIGPEGEENEFEVQDDQFILDAAEEAGVDLPYSCRAGACSTCAGQIVKGQVDQSEGSFLEDDHFEKGFVLTCVAYPQSDCVIHTHKETELF

SEQ ID NO: 3727 - protein, 50 aa, Equus caballus
MARYRCCRSQSQSRCRRRRRRRCRRRRRRSVRQRRVCCRRYTVLRCRRRR

SEQ ID NO: 3728 - protein, 92 aa, Daucus carota
MASQQEKKELDARARQGETVVPGGTGGKSLEAQQHLAEGRSKGGQTRKEQLGGEGYHEMGRKGGLSNNDMSGGERAEQEGIDIDESKFRTKK

SEQ ID NO: 3729 - protein, 166 aa, Sus scrofa
MSYTTYFLAFQLCVTLCFSGSYCQAPFFKEITILKDYFNASTSDVPNGGPLFLEILKNWKEESDKKIIQSQIVSFYFKFFEIFKDNQAIQRSMDVIKQDMFQRFLNGSSGKLNDFEKLIKIPVDNLQIQRKAISELIKVMNDLSPRSNLRKRKRSQTMFQGQRASK

SEQ ID NO: 3730 - protein, 269 aa, Rhizomucor miehei; identical to SEQ ID NO: 428

SEQ ID NO: 3731 - protein, 92 aa, Sus scrofa
MVRCRVRSPSESPQQGSGQQRENERQDQDQELRPEDVPVYGRTHRGRYHYRHRSHTRRRRSCRRRRRRACRHRRHRRGCRRIRRRRRCRRRL

SEQ ID NO: 3732 - protein, 115 aa, Bos taurus
MVRCHVKSPTESPPGQQGSGQQGETEHPDQARELRPEDIPVYGRTHRGRYHYRHRSHTRRRPYRRRRRRACRHRRRRRGAAGPPCAPIPGTPQASRQGSGCRRMRRRRRRCGRQL

SEQ ID NO: 3733 - protein, 97 aa, Daucus carota
AEVKLGADDGALVFSPSSFSVAKGEGISFKNNAGFPHNIVFDEDEVPAGVDVSKISQEDYLDGAGESFTVTLTEKGTYKFYCEPHAGAGMKGEVTVT

SEQ ID NO: 3734 - protein, 54 aa, Ovis aries
STSRKLKSQGTRRGKNRTPHKGVKRGCSKRKYRKSSLKSRKRCDDANRNFRSHL

SEQ ID NO: 3735 - protein, 94 aa, Triticum aestivum
MASGQEKGRSELDSLAREGQTVVPGGTGGKSYEAQEKLAEGRSRGGQTRKEQMGEEGYSEMGRKGGLSTNDESGGERAAREGIDIDESKFKTKS

SEQ ID NO: 3736 - protein, 42 aa, Oncorhynchus mykiss
MSDKPNLEEVASFDKTKLKKTETQEKNPLPTKETIEQEKQAS

SEQ ID NO: 3737 - protein, 132 aa, Bos taurus
MDTKTQSLPNTHAQPHSNSRPQSHACHHCSCSQHCQSRSRSRSCRSRSSSRRPRSHRSPTGRQGQSPGPSPPLRRHRHTMHSHQCPSRPVTHSCSHSKNRKNLEGKVIKRKQVKRSKQVYKRKRQSSGRKYN

SEQ ID NO: 3738 - protein, 214 aa, Octopus vulgaris
MPSYTLHYFNHRGRARSAVCCSQLLVSSTMTADRVFRMGQHEKQDAMSHDANVGIGQQNPNSPEYAMARYLAREFGFHGRNNMEMARVDFISDCFYDILDDYMRMYQDGNCRMMFQRSRDMSSSSEKRMRFQETCRRILPFMERTLEMYNGGSQYFMGDQMTMADMMCYCALENPLMEEPSMLSSYPKLMALRNRVMNHSKMSSYLQRRCRTDF

SEQ ID NO: 3739 - protein, 119 aa, Gallus gallus
MSKGCQTQGPLSELEKAIDVIIDVFHQYSRREGDKDTLTRKELKLLIEKQLANYLKHVKNQVSIDQIFKDLDNNKDQQLSFGEVMLLIIRVTVATHEHLHFCEDHQQQHQHQHQHQHNH

SEQ ID NO: 3740 - protein, 57 aa, Spinacia oleracea
MAVPKKRTSIYKKRIRKNIWKKKGYWAALKAFSLAKSLSTGNSKSFFVRKISNQTLE

SEQ ID NO: 3741 - protein, 148 aa, Gallus gallus
MATSDIQVKELEKRASGQAFELILGPRSKEAAPEFPLSPPKKKDLSLEEIQKKLEAAEERRKSHEAEVLKQLAEKREHEKEVLQKAIEENNNFSKMAEEKLTHKMEANKENREAQMAAKLERLREKDKHIEEVRKNKEGKDPGEAETN

SEQ ID NO: 3742 - protein, 672 aa, Saccharomyces cerevisiae
  strain ATCC 204508 / S288c
MKQEQSHEGDSYSTEFINLFGKDTATHPSSNNGANNNGMGSTNSLDQFVATASSSSSLVTSSENRRPLIGDVTNRGNTNLYDHAVTPEILLEQLAYVDNFIPSLDNEFSNVDWNVNTTHNNANNNGADTFSSINANPFDLDEQLAIELSAFADDSFIFPDEDKPSNNNNNSNNGNDDHSNHDVLHEDPSTNNRQRNPHFLTQRRNTFLTSQYDQSKSRFSSKNKRNGNNGETNNFGDNMQNNHPFEPNFMGSPSQFPADATNMTSIDHGGFTNVDITSTENNTTGDNGVDALSNLLHRTTHTPNRSSPLSNVTSAQNSSSQQRKHSESKVDSNSDNNSSNKAPNITVPDYSIIPTSVLVTLLPRVNVPNGAYNSLISAGFDNDQIDAIAAIMAYHHQKKIRENNSNNNKNINTNDSQEAPILKNINELLSVLIPPSPAETRGPTTLSTSPSFNEHGVVAEASFLSSILELGIKHPKSNNIHNQRQPSRNDHKISRESDGNNGNDNVHHNNAVIKSSTTRGDEIAKIRSEPTLNASSSDHKENSLKRSHSGDLKNKKVPVDRKYSDNEDDEYDDADLHGFEKKQLIKKELGDDDEDLLIQSKKSHQKKKLKEKELESSIHELTEIAASLQKRIHTLETENKLLKNLVLSSGETEGIKKAESLKKQIFEKVQKE

SEQ ID NO: 3743 - protein, 94 aa, Saccharomyces cerevisiae
  strain ATCC 204508 / S288c
MDRSLQVYICMYPYLDGSKQYRFDELISFYRPCPKSLDNIKSHYRQIHHQIRRRTHQHHQIRRRTHQHHHRSNCSRQRQCLVRHSCGRQMRVLA

SEQ ID NO: 3744 - protein, 114 aa, Solanum lycopersicum
MAEEKHQHHHHLFHHKNKEDEGGPVDYEKEVKHHSHLEKIGELGAVAAGALALHEKHKAKKDPEHAHKHKIEEEIMAVAAVGAGGFAFHEHHQKKDAKKEKKEVEGGHHHHHHY

SEQ ID NO: 3745 - protein, 108 aa, Solanum lycopersicum
MAEEKQHHRLFHHKNREEEGGPVDHKKKVKHHSHLQKIGELGAVAAGAYALHEKHKAKKDPENAHKHKIKQEIAAVAAVGAGGFAFHEHHQKKEAKKEKKAAEKGRHH

SEQ ID NO: 3746 - protein, 366 aa, Saccharomyces cerevisiae
  strain ATCC 204508 / S288c
MNYMAYDYDPQHSLETSFNNLAFHPHQQSQQQALYESGERNDARPGLMNTLGQASKMNNSMLPQGSSASPLTGQHSLNSTTNFNMPPSMNTYNYQNVPQASMRNTLNHNNIMNGATANDYWLDPMNNMTNNKDTNGNPNDSMSSMSNMTAKTSINSTAFKNSFVPFNHVTALSMNNVNSNEMNSNKDDRMEALEVELQIKESQIESLENEIQRLKKIFNEGLNYKQNEHKYEKENCHIPQTFELPASLEVIFRKLSSSLHAKEKELAETKENLESILTALALNPTNSVTKYGRYDAESIAHKMVVRLENLTNENKEMAKMLAYGRSKETQIELQLAKKENLELREKIASLEAHLASKESSKEDVAN

SEQ ID NO: 3747 - protein, 211 aa, Saccharomyces cerevisiae
  strain ATCC 204508 / S288c
MLRRSKNSSTNTNADTKKRQSMHLGSKSSLISLTSEFGHGHSKTKQKKEEGTAPSQFLSPTNKRSTSSQSKLKRSSLLLDETLLKDYHSAMRHMQTNAAKEEKLRMAPSPTQSTRSESDASLSSTKSSISSIFSQDNDYSIHDLLYEDIEEMDKTDAFKINNTIAIDDSKALFVFCSNDSSSRTASIETLHESNLDNLDMGSSRRTSLDFF

SEQ ID NO: 3748 - protein, 255 aa, Saccharomyces cerevisiae
  strain ATCC 204508 / S288c
MGKFEQKERERISTFSFPTTGSQSSTSIKSLGSPLYGRFSSLSSTESQFDSSKQPHEYEKSFYFEESQGEALFNKLKTYSFPGDKDGVKTRRNSSICPRKPNAVSPLRVESNELSSHSHSRSLSHELTKPSGRRKSYHRKSHAISFSRSCKPNFIDGYDSNSSIGVNSRKTSLASSFLDKEYHSSPDTSYTHQMSPKNTIMNTNEQLRRNASGRFGSLKEFAEKNQINIEGKIFAHKVETGDILQPLIDLDIDNK

SEQ ID NO: 3749 - protein, 74 aa, Saccharomyces cerevisiae
  strain ATCC 204508 / S288c
MNKYLFDHKIWSTPYYFYCEEDCHRLFLSFIEGRTFEKPTSNAEENVQETEAGESFTLNPGEDFQNCFPRQRIL

SEQ ID NO: 3750 - protein, 112 aa, Saccharomyces cerevisiae
  strain ATCC 204508 / S288c
MDLRSALEKTNIIKSYKLHFLIRYTTSRFEVKEPFLAYLHMARQKDKLLPKCITPPNKKADPFTNDVSSYFTHTHTHTPCSPSLVYTYVNTTEKSPSKSPKHKNILPFNFTK

SEQ ID NO: 3751 - protein, 70 aa, Pinus thunbergii
MAVPKKRTSRSKKKIRKNVRKGKAYRAAIKAFSLAKSISTGHSKSFYCIVNDDSSGSSESKLTAIDLDDP

SEQ ID NO: 3752 - protein, 93 aa, Triticum aestivum
MASGQQERSELDRMAREGETVVPGGTGGKSLEAQEHLADGRSRGGETRKEQLGEEGYREMGRKGGLSTMEESGGERAAREGIEIDESKFKTKS

SEQ ID NO: 3753 - protein, 151 aa, Pisum sativum
MGRLHSKGKGISSSALPYRRTAPSWLKISSQDVDETICKFAKKGLTPSQIGVILRDSHGIAQVKSVTGSKILRILKAHGLAPEIPEDLYHLIKKAVSIRKHLERFRKDKDSKFRLILVESRIHRLARYYKKTKKLPPVWKYESTTASTLVA

SEQ ID NO: 3754 - protein, 91 aa, Zea mays
MASGQESRKELDRKAREGETVVPGGTGGKSVEAQEHLAEGRSRGGQTRREQLGQQGYSEMGKKGGLSTTDESGGERAAREGVTIDESKFTK

SEQ ID NO: 3755 - protein, 95 aa, Oryza sativa
  subsp. japonica
MASGQQQQGRSELDRMAREGQTVVPGGTGGKSLEAQENLAEGRSRGGQTRKEQMGEEGYREMGRKGGLSTGDESGGERAAREGIDIDESKYKTKS

SEQ ID NO: 3756 - protein, 190 aa, Ovis aries
METQMASPSLGRCSLWLLLLGLLLPSASAQALSYREAVLRAVGQLNEKSSEVNLYRLLELDPPPKDAEDQGARKPVSFRVKETVCPRMSQQPPEQCDFKENGLVKQCVGTVSLDTSNDEFDLNCNELQSVRRLRPRRPRLPRPRPRPRPRPRSLPLPRPQPRRIPRPILLPWRPPRPIPRPQPQPIPRWL

SEQ ID NO: 3757 - protein, 51 aa, Oryza sativa
  subsp. japonica
MPSHKTFRIKKKLAKKMRQNRPIPYWIRMRTDNTIRYNAKRRHWRRTKLGF

SEQ ID NO: 3758 - protein, 417 aa, Bos taurus; identical to SEQ ID NO: 107

SEQ ID NO: 3759 - protein, 116 aa, Saccharomyces cerevisiae
  strain ATCC 204508 / S288c
MLLTPAKTTRTEDSANSTDDSSKSSNSFMRAIVSSLMVKPITSLTNTVTCRQSSHHNSSPSKITRYDLIKAAAENDLKRSKSQGREKSRRNSNRRNNEEIFVANTASEIQRTKSSI

SEQ ID NO: 3760 - protein, 386 aa, Saccharomyces cerevisiae; identical to SEQ ID NO: 850
  strain ATCC 204508 / S288c

SEQ ID NO: 3761 - protein, 86 aa, Saccharomyces cerevisiae
  strain ATCC 204508 / S288c
MPPRSIEEWFYYKLLSSPGFHRFVRKVYRKVNGIKEDPFTDQSTAFQYLYKPTPRQKFKALRLLFWDEMRSTFGFRRRLGDRFKKD

SEQ ID NO: 3762 - protein, 79 aa, Lactobacillus johnsonii
MFVKTGDKVKVIAGKDKGKEGTVLSVNAKTNRIVVKGVNKIKKHEKPSQTNANGGVVEKEGSIHASNVKVIAKKEDNNK

SEQ ID NO: 3763 - protein, 149 aa, Anas platyrhynchos [sequence omitted]

SEQ ID NO: 3764 - protein, 44 aa, Bos taurus
MSDKPDMAEIEKFDKSKLKKTETQEKNPLPSKETIEQEKQAGES

SEQ ID NO: 3765 - protein, 71 aa, Bos taurus
MASNNTASIAQARKLVEQLKMEANIDRIKVSKAAADLMAYCEAHAKEDPLLTPVPASENPFREKKFFCAIL

SEQ ID NO: 3766 - protein, 44 aa, Equus caballus
MADKPDMGEIASFDKAKLKKTETQEKNTLPTKETIEQEKRSEIS

SEQ ID NO: 3767 - protein, 51 aa, Capra hircus
MARYRCCLTHSRSRCRRRRRRRCRRRRRRFGRRRRRRVCCRRYTVVRCTRQ

SEQ ID NO: 3768 - protein, 616 aa, Aspergillus niger; identical to SEQ ID NO: 363

SEQ ID NO: 3769 - protein, 92 aa, Bos taurus
MTKLEDHLEGIINIFHQYSVRVGHFDTLNKRELKQLITKELPKTLQNTKDQPTIDKIFQDLDADKDGAVSFEEFVVLVSRVLKTAHIDIHKE

SEQ ID NO: 3770 - protein, 68 aa, Saccharomyces cerevisiae
  strain ATCC 204508 / S288c
MGAAYHFMGKAIPPHQLAIGTLGLLGLLVVPNPFKSAKPKTVDIKTDNKDEEKFIENYLKKHSEKQDA

SEQ ID NO: 3771 - protein, 49 aa, Equus caballus
YLDHWLGAPAPYPDPLEPRREVCELNPDCDELADHIGFQEAYRRFYGPV

SEQ ID NO: 3772 - protein, 49 aa, Bison priscus
YLDHGLGAPAPYPDPLEPKREVCELNPDCDELADHIGFQEAYRRFYGPV

SEQ ID NO: 3773 - protein, 76 aa, Equus caballus
QAEESCLQNLASRYLQTVTDYGKDLVEKALAPELQAQAKAYFEKTQEQLTPLVKKIGNDLLNFFSHFIELKTQPAT

SEQ ID NO: 3774 - protein, 134 aa, Bos taurus
MDFVMKQALGGATKDMGKMLGGEEEKDPDAQKKEEERQEALRQQEEERKAKHARMEAEREKVRQQIRDKYGLKKKEEKEAEEKAALEQPCEGSLTRPKKAIPAGCGDEEEEEEESILDTVLKYLPGPLQDMFKK

SEQ ID NO: 3775 - protein, 49 aa, Lama guanicoe
YLDHGLGAPAPYVDPLEPKREVCELNPDCDELADQMGFQEAYRRFYGTT

SEQ ID NO: 3776 - protein, 291 aa, Bacillus subtilis; identical to SEQ ID NO: 405
  strain 168

SEQ ID NO: 3777 - protein, 88 aa, Solanum lycopersicum
MQTGKDAASAAKAGMEKTKANVQEKAERMTTRDPLKKEMATEKKEDRVAAAEMGKRDAKAQHAAEKQGAATTGTGTTGYGATGNHTTF

SEQ ID NO: 3778 - protein, 175 aa, Saccharomyces cerevisiae
  strain ATCC 204508 / S288c
MNESENSPQHNEVTVPMVEDTSSNADIPMEQIQREDNKNYDKHDNECFDMNGNHNNNSDNLQFDSVPSSATKDLKNIKSVTNQNVKIEESSSTNSVIEESSEPKISKLENVNLAATVGGSQTRKYLNTNVTPHLLAGMRLIAVQQPEDPLRVLGEYLIEQSNILKSGEKESNASK

SEQ ID NO: 3779 - protein, 46 aa, Lactobacillus casei
  strain ATCC 334
MTTKRTFQPKKRHRERVHGFMKRMSTKNGRKVLARRRAKGRKVLSA

SEQ ID NO: 3780 - protein, 89 aa, Lactobacillus casei
  strain ATCC 334
MAKKSKIAKAKRQEKLVQQYAVKRAALKAKGDYIGLSKLPRDSSPVRLHHRDVLDGRPHAYMRKFGMSRLNFRELAHKGQIPGVRKASW

SEQ ID NO: 3781 - protein, 49 aa, Lactobacillus casei
  strain ATCC 334
MTAKKVALACSVCGQRNYFVPENPKRTERLTLKKFCKHCGRVTVHQETK

SEQ ID NO: 3782 - protein, 114 aa, Lactobacillus casei
  strain ATCC 334
MANVYDTANQMAADIKTTQEFQDLKKAFDLLKLDTVAYGLFQQFQQKQYEMQQKSMQGQDFTDDEVKSLQELGDKMRGIQPIQNLMAKEQGLSQMMDELNKIISQPIIDVYQGK

SEQ ID NO: 3783 - protein, 66 aa, Lactobacillus casei
  strain ATCC 334
MPKFKTHRASAKRFKKTASGALKRGHAYTSHRFHGKTKKQRRQLRKSALVSHSDMKRIRQMLSQMK

SEQ ID NO: 3784 - protein, 113 aa, Lactobacillus casei
  strain ATCC 334
MEIEKNYRMNSLFEFYGPLLTDKQHAYLALYYGDDYSLGEIATEFNVSRQAVYDNIRRTEASLEEYEKKLHLFANYQAQNEAVDTLVSYARTHYPDDKALSTLLERVADQTAK

SEQ ID NO: 3785 - protein, 89 aa, Lactobacillus casei
  strain ATCC 334
MATKTYYFYVLLCADGSFYGGFTDDVKARVATHNAGKGAKYTAQRLPVRLLYHQAFADKHDALSAEWHFKHQTRHRKEVFLEDHQVEWR

SEQ ID NO: 3786 - protein, 80 aa, Lactobacillus casei
  strain ATCC 334
MHRTFYEYLMTLRNPNDHSEIAEFAKNAFLDQSFPKQEKDYHRLSDYLELNGNYLPSMAVFDETYRAYEASESTGGDSYQ

SEQ ID NO: 3787 - protein, 109 aa, Lactobacillus gasseri
  strain ATCC 33323 / DSM 20243
MSRRPNFGGMGMGNMQGLIKQAKKMQQQMEAEQANLATQEFVGKSADDMVVATFSGDRQLKDLKIDKEAIDPDDPDMLQDLVIDAVNKGIKAVDDATQASMGKYTKGLM

SEQ ID NO: 3788 - protein, 79 aa, Lactobacillus gasseri
  strain ATCC 33323 / DSM 20243
MFVKTGDKVKVIAGKDKGKEGTVLSVNAKTNRIVVKGVNKIKKHEKPSQANANGGVVEKEGSIHASNVKVIAKKEDNNK

SEQ ID NO: 3789 - protein, 95 aa, Lactobacillus gasseri
  strain ATCC 33323 / DSM 20243
MSRSIKKGPFADASLLKKIEAQEGSEKKQVIKTWSRRSTIFPSFVGFTIAVYDGRKHVPVYITEDMVGHKLGEFVPTRTFRGHKVADKATTTVGK

SEQ ID NO: 3790 - protein, 79 aa, Lactobacillus delbrueckii
  subsp. bulgaricus
  strain ATCC BAA-365
MFVKTGDKVKVIAGSEKGKEGTVLSVNVKKNRVVVKGVNMIKKATKASASNANGGVVETEGSIHASNVKVIAKAESNKD

SEQ ID NO: 3791 - protein, 83 aa, Lactobacillus delbrueckii
  subsp. bulgaricus
  strain ATCC BAA-365
MKKGIHPDYQEVCFMDAATGFKFVAGSTLKSSETVEFEGNTYPLIRVEISSDSHPFYTGKQKFAAADGRIERFNKKYGFNKKN

SEQ ID NO: 3792 - protein, 383 aa, Saccharomyces cerevisiae
  strain ATCC 204508 / S288c
MTSASITNTGNETMNLPQMRSIWLDEDEEAEKLYGLQAQQFMGSDDEENLGITFINSDKPVLSNKKNIELPPLSPNSHPSCHHRRSNSNSAKSKESSSSSSSANKTNHKKVFLKLNLLKKKLLGAQPDIRGKGISTPFDFQHISHADTRNGFQDEQLQEPSSLSTEIKDDYTSSSSKRDSKSLNKAFVTERIPANRESKLISRSHENKTSRLSVARSISVTSSNYSKNTQGNNHSINGRVVSTSTMATSIFEYSPNASPKQFKNKSHALGHRYTNSTDSSESSLDFLKNYNFPTLLEDKPILDFLPRSQRSSAYRSLLETPNSNKDSAKAFFPSRQSPLPKRRNSIATPSPQSKFSYSDSPVNHRKSFDDVLYSFNQLEPLQT

SEQ ID NO: 3793 - protein, 115 aa, Solanum lycopersicum
MEEEKHHHHHLFHHKDKAEEGPVDYEKEIKHHKHLEQIGKLGTVAAGAYALHEKHEAKKDPEHAHKHKIEEEIAAAAAVGAGGFAFHEHHEKKDAKKEEKKKLRGDTTISSKLLF

SEQ ID NO: 3794 - protein, 105 aa, Saccharomyces cerevisiae
  strain ATCC 204508 / S288c
MLMPKEDRNKIHQYLFQEGVVVAKKDFNQAKHEEIDTKNLYVIKALQSLTSKGYVKTQFSWQYYYYTLTEEGVEYLREYLNLPEHIVPGTYIQERNPTQRPQRRY

SEQ ID NO: 3795 - protein, 52 aa, Citrus sinensis
MAVPKKRTSILKKRIRKNLWKKGGYWAALKAFSLAKSLATGNSKSFFCTTNK

SEQ ID NO: 3796 - protein, 55 aa, Daucus carota
MAVPKKRTSISKKRIRKNIWKGKGSWAALKALSLGKSLSTGNSKSFFVRQKKNKS

SEQ ID NO: 3797 - protein, 194 aa, Bos taurus
MTENSTSTPAAKPKRAKASKKSTDHPKYSDMIVAAIQAEKNRAGSSRQSIQKYIKSHYKVGENADSQIKLSIKRLVTTGVLKQTKGVGASGSFRLAKSDEPKRSVAFKKTKKEVKKVATPKKAAKPKKAASKAPSKKPKATPVKKAKKKPAATPKKTKKPKTVKAKPVKASKPKKTKPVKPKAKSSAKRTGKKK

SEQ ID NO: 3798 - protein, 149 aa, Oryza sativa
  subsp. japonica
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVEEMIREADVDGDGQINYDEFVKVMMAK

SEQ ID NO: 3799 - protein, 86 aa, Sus scrofa
MSKQPVSNVRAIQANINIPMGAFRPGAGQPPRKKECTPETEEAVLPTSDEEKKPIPGAKKLPGPAVNLSEIQNIKSELKYVPRAEQ

SEQ ID NO: 3800 - protein, 587 aa, Bos taurus
MDLPGDSSTPGRQRLCRQPHAGALWGAKSPKRPKLQPLGAPSPLEKASRRVLAVVLEDVMAARMVPLEPQEESSTPRHHSNHRDSVRSQPPASPPRQAMWSPQARPPDPLHLCREPLSRIRRPPSTPRRQSRTTPGPDEGPSQKVDQVHQPTLVVMLQDIASSRPRAEGFADEAPNFIIPARRAEPKVMVHQPKPPSRDLPAPSRPSALSANPLASPPPAPDPVLEPPSTPPPSSLLRPRLSPWGLAPLFHSVRSKLESFADIFLTPNKAPRPPPPSPPMKLELKIAISEAGQPGASEGTVTVSPRPPIRQWRAQDQNPSATLTKPSLGRSHSCPDLGPPGPDPCSWPPVPAPSSRPRPRRHTVGGGEMAKAPPPPRPCLRKEVFPLGGVGASPPLVTSCSSTASTSSFSEPAEPRLSSTKRKEPRAPEDQVLPDSETKTIGKVSRFRIRRTPARSQINLTPMGLPRPVRLNKKEFSLEEIYTNKNYQSPTTRRTFETIFEEPRERNGTLIFTSSRKLRRTVEFRDSSLPRSRRPSRGARATAGRTLPPSLAPSPDVEPLLQQRLQELDASLLEEEEEGDQDQPHRT

SEQ ID NO: 3801 - protein, 447 aa, Saccharomyces cerevisiae
  strain ATCC 204508 / S288c
MSSQNLNDNPKNTSSAAEDKKKQTSSLKLAPIPTTSPWKSSSPDSNTVIPVEELRDISKTAKPSKNGSGSIKLTSNTKWTPITPSVIISGSKDTNSKSGKNSKNSKTNKKMKKRGKYNNDINKKDFNGQTNSTSEISNVSNLESKPLDANAKVNIHSSSGATANGNIKRITNNNNSTNGRQSRNYQNRNGKTRYNNNSRHSQAANNAISFPNNYQARPEYIPNASHWLNNNSRNSYKQLSYFRQQQYYNNINYQQQLQTPYYYSMEPIFKSIESIKNQIEFYFSEENLKTDEFLRSKFKKANDGFIPMSLIGKFYRMVNLSLGGDPNLILASMREVLQHKETNHLEIALGSIEGAQKNMADDFNPLENYFIRRENWAEYAMESNFDENDDETEKYNIEKLLGPNDLDNYSYMGYPNFFPSNENGKKSQSYDQGEISRQFEQNLQIND

SEQ ID NO: 3802 - protein, 63 aa, Saccharomyces cerevisiae
  strain ATCC 204508 / S288c
MAKVHGSLARAGKVKSQTPKVEKTEKPKKPKGRAYKRLLYTRRFVNVTLVNGKRRMNPGPSVQ

SEQ ID NO: 3803 - protein, 295 aa, Saccharomyces cerevisiae
  strain ATCC 204508 / S288c
MATFNPQNEMENQARVQEYKVSTGRGGAGNIHKSMSKPSPVLLPLKSNSKTVANNNNNGSNQEKVPRFAIGRGGAGNIFHDPHLTRSAQQLDSNDNINYNDVINDIDDYISPITSDMVDEGGSNPVTNTRSRISATRSHQSLHATTSSPNNNAPIVVGRGGAGNIFFNKKKVASNGGNEEDEIRGGNIEDEDTINANEDNLFVVTSNGNALAAIKSTSKKPKNKLKGKSAPEKFAIGRGGAGNIISPKSSRNTINHNLNDDDEDKFNLKDDNGKEKKKKKKKKSGFFSSLKTMFN

SEQ ID NO: 3804 - protein, 62 aa, Bos taurus
MSERQGAGTTNGKDKPSGENDGQKKVQEEFDIDMDAPETERAAVAIQSQFRKFQKKKAGSQS

SEQ ID NO: 3805 - protein, 37 aa, Populus alba
MKIRASARKICEKCRLIRRRGRILIICSNPRHKQRQG

SEQ ID NO: 3806 - protein, 103 aa, Lactobacillus delbrueckii
  subsp. bulgaricus
  strain ATCC 11842 / DSM 20081
MYAVIKTGGKQYKVAEGESIFVEKLDVQAGEEVVFDQVILVANGDDVKVGTPLVEGAKVVASVDKQGKEKKVVTFKYKPKKHSHSKYGHRQPYTKVTVKSIEA

SEQ ID NO: 3807 - protein, 83 aa, Lactobacillus delbrueckii
  subsp. bulgaricus
  strain ATCC 11842 / DSM 20081
MPQIKSAIKRVKTQAVANERNAAQLSTMRTAVKKFKAAQAAGADNASELYVAAIRELDKAASKGLIHKNKATRDKSRLAKLAK

SEQ ID NO: 3808 - protein, 79 aa, Lactobacillus delbrueckii
  subsp. bulgaricus
  strain ATCC 11842 / DSM 20081
MFVKTGDKVKVIAGSEKGKEGTVLSVNVKENRVVVKGVNMIKKATKASASNANGGVVETEGSIHASNVKVIAKAESNKD

SEQ ID NO: 3809 - protein, 91 aa, Lactobacillus delbrueckii
  subsp. bulgaricus
  strain ATCC 11842 / DSM 20081
MSRSIKKGPFADAHLLKKVDEQQAAEKKQVIKTWSRRSTIFPSFVGLTIAVYDGRKHVPVFVTEDMVGHKLGEFVPTRTFRGHKADDKASK

SEQ ID NO: 3810 - protein, 378 aa, Bos taurus
MASKPEKRVASSVFITLVPPRRDEAVVEEVRRAACEAWPGRPWESAPTKAPGAGSVGKLRSWMPPGRAAAPGPAVPPQLSNGGCSLPPPPLDVDDALPDLDLLPPPPPPPAADLPPPDEEPHSAMGASLISDLEQLHLPPPPPPPQALVEGPPLQPRPSHLKPAEEELPPPPEEPVSFPEREASTDICAFCHKTVSPRELAVEAMKRQYHAQCFTCRVCRRQLAGQSFYQKDGRPLCEPCYQDTLEKCGKCGEVVREHIIRALGQAFHPSCFTCVTCARRIGDESFALDSQNEVYCLDDFYRKFAPVCSICENPIIPRDGKDAFKIECMGRNFHENCYRCEDCRVLLSVEPTDQGCYPLNNRLFCKPCHVKRSAAGCC

SEQ ID NO: 3811 - protein, 98 aa, Bos taurus
MLSRLQELRKEEETLLRLKAALHDQLNRLKVEELALQSMISSRREGEMLPSQPAPEPSHDMLVHVDNEASINQTALELSTRSHVQEEEEEEEEEEEDS

SEQ ID NO: 3812 - protein, 159 aa, Bos taurus
MEKACKEPEEQPQSPPKADEERPSVEPSPEKSSPEEQSSEEVSSEEEFFPDELLPELLPEMLESEERPPQERLSRKDLFEARPPMEQPPCGVGKHKLEEGSFKERLARSRPQFRGDIHGRNLSNEEMIKVAEEMEEMKRVRNKLMVMHWKARRNRPYPI

SEQ ID NO: 3813 - protein, 131 aa, Bos taurus
MLSGGGGDADLANAAARGQVEAVRQLLEAGVDPNRLNRFGRRPIQVMMMGSARVAELLLLHGADPNCADPATLTRPVHDAAREGFLDTLVALHRAGGRLDVRDAWGRLPVDLAEERGHRDVARYLRATAGD

SEQ ID NO: 3814 - protein, 54 aa, Gossypium hirsutum
MAVPKKRTSTSKKRIRKNVWKKKGYWAALKAFSLAKSLSTGNSKSFFVRQINLE

SEQ ID NO: 3815 - protein, 87 aa, Solanum bulbocastanum
MVKNSVISVIFQEEKKGSVEFQVFNFTNKIRRLTSHLELHKKDYLSQRGLKKILGKRQRLLAYLAKKNRVRYKELINQLDIRETKTH

SEQ ID NO: 3816 - protein, 53 aa, Glycine max
MAVPKKRTSISKKRIRNTLWKKKGYFTTLKAFSLAQSIFTGNSKSFFCNKYKR

SEQ ID NO: 3817 - protein, 90 aa, Glycine max
MVKNSIIPVISQEKKEKNPGSVEFQIFKFTDRIRRLTSHFELHRKDYLSQRGLRKILGKRQRLLSYLSKKDRIRYKKLINQFDIRESQIR

SEQ ID NO: 3818 - protein, 216 aa, Glycine max
MGQKINPLGFRLGTTQSHDSIWFAQPTNYSENIQEDKKIRDCIKNYIQKNIRISSGVEGIGQIKIQKRIDLIQVIIYMGFPKLLIEGKSQKIEELQTNMQKKLNCVNRKLNIAIVKVANAYKHPNIIAEFIAGQLKNRVSFRKAMKKAIELTEQAGTKGVQVQIAGRIDGKEIARVEWIREGRVPLQTIRAKIDYCCYTVRTIYGVLGIKVWIFSK

SEQ ID NO: 3819 - protein, 388 aa, Bos taurus
MAEDGLPKIYSHPPAESTKTTTEATIFFGADNTIPKSETTITSEGDHVTSVNDYMLENDFSTTTGNKLIPPKERQKSEDDVESHLEKEFATLMDIKNPMANESITENFLPVKTGNISSTDAISLIDFSTDIAKEDILLDTIDPGDKDVSLTSEVSGTPKESTAAIADTPILPNIMGKSDVSNYSSSVKFKVPADGNAHITDSSVPEAEITPTTERNLTTIPDITALTEEKITEIDLILPENDPNVVPKLTDSDEEKFITVFELTTTAERDKDNPEDALLTDEESTDEVSVWMERDMANEEESHSVLLTAVESRYDFVIPASVTMNLTEDLLTEEDLPENNRMESVTKNTDELSGTTPDLDAFSHKEDNFTTETGVFKLLKEEPDEFLI

SEQ ID NO: 3820 - protein, 62 aa, Saccharomyces cerevisiae
  strain ATCC 204508 / S288c
MDTEEKKKTTASVEHARMLQNEIQQLFAQLRDTNSQIRCDLNEFEQIKESSTTADSTTNSAN

SEQ ID NO: 3821 - protein, 241 aa, Bos taurus
MPIFKCPQKSEPLWKEWDQKAQKNGLRHQVFAVNGDHYVGEWKDNVKHGKGTQVWKKNGAIYEGDWKSGKRDGYGTLSLPDQETGKYKRAYSGWWKGDKKCGYGIQFFGPKEYYEGDWCGNQRSGWGRMYYSNGDIYEGQWRNDKPEGEGMLRLKNGNRYEGNWQRGVKNGSGRFFHLDHGQLFEGFWVDDVAKCGTMIDFGRDEAPQPTQFPIPEVKILDPDGVLEEALAMFKKTKEEGD

SEQ ID NO: 3822 - protein, 196 aa, Bos taurus
MSQSESPGLQEESLHGSWVELHFGSNGNGSSVPDSVSIYKGDMEKILLDAQHESGRSSSKSSHCDSPPRSQTPQDTNRASETDTHSLGEKNSSQSEEDYMERRKEVESILKKNSDWIWDWSSRPENVPPAKEFLLFKHPKRTPTLSMRNTSVMKKGGIFSAEFLKVFLPSLLLSHLLAIGLGIYIGRRLTTSTSTF

SEQ ID NO: 3823 - protein, 88 aa, Bos taurus
MANSDVKPKSISRAKKWSEEIENLYRFQQAGYRDEIEYKQVKQVSMVDRWPETGYVKKLQRRDNTFYYYNKQRECDDKEVHKVKIYAY

SEQ ID NO: 3824 - protein, 66 aa, Bos taurus
MDPPARKEKPKVKEPVSRIEKAKQKSAQQELKQRQRAEIYALNRVMTELEQQQFDEFCKQMQPPGE

SEQ ID NO: 3825 - protein, 93 aa, Bos taurus
MGSRCAKLGTGHGRGHESSMKKLVACVSQDNFSLSSEGEEEEEGEEEEEEEGEEEELPVQGKLLLMEAGQQEEGAEDADSEVQQSPEPKQTRS

SEQ ID NO: 3826 - protein, 125 aa, Bos taurus
MAAAGLAQIPDVDIDSDGVFKYVLIRVYAAPPSGDPAVETKEIVRGYKWAEYHADIYDKVSGEIQKKGYDCECLGGGRISHQSQDRKIHVYGYSMGYGRAQHSVSTEKIKAKYPDYEVTWADDGY

SEQ ID NO: 3827 - protein, 57 aa, Bos taurus
MKPAVDEMFPEGAGPYVDLDEAGGSTGLLMDLAANEKAVHADFFNDFEDLFDDDDIQ

SEQ ID NO: 3828 - protein, 218 aa, Lactuca sativa
MGQKINPIGFRLGTTQGHHSLWFAQPKNYSEGLQEDKKIRTYIQNYVQKNMKTSSGVEGIARIEIQKRIDLIQIIIYMGFPKILIESRPRGIEELQMNLQKEFHSVNRKLNIAITRIEKPYGNPNILAEFIAGQLKNRVSFRKAMKKAIELTEQADTKGIQVQIAGRIDGKEIARVEWIREGRVPLQTIRAKIDYCCYTVRTIYGVLGIKIWIFIDGE

SEQ ID NO: 3829 - protein, 68 aa, Saccharomyces cerevisiae
  strain ATCC 204508 / S288c
MHLCQNGHYYKPHRASAEKVPYLKKKKKNSRNEGKAKKKNEKKKIGTVEFFQQKKKEKKRVLNAVCGL

SEQ ID NO: 3830 - protein, 64 aa, Saccharomyces cerevisiae
  strain ATCC 204508 / S288c
MSSRQGGKMKPLKQKKKQQQDLDPEDIAFKEKQKADAAAKKALMANMKSGKPLVGGGIKKSGKK

SEQ ID NO: 3831 - protein, 68 aa, Saccharomyces cerevisiae
  strain ATCC 204508 / S288c
MAKSVFNFFHFEILEYLNRFVYHSQYFLPYYCSLEVLGKSRKNWTFQYWCLYITTDKKIIKKKDFYHR

SEQ ID NO: 3832 - protein, 140 aa, Sus scrofa
MDVFMKGLSKAKEGVVAAAEKTKQGVAEAAGKTKEGVLYVGSKTKEGVVHGVTTVAEKTKEQVTNVGEAVVTGVTAVAQKTVEGAGSIAAATGFGKKDQLGKNEEGAPQEGILEDMPVDPDNEAYEMPSEEGYQDYEPEA

SEQ ID NO: 3833 - protein, 92 aa, Bos taurus [sequence omitted]

SEQ ID NO: 3834 - protein, 592 aa, Bos taurus
MAPPVKGKRKQSEEGEPLDPPVSPQPDGEPRSRSPVRLEEPPEAGREREEEQEEEQAFLVSLYKFMKERHTPIERVPHLGFKQINLWKIYKAVEKLGAYELVTGRRLWKNVYDELGGSPGSTSAATCTRRHYERLVLPYVRHLKGEDDKPLPPSKPRKQYKMAKEPRGDDGATERPKKVKEEKRVDQLMPAKTKTDAPDPARLPSQETPRDGMEQRGPAAGPSLPFLGASGCPEAYKRLLSSFYCRGTHGIMSPLAKKKLLAQVSKAEALQCQEEGCRHGAGGEPQAPPAAPPLESPQSPGGPAEDSRHRLTPLEGRQAPGGGLWGETQAGPRPSAPVVTGCFHAYPSEVLKPISQRPRDLFPSLKDRVLLGPPAKEEGLPAKEPPLVWGGDAGRPSAFHKGSSRKGSLYPKPKACWVSPMTKVPAESPVPLPTFPSSPGLGHKRSLAEDSSVHGSKKLRAVSPFLKEANAQECGTKPRGPDLAVSCLLGPALPEAYRGTLLRCPLNFAGTLGPLKGQATLPFSPLVIPAFPAHLLATTAPSPMTAGLMHLPPASFDSALCHRLCPASSPWHVPPATAYTAPHFSFHLNTKL

SEQ ID NO: 3835 - protein, 51 aa, Bos taurus [sequence omitted]

SEQ ID NO: 3836 - protein, 140 aa, Bos taurus
MSGSFYFVIVGHHDNPVFEMEFLPAGKAESKDDHRHLNQFIAHAALDLVDENMWLSNNMYLKTVDKFNEWFVSAFVTAGHMRFIMLHDVRQEDGIKNFFTDVYDLYIKFAMNPFYEPNSPIRSSAFDRKVQFLGKKHLLS

SEQ ID NO: 3837 - protein, 57 aa, Acorus calamus
MAVPKKRTSISKKRIRKNFWKKKGYFAAVKAFSLAKSVSTGQSKSFFVRQTSNKSLE

SEQ ID NO: 3838 - protein, 37 aa, Acorus calamus
MKIRASVRKICEKCRLIRRRGRIIVICYNPKHKQRQG

SEQ ID NO: 3839 - protein, 86 aa, Bos taurus
MSKQPVSNVRAIQANINIPMGAFRPGAGQPPRRKECTPEIEEGAPPTSDEEKKPIPGAKKLPGPAVNLSEIQNIKSELKYVPKAEQ

SEQ ID NO: 3840 - protein, 445 aa, Zea mays; identical to SEQ ID NO: 90

SEQ ID NO: 3841 - protein, 134 aa, Cucumis sativus
MGKDTIANIITSIRNADMNRKGMVRIPATNITENIVKILLREGFIENVRKHRESNKDFWVLTLRHRRNRKGPYKTILNLKRISRPGLRIYSNYQKIPRILGGMGIVILSTSRGIMTDREARLQGIGGEILCYIW

SEQ ID NO: 3842 - protein, 90 aa, Cucumis sativus
MVKNSFSSVISQEEKKENGGSVEFQVVSFTNKIRRLTSHLELHKKDYLSQRGLRKILGKRQRLLSYLSKKNKMRYKELINQLDIRESKTQ

SEQ ID NO: 3843 - protein, 218 aa, Cucumis sativus
MGQKINPLGFRLGATQGHHSLWFAHPKKYSEGLQEDQKIRDCIQNYVQKNMRIFSGVEGIARIEIQKRIDLIQVIIFMGFPKLVIDDGSRKIEELQINVQKEFNSGNRKLNIAITRIGNPYGHPNILAEFIAGQLKNRVSFRKAMKKAIELTEQAGTKGIQVQIAGRIDGKEIARVEWIREGRVPLQTIRAKIDYCCYPVRTIYGILGIKIWIFVDEQ

SEQ ID NO: 3844 - protein, 291 aa, Bos taurus
MKSEAKDGEEESLQTAFKKLRVDASGSIASLSVGEGASVRASVRAAVEDAKPKSACASKDSWHGSTRKSSRGAVRTQRRRRSKSPVLHPPKFIHCSTIASSSSQLKHKSQTDSPDGSSGLGISTPKEFNAGECSSSLDTNHTGAVAEPLRTSVPRLPSESKEEDSSDAPQVSQASLQANDLSDFQSVSKLNLGKPCVCIGKECQCKRWHDMEVYSFSGLQNVPPLAPERRSTLEDYSQSLHTRTLSGSPRSCSEQARVYVDDVTIEDLSGYMEYYLYIPKKMSHMAEMMYT

SEQ ID NO: 3845 - protein, 102 aa, Bos taurus
MSSPPEGKLETKAGHPPAVKAGGMRIVQKHPHSGDTREEKDKDDQEWESPSPPKPTVFISGVIARGDKDFPPAAAQVAHQKPHASIDRHPSPRTQHIQQPRK

SEQ ID NO: 3846 - protein, 326 aa, Gallus gallus
MVDYYEVLGVQKHASAEDIKKAYRKLALKWHPDKNPENKEEAEQQFKQVAEAYEVLSDAKKRDIYDRFGKEGLINGGGGGSHHDNPFEFGFTFRNPDDVFREFFGGRDPFSFDFFEDPFEDFFGGRRGPRGSRSRAGGSFLSAFGGFPAFGNAFPSFDTGFTSFGSLGHGGLTSFSSTSFGGSGMGNFKSVSTSTKIVNGRKITTKRIVENGQERVEVEEDGQLRSLTINGEANEEAFAEECRRRGQHALPFQPTNTRLLKPHKPASSPRYAYHYNSDEVEEQEKSRVASSLETPFYLSGYKEGSKRRKQKQREEQKKKKSTKGSY

SEQ ID NO: 3847 - protein, 66 aa, Lactobacillus acidophilus
MPKMKTHRASAKRFKRTANGGLKRHHAFTGHRFHGKTKKQRRHLRKPAMVSRSDMKRIKQMVAQMH

SEQ ID NO: 3848 - protein, 76 aa, Lactobacillus acidophilus
MAYRESFYRYLMTQRDADSSDEVAQFANNAQHDLTFPKQEQDYEELSDYLELNASYLPSMSVFDRAYKMYEEKMMY

SEQ ID NO: 3849 - protein, 38 aa, Lactobacillus acidophilus
MKVRPSVKPMCEHCKVIKRHGRVMVICPANPKHKQRQG

SEQ ID NO: 3850 - protein, 94 aa, Lactobacillus acidophilus
MSRSIKKGPFADASLLKKVDAQADADKKQVIKTWSRRSTIFPSFVGLTIAVYDGRKHVPVYITEDMVGHKLGEFVPTRTFHGHKSTDDKATSQS

SEQ ID NO: 3851 - protein, 51 aa, Oryza sativa
  subsp. japonica
MPSHKTFQIKKKLAKKMRQNRPIPYWIRMRTDNTIRYNAKRRHWRRTKLGF

SEQ ID NO: 3852 - protein, 76 aa, Gallus gallus
MARGQQKIQSQQKNAKKQAEQKKKQGHDQKAAAKAALIYTCTVCRTQMPDPKTFKQHFESKHPKTPLPPELADVQA

SEQ ID NO: 3853 - protein, 262 aa, Gallus gallus; identical to SEQ ID NO: 9

SEQ ID NO: 3854 - protein, 483 aa, Bacillus licheniformis; identical to SEQ ID NO: 429

SEQ ID NO: 3855 - protein, 50 aa, Equus asinus
MARYRCCRSQSQSRCRRRRRRRCRRRRRRCVRRRRVCCRRYTVLRCRRRR

SEQ ID NO: 3856 - protein, 233 aa, Gallus gallus
MNLNFTSPVHPVPAPRPTSFFIEDILLHKPKPLREVPPEHFAGSLASRVPLLDYGYPLMPAPALLAPHPHPALHKPEHHHHHPYFLTTSGVPVPALFPHHAHAELPGKHCRRRKARTVFSDSQLSGLEKRFEIQRYLSTPERVELATALSLSETQVKTWFQNRRMKHKKQLRKSQDDPIHEENREQSSPEPELPEPAAAEPRKGPPGPFLLQDPEDEVDILEEGDILAAPHRL

SEQ ID NO: 3857 - protein, 103 aa, Lactobacillus johnsonii
MYAVIKTGGKQYKVAKGDSVFVEKLEVKPGDEVTFDEVILVNDGKSTKIGTPVVEGAKVVAKVEKQGKEKKVVTFKYKPKKHSHTKYGHRQPYTKVTIESIEA

SEQ ID NO: 3858 - protein, 109 aa, Lactobacillus johnsonii
MGKRPNFGGMGMGNMQGLIKQAKKMQQQMEAEQANLATQEFVGKAADDMVVATFSGDRKLKDLKINKEAIDPDDPDMLQDLVIDAVNKGIKAVDDATQASMGKYTKGLM

SEQ ID NO: 3859 - protein, 53 aa, Lactobacillus johnsonii
MEDKHGIKDKVAGKLKEVEGKITGDKAREVEGKAQQAKGKVKSKATEVKEDLE

SEQ ID NO: 3860 - protein, 149 aa, Solanum tuberosum
MADQLTEDQISEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYDEFVKVMMAK

SEQ ID NO: 3861 - protein, 76 aa, Sus scrofa
AKVTEKSWQPQTTSTKRWKKRKTPSQPRSRGKVRKIYKKVKRPLHVCSRKKYSPKVITTSRRQKRARRANKFETIP

SEQ ID NO: 3862 - protein, 213 aa, Oryza sativa
  subsp. japonica
MGCFQSTARRPRPGYEDPVGLASETAFSVSEVEALFELFKSISGSVIDDGLINKEEFQLALFKNKRKENLFANRIFDLFDVKKRGVIDFGDFVRALNVFHPNIPMEEKIDFSFKLYDMDNTGFIERKEVKQMLIALLGESEMRLSDEIIETILDKTFSDADTNQDGRIDRTEWENFVSRNPSLLKIMTLPYLKDITTTFPSFVFNSEVDDLVT

SEQ ID NO: 3863 - protein, 76 aa, Bos taurus
MMEVESSYSDFISCDRSGRRNAVPDIQGDSEAVSVRKLAGDMGELALEGAEGQAEVGTSDKEASSQPESSDGTTSS

SEQ ID NO: 3864 - protein, 84 aa, Lactobacillus plantarum
MPIIKSAIERVKTNNKANVRNTAQMSAMRTAVKKFEAAKTAGADNVDDLYLAATSAVDKAASKGLIKRNKAARDKSRMAARYAK

SEQ ID NO: 3865 - protein, 73 aa, Lactobacillus plantarum
MSDVNKKFDSKKDQLSGKAKEVEGKVTGDRAREAQGKTQSLMGKAKDKLADAEETVKGVVDEAKDKMKKKSDD

SEQ ID NO: 3866 - protein, 76 aa, Lactobacillus plantarum
MAEQPTFEQNLSQLETIVNQLEQGDVPLEQALDQFQKGVALSKQLQATLEGAEKTLTKMMNENGDEVPFEQADANE

SEQ ID NO: 3867 - protein, 102 aa, Lactobacillus plantarum
MYAIIVTGGKQYKVEAGQAIYVEKLDAAAGDKVTFDQVVFVGGDTTKVGTPTVDGATVEGTVEKQGRDRKVVTFKYKAKKGQHTKKGHRQPYTKVTIDTINA

SEQ ID NO: 3868 - protein, 64 aa, Lactobacillus plantarum
MPKQKTNRAAAKRFKVTAKGKIKSANAFTSHRFHGKTKKQRRQLRGTAIIEKPMVKTYHKLLQK

SEQ ID NO: 3869 - protein, 91 aa, Lactobacillus plantarum
MGRSLKKGPFADAHLLKKIDAQSDSDKKSVIKTWSRRSTIFPSFIGYTIAVYDGRKHVPVYIQDDMVGHKLGEFVPTRTFHGHGTDDKKTK

SEQ ID NO: 3870 - protein, 102 aa, Lactobacillus plantarum
MMRGMGNMQSMMKQMKKMQAQMTAEQAALNEQTFTGAAPDDMVKVTFTGDKKMKDITINPDAVDPDDVDMLQDLVVAAVNDALTKVDEQTQSTMGKYTKGLQ

SEQ ID NO: 3871 - protein, 57 aa, Bifidobacterium longum
MTMAKSADIRPGITLACTECKERNYITTKNRRNTPDRLELKKFCPRCGKQTVHRETR

SEQ ID NO: 3872 - protein, 314 aa, Bacillus licheniformis; identical to SEQ ID NO: 663

SEQ ID NO: 3873 - protein, 49 aa, Sus scrofa
YLDHGLGAPAPYPDPLEPRREVCELNPDCDELADHIGFQEAYRRFYGIA

SEQ ID NO: 3874 - protein, 32 aa, Saccharomyces cerevisiae
  strain ATCC 204508 / S288c
MPILVWQLPKSKKLKTLKYRICFREFFDRVET

SEQ ID NO: 3875 - protein, 46 aa, Saccharomyces cerevisiae
  strain ATCC 204508 / S288c
MLTTQKCESREGKNDEIFELGESNSDKILLKHGKCNLFSERKPVNH

SEQ ID NO: 3876 - protein, 26 aa, Saccharomyces cerevisiae
  strain ATCC 204508 / S288c
MRLNYSRCYYSSQRRRQSLPKRFPLI

SEQ ID NO: 3877 - protein, 3562 aa, Gallus gallus
MLLNIKSIIWMCSTLAITYMLPKVKAEKKTLVKGSLSGTSVLPCFFSTTPTIASSYAAEYLRIKWSKVELDKSGKDAKETTVLVAQNGNIKIGQNYKDRVSVPTHSEETGDASLTFSRLRASDAGVYRCDVMYGVEDTQGIVSLAVDGVVFHYRAATSRYTLNFTQAQQTCLDNGAVIASPEQLKAAYEDGFEQCDAGWLSDQTVRYPIRHPRIGCFGDKMGKKGVRTYGRRFPNETYDVYCYVEHMQDEVVHVSVPEKLTFEEAKELCRKRDGVLASVGNMYVAWRNGFDQCDYGWLADGSVRYPASVARPQCGGGLLGVRTLYRYENQTGFPYPDSKFDAYCYERKKIVSEPTTVKLVTTLKTDSVELSSAKVTLKPSVFESSVTEVAVTKTKVPAWEEATLETEDTKMTTEVAEEKREMEVLMENIKLTTLLPQTVTDGEISPYDTLGRTEYDVSPRLTESTSAALEVEHTYSEAELSEEQGRSESTEDAFLTSVVFQDSTAVAKSSTGSWEDIETGDTQKHDGDNQTEQIEVGPVMTATDSLVPASQRELPRTGSSVSLTKENLYLGSHSTKEPTKKSMEAKSDKKLTTVVIPKALFTDQYDLTTGGEGRESMYTVMPDRVSGVALVSIPESDVPAVSETLMDELAVTTGQSSTADESTPFIKFSSSATELDNEASAEGSREDLKDVHLTTSSGIPVSFTLFTANETGSEVTALSESTSAPQKFEEGITSVLHSSQQTEGSAILEKQEKTKEPEMSTIDAKVLYITTVVPASVTAGSEGRFGSEKFTHTPPVSGMWLQTDKDQVYMTEETSHTKRIELDTEDDISGMEPTSSPGQIIEYTKHLGAPVSAVTDETKTSMETAETESDEEVVSADFDQTKGTTEVFHTSSSLDLEKFTLSKIPEDESSATVKSFSSSSGTVLPTAVATVLEVTDHEADETSGYVLNMTFSTPEGEQRKATEKSPATSAEDEVSTGTEISKYTMTEGGQISSVTSAEKESVAALQEREEQPSVGLPETKEPFKFTDVTEIETTVPQREGDTSLVPVTVGSEDIGEMQVTDHTSFDSIIHTEATVTSTKASEVFPKELSTKDQDRELGTAMGSTLPVTSVQMHEQKTTAGFESPQTTTQEKHDEMGSAYDEMYPATELSVPALMLTEYGQVSGPVETSTRSLHLTGTPKAETATDQEEKITEAVPVTFGTQAKVYESKGTTTREEDRDVGSWNSVLPPHTMLSSPSTAGSISLLTLGASPSQTPEGSGISEELEEVKTVPFSSRATDKTTVISDLTTSSISAVDKIQPTSASKPFVSSKSPRIIPEEDEEVTSSDIIVIDESISPSKASAEDDLTGKMVEPEIDKEYFTSSTATAVARPTAPPTVMEATEALQPQEVSPTSHPDSGTDIRLYVIQITGNDTDHPVNEFLDLFSRHILPHAVDETHTDAESAQTEPCTSDSVQDSSEYIILDPFFPNFMDFEEEEEDCENTTDVTTPPALQFINGKQQVTSAPKSTKAEEARSDQIESVAHSKNVTFSQINETNTFIISETEASGTMQPSKAGEVMGAFEVTQPTADVAMLEPVYSGESEVTTTDKYLEITSVYEQSPKKNKETVMWHGTEESSTKDTKNLLLITNESSGDGSTESDLSRSVFTEILTMSSHEDSEKISHTTSVPTILSVERSAVTAAPSADSDTATVGIDVKDLIPKGGTATPGNYYKSTIKLDAEFPFESNPEATSHTTKPDMTASSFIVLEGSGDVEENSTLASAMTTETAVAETLSVQDTSLGSGTVLPTEISVTISEITPALPGGTRILYSTFDQSSEATVSTNFVSELIMEQVVGSSVATEKKVEDEKEVQTTVYSSQEISTTDAKGKSELDEFGSTTNEVRTVSQEPTPLREIVPITGTMHSEIKKVTATPFLREKLFINEGSAEEPADLFAGSPTRKVVSTDSPFTDSGSGDIDVITESATLTSVPSRSVIETQTVKHEGNINVISVSLKNTTTEYEEHIGTGGPVTSVSSTGSDGLTEESEVAIEMSENVFSTENQGEPTQEAVPTYTAPSDIKSRLGSRREVTSHVTPVIRTKDLETAEVTSSPESVVNNSTLDTMVTHGTIRAVAESTESKKGKGSFSAVSLGKILMIEHGSGEELKVDSSTTKLMSNGPTEKLLGSHFSFFDQGSGEAETLTESFTKASVSPTGKPEPQEQYGRKTVSMPSAVVHAYTAEPNELVTSTEHDITSLQTVTDTEMEEKAANELTVTSFATNLPLSEDVHSWEDRPREILPKAIESSGEATEDPFFISTQANHEHVEFLSVPTIRPHSEENKVEAESDEKILLPFNNDRVTESAVIERKYLSSPFTDTEQEEELVQNIFPTEDIPRLFLTPKEEKPTNNELISDPLFSGQGSGDEFTVIPSVESLAVKETTNTLSPWPFHPASVGPKLSTDKTQVFESGSTDSNAEINEEITTTAAELTETAYSMATSSPALEEESSSHSNSKDKDITHYFLVIEDPYNKEMDHRRGENGTSRPLPTPGDVSLEESSHMLTTDDVTPVSVILSETPYLEMGKSLATSATKMPSRVLPESSGEGSGWDGVSDSFAPDTLTHSTAPSVMEVELTASSHIPGVYSEVMTTHVPGDGSQTVITGLASLFTEEKEIVANRTAADPKTGTSEELTSDTGMSLDIIPVVDDRRHVTLNVSVYGDITLIEERLQIPSEKTTIIDMDHSKSMPEDIISVQTMPNLVIRSTQVSDDNMKAEEDKYDSILNFSTVEENSFGSGDNLSLTTSIQPSSESVTAGHGPKLVDKDLGSGYAMQFATETLTTTVLNELGIFLPTVPSLVSPHMPHESKESEFEAKHIGRTSTTDDVYEPYTSANNQVITDQSKTMSISGFSGMGQEESGDKKPMIPSLTPDLTMETEKALTTDTFDVSMVTTQSMSQHATVSSSSSEEKHSTVYMQTKSASTEYEETDSVSLNSVSQNPKSSVTVWLVNGVSKYPEVIIPSTSSAKDSDQSDHSSDGTFKEVSSDMAATYKPPTTDLDTTVSSLLVFSPEPESESISTESTPHFNKFVTERSEETESSVNDLIIEENATVSGDSPSIHDYPTAFWNFGERTSTDVPKLSTIEVEFSSERVKNPSQESDRSTERERPRLSSAPVSDSPNSIEVGVFKPDQEAVTMLTSSLEPLDRSLETQSALLGPLLGQQEITTISSNIATNNTAPGNNPYSNEQSTISSELLNTIELVTSSFSLPEVTNGSDFLIGTSVGSVEGTAVQIPGQDPCKSNPCLNGGTCYPRGSFYICTCLPGFNGEQCELDIDECQSNPCRNGATCIDGLNTFTCLCLPSYIGALCEQDTETCDYGWHKFQGQCYKYFAHRRTWDTAERECRLQGAHLTSILSHEEQVFVNRIGHDYQWIGLNDKMFERDFRWTDGSPLQYENWRPNQPDSFFSAGEDCVVIIWHENGQWNDVPCNYHLTYTCKKGTVACGQPPVVENAKTFGKMKPRYEINSLIRYHCKDGFIQRHIPTIRCQGNGRWDMPKITCMNPSTYQRTYSKKYYYKHSSSGKGTSLNSSKHYHRWIRTWQDSRR

SEQ ID NO: 3878 - protein, 65 aa, Carica papaya
MSDTCGNCDCADKTQCVKKGSSYTADIIETEKSIMTVVMDAPAAENDGKCKCGPSCSCTNCTCGH

SEQ ID NO: 3879 - protein, 51 aa, Gallus gallus
MSSHKTFKIKRFLAKKQKQNRPIPQWIRMKTGNKIRYNSKRRHWRRTKLGL

SEQ ID NO: 3880 - protein, 45 aa, Coturnix japonica
MCDKPDLSEVEKFDKKKLKKTNTEEKNTLPSKETIEQEKECVKSS

SEQ ID NO: 3881 - protein, 127 aa, Bos taurus
MDVFKKGFSIAKEGVVGAVEKTKQGVTEAAEKTKEGVMYVGAKTKEGVVQSVTSVAEKTKEQANAVSEAVVSSVNTVATKTVEEVENIAVTSGVVHKEALKQPVPSQEDEAAKAEEQVAEETKSGGD

SEQ ID NO: 3882 - protein, 131 aa, Saccharomyces cerevisiae
  strain ATCC 204508 / S288c
MSEDLSPTSSRVDLSNPHGFTKEGVDLSKLSPQELKLYKMYGKLPSKKDLLRHKMQDRQYFDSGDYALKKAGVIKSDDVIVNNSSNNLPVTNPSGLRESIIRRRMSSSSGGDSISRQGSISSGPPPRSPNK

SEQ ID NO: 3883 - protein, 420 aa, Zea mays; identical to SEQ ID NO: 108

SEQ ID NO: 3884 - protein, 78 aa, Saccharomyces cerevisiae
  strain ATCC 204508 / S288c
MSQNNTISSMNPERAYNNVTLKNLTAFQLLSQRENICELLNLVESTERHNSIINPERQRMSLEEMKKMLDALKNERKK

SEQ ID NO: 3885 - protein, 239 aa, Bos taurus
MSRSNRQKEYKCGDLVFAKMKGYPHWPARIDEMPEAAVKSTANKYQVFFFGTHETAFLGPKDLFPYEESKEKFGKPNKRKGFSEGLWEIENNPTVKASGYQSSQKKSCVEEPEPEPEATEGDGDKKGNAEGSSDEEGKLVIDEPTKEKNEKGALKRRAGDLLEDSPKRPKEAEDLEGEEKEGATLEGERPLPVEAEKNSTPSEPGSGRGPPQEEEEEEEEEEAAKEDAEAPGLRDHESL

SEQ ID NO: 3886 - protein, 138 aa, Cucurbita maxima
MGMGMMEVHLISGKGLQAHDPLNKPIDPYAEINFKGQERMSKVAKNAGPDPIWNEKFKFLVEYPGSGGDFHILFKVMDHDAIDGDDYIGDVKIDVQNLLAEGVRKGWSELPPRMYQVLAHKIYFKGEIEVGVFFQRQG

SEQ ID NO: 3887 - protein, 150 aa, Cucurbita maxima
MGMGMMEVHLISGKGLQAHDPLNKPIDPYAEINFKGQERMSKVAKNAGPNPLWDEKFKFLAEYPGSGGDFHILFKVMDHDAIDGDDYIGDVKIDVKNLLAEGVRKGKSEMPPRMYHVLAHKIHFKGEIEVGVSFKLQGGGGCGGCYPWEN

SEQ ID NO: 3888 - protein, 51 aa, Saccharomyces cerevisiae
  strain ATCC 204508 / S288c
MKMKTNKYMNMVRPAPPRRADPEGVRDPSTMGGGPNPFLRRSPYMYINKKK

SEQ ID NO: 3889 - protein, 3260 aa, Ovis aries; identical to SEQ ID NO: 836

SEQ ID NO: 3890 - protein, 61 aa, Bos taurus
NSPESYLSSKTRSSKLDDNYLKELNEDLKLRKQELLEILKPLEDKNNLLFQKLMSNLEEKQ

SEQ ID NO: 3891 - protein, 51 aa, Saccharomyces cerevisiae
  strain ATCC 204508 / S288c
TNLHMMLPPNHRKTWYALDDFRKDNLKTDEKRINKLFDLDPFKTMVEDRKL

SEQ ID NO: 3892 - protein, 51 aa, Saccharomyces cerevisiae
  strain ATCC 204508 / S288c
KVPEHDQQLNTFEKRYDELFDAQFNKLEFFKIRMKKLKKNKPIEKKNYKIW

SEQ ID NO: 3893 - protein, 56 aa, Saccharomyces cerevisiae
  strain ATCC 204508 / S288c
KVPEHDQQLNTFEKRYDELFDAQFNKLEFFKIRMKKLKKNKPIEKKNYKIWCLEKE

SEQ ID NO: 3894 - protein, 61 aa, Saccharomyces cerevisiae
  strain ATCC 204508 / S288c
KVPEHDQQLNTFEKRYDELFDAQFNKLEFFKIRMKKLKKNKPIEKKNYKIWCLEKEDLKDL

SEQ ID NO: 3895 - protein, 66 aa, Saccharomyces cerevisiae
  strain ATCC 204508 / S288c
KVPEHDQQLNTFEKRYDELFDAQFNKLEFFKIRMKKLKKNKPIEKKNYKIWCLEKEDLKDLVWDPL

SEQ ID NO: 3896 - protein, 51 aa, Gallus gallus
DMEKRVIKWFDYLWTNKKAVDEREVLKYLPDKLRAEIAINVHLETLKKVRI

SEQ ID NO: 3897 - protein, 51 aa, Bos taurus
KDMEKRVIKWFDYLWTNKKTVDEREVLKYLPDKLRAEIAINVHLDTLKKVR

SEQ ID NO: 3898 - protein, 56 aa, Bos taurus
KDMEKRVIKWFDYLWTNKKTVDEREVLKYLPDKLRAEIAINVHLDTLKKVRIFADC

SEQ ID NO: 3899 - protein, 56 aa, Gallus gallus
MHFRKVTKDLEARVIKWFDYLWTNKKTVDEKEVLKNLPDKLKAEIAINVHLDTLKK

SEQ ID NO: 3900 - protein, 51 aa, Bos taurus
WNKTIDAMKRVEEIKQKRQAKFIMNRLKKNKELQKVQDVKEVKQNIHLIRA

SEQ ID NO: 3901 - protein, 51 aa, Bos taurus
EELKNFLKDLLEKANKTVDDTKLAEYTDLMLKLFDSNNDGKLELTEMARLL

SEQ ID NO: 3902 - protein, 51 aa, Bos taurus
LKRRLPTQPSDHSYALLDLDTLKKKLFLTLKENEKLRRRLKAQRLVMRRMC

SEQ ID NO: 3903 - protein, 51 aa, Bos taurus
FKRLQHLLKEKKRRYLHNRKVEHEALGSSLLTGPEGLLAKERENLKRLKCL

SEQ ID NO: 3904 - protein, 66 aa, Oryza sativa
  subsp. japonica
SPLGASAEREREVREAEMLLRAIAERYDDCFLRLRDAAAELSDLHRERLRLAAENLHLSLLLEELE

SEQ ID NO: 3905 - protein, 51 aa, Coturnix japonica
SLNLSSNKLYRLDDLAELAIKAAGLKVLDLSRNELKSERELDKVKGLKLEE

SEQ ID NO: 3906 - protein, 51 aa, Saccharomyces cerevisiae
  strain YJM789
RKDITICLNDLCRINDLLVSHDGLLKREIGSLLRDKQELLELNEREQLLWK

SEQ ID NO: 3907 - protein, 56 aa, Saccharomyces cerevisiae
  strain ATCC 204508 / S288c
VFEELRNSATTLQEDELLLETCENELKRLEEKLTLYKPILKLISDFESLQEDQEFL

SEQ ID NO: 3908 - protein, 56 aa, Solanum demissum
CKDLLLSLLRDAIGEESERRELPDNELADMLRKTLLPRRYLILVDDVWDNSAWDDL

SEQ ID NO: 3909 - protein, 56 aa, Solanum tuberosum
DHVEDKNVETLLERLLEAREELRPLLLKPNNRLKDLLFLDIALDSTVRTAVERGYE

SEQ ID NO: 3910 - DNA, 43 bp, Artificial Sequence
  Description of Artificial Sequence: Synthetic oligonucleotide
cagtggtatcaacgcagagtggccattacggccaagttacggg

SEQ ID NO: 3911 - DNA, 48 bp, Artificial Sequence
  Description of Artificial Sequence: Synthetic oligonucleotide
cagtggtatcaacgcagagtggccgaggcggccttttttttttttttt

SEQ ID NO: 3912 - DNA, 22 bp, Artificial Sequence
  Description of Artificial Sequence: Synthetic primer
tacgtgtatggccgcctcggcc

SEQ ID NO: 3913 - DNA, 22 bp, Artificial Sequence
  Description of Artificial Sequence: Synthetic primer
tacgtgtatggccgtaatggcc

SEQ ID NO: 3914 - protein, 8 aa, Artificial Sequence
  Description of Artificial Sequence: Synthetic peptide
DYKDDDDK

SEQ ID NO: 3915 - protein, 22 aa, Artificial Sequence
  Description of Artificial Sequence: Synthetic peptide
DYKDHDGDYKDHDIDYKDDDDK

SEQ ID NO: 3916 - protein, 20 aa, Artificial Sequence
  Description of Artificial Sequence: Synthetic peptide
MGSSHHHHHHSSGLVPRGSH

SEQ ID NO: 3917 - protein, 11 aa, Artificial Sequence
  Description of Artificial Sequence: Synthetic peptide
MGSHHHHHHHH

SEQ ID NO: 3918 - protein, 19 aa, Artificial Sequence
  Description of Artificial Sequence: Synthetic peptide
MGSHHHHHHHHSENLYFQG

SEQ ID NO: 3919 - protein, 8 aa, Artificial Sequence
  Description of Artificial Sequence: Synthetic 8xHis tag
HHHHHHHH

SEQ ID NO: 3920 - DNA, 57 bp, Artificial Sequence
  Description of Artificial Sequence: Synthetic oligonucleotide
atgaaaaagatttggctggcgctggctggtttagttttagcgtttagcgcatcggcg

SEQ ID NO: 3921 - protein, 32 aa, Bacillus subtilis
MKKKKTWKRFLHFSSAALAAGLIFTSAAPAEA

SEQ ID NO: 3922 - protein, 29 aa, Bacillus subtilis
MKRSISIFITCLLITLLTMGGMIASPASA

SEQ ID NO: 3923 - protein, 30 aa, Bacillus subtilis
MRKKTKNRLISSVLSTVVISSLLFPGAAGA

SEQ ID NO: 3924 - protein, 26 aa, Bacillus subtilis
MRKNRILALFVLSLGLLSFMVTPVSA

SEQ ID NO: 3925 - protein, 32 aa, Bacillus subtilis
MKFVKRRIIALVTILMLSVTSLFALQPSAKAA

SEQ ID NO: 3926 - protein, 25 aa, Bacillus subtilis
MKSCKQLIVCSLAAILLLIPSVSFA

SEQ ID NO: 3927 - protein, 26 aa, Bacillus subtilis
MKKKLAAGLTASAIVGTTLVVTPAEA

SEQ ID NO: 3928 - protein, 34 aa, Bacillus subtilis
MKLVPRFRKQWFAYLTVLCLALAAAVSFGVPAKA

SEQ ID NO: 3929 - protein, 28 aa, Bacillus subtilis
MRNLTKTSLLLAGLCTAAQMVFVTHASA

SEQ ID NO: 3930 - protein, 24 aa, Bacillus subtilis
MKRLCLWFTVFSLFLVLLPGKALG

SEQ ID NO: 3931 - protein, 36 aa, Bacillus subtilis
MKLKTKASIKFGICVGLLCLSITGFTPFFNSTHAEA

SEQ ID NO: 3932 - protein, 32 aa, Bacillus subtilis
MKKFPKKLLPIAVLSSIAFSSLASGSVPEASA

SEQ ID NO: 3933 - protein, 32 aa, Bacillus subtilis
MKKRKRRNFKRFIAAFLVLALMISLVPADVLA

SEQ ID NO: 3934 - protein, 28 aa, Bacillus subtilis
MFKFKKNFLVGLSAALMSISLFSATASA

SEQ ID NO: 3935 - protein, 28 aa, Bacillus subtilis
MKRMIVRMTLPLLIVCLAFSSFSASARA

SEQ ID NO: 3936 - protein, 26 aa, Bacillus subtilis
MKRITINIITMFIAAAVISLTGTAEA

SEQ ID NO: 3937 - protein, 28 aa, Bacillus subtilis
MRKKRVITCVMAASLTLGSLLPAGYASA

SEQ ID NO: 3938 - protein, 29 aa, Bacillus subtilis
MKKKQVMLALTAAAGLGLTALHSAPAAKA

SEQ ID NO: 3939 - protein, 21 aa, Bacillus subtilis
MKWMCSICCAAVLLAGGAAQA

SEQ ID NO: 3940 - protein, 26 aa, Bacillus subtilis
MKKELLASLVLCLSLSPLVSTNEVFA

SEQ ID NO: 3941 - protein, 26 aa, Bacillus subtilis
MNFKKTVVSALSISALALSVSGVASA

SEQ ID NO: 3942 - protein, 28 aa, Bacillus subtilis
MKRLFMKASLVLFAVVFVFAVKGAPAKA

SEQ ID NO: 3943 - protein, 26 aa, Bacillus subtilis
MLKKKWMVGLLAGCLAAGGFSYNAFA

SEQ ID NO: 3944 - protein, 27 aa, Bacillus subtilis
MKKIGLLFMLCLAALFTIGFPAQQADA

SEQ ID NO: 3945 - protein, 25 aa, Bacillus subtilis
MRFTKVVGFLSVLGLAAVFPLTAQA

SEQ ID NO: 3946 - protein, 28 aa, Bacillus subtilis
MKQGKFSVFLILLLMLTLVVAPKGKAEA

SEQ ID NO: 3947 - protein, 28 aa, Bacillus subtilis
MTLTKLKMLSMLTVMIASLFIFSSQALA

SEQ ID NO: 3948 - protein, 30 aa, Bacillus subtilis
MKRKLLSSLAISALSLGLLVSAPTASFAAE

SEQ ID NO: 3949 - protein, 28 aa, Bacillus subtilis
MTKKAWFLPLVCVLLISGWLAPAASASA

SEQ ID NO: 3950 - protein, 30 aa, Bacillus subtilis
MRKSLITLGLASVIGTSSFLIPFTSKTASA

SEQ ID NO: 3951 - protein, 26 aa, Bacillus subtilis
MKRIRIPMTLALGAALTIAPLSFASA

SEQ ID NO: 3952 - protein, 21 aa, Bacillus subtilis
MRKYTVIASILLSFLSVLSGG

SEQ ID NO: 3953 - protein, 31 aa, Bacillus subtilis
MKKLLTVMTMAVLTAGTLLLPAQSVTPAAHA

SEQ ID NO: 3954 - protein, 30 aa, Bacillus subtilis
MNKPTKLFSTLALAAGMTAAAAGGAGTIHA

SEQ ID NO: 3955 - protein, 41 aa, Bacillus subtilis
MVKSFRMKALIAGAAVAAAVSAGAVSDVPAAKVLQPTAAYA

SEQ ID NO: 3956 - protein, 32 aa, Bacillus subtilis
MKWNNMLKAAGIAVLLFSVFAYAAPSLKAVQA

SEQ ID NO: 3957 - protein, 16 aa, Aspergillus sp.
MRWLLTSSALLVPAAA

SEQ ID NO: 3958 - protein, 26 aa, Aspergillus sp.
MKFLKAKGSLLSSGIYLIALAPFVNA

SEQ ID NO: 3959 - protein, 23 aa, Aspergillus sp.
MNFKNIFLSFFFVLAVGLALVHA

SEQ ID NO: 3960 - protein, 21 aa, Aspergillus sp.
MKQFSAKYALILLATAGQALA

SEQ ID NO: 3961 - protein, 19 aa, Aspergillus sp.
MKLSSACAIALLAAQAAGA

SEQ ID NO: 3962 - protein, 20 aa, Aspergillus sp.
MKYSTIFSAAAAVFAGSAAA

SEQ ID NO: 3963 - protein, 18 aa, Aspergillus sp.
MKFSTILTGSLFATAALA

SEQ ID NO: 3964 - protein, 22 aa, Aspergillus sp.
MIGSSHAVVALGLFTLYGHSAA

SEQ ID NO: 3965 - protein, 19 aa, Aspergillus sp.
MPRTSLLTLACALATGASA

SEQ ID NO: 3966 - protein, 22 aa, Aspergillus sp.
MRPLSHLSFFNGLLLGLSALSA

SEQ ID NO: 3967 - protein, 18 aa, Aspergillus sp.
MGALRWLSIAATASTALA

SEQ ID NO: 3968 - protein, 23 aa, Aspergillus sp.
MGVSAVLLPLYLLSGVTSGLAVP

SEQ ID NO: 3969 - protein, 14 aa, Aspergillus sp.
MLPLLLCIVPYCWS

SEQ ID NO: 3970 - protein, 18 aa, Aspergillus sp.
MHFLQNAVVAATMGAALA

SEQ ID NO: 3971 - protein, 20 aa, Aspergillus sp.
MKGTAASALLIALSATAAQA

SEQ ID NO: 3972 - protein, 16 aa, Aspergillus sp.
MKGILGLSLLPLLTAA

SEQ ID NO: 3973 - protein, 18 aa, Aspergillus sp.
MKFSTILTGSLFATAALA

SEQ ID NO: 3974 - protein, 22 aa, Aspergillus sp.
MIGSSHAVVALGLFTLYGHSAA

SEQ ID NO: 3975 - protein, 26 aa, Aspergillus sp.
MMYSKLLTLTTLLLPTALALPSLVER

SEQ ID NO: 3976 - protein, 18 aa, Aspergillus sp.
MHSYQLLGLAAVGSLVSA

SEQ ID NO: 3977 - protein, 21 aa, Aspergillus sp.
MQSIKRTLLLLGAILPAVLGA

SEQ ID NO: 3978 - protein, 20 aa, Aspergillus sp.
MHYKLLFAAAAASLASAVSA

SEQ ID NO: 3979 - protein, 20 aa, Aspergillus sp.
MPRLLPISAATLALAQLTYG

SEQ ID NO: 3980 - protein, 19 aa, Aspergillus sp.
MPRTSLLTLACALATGASA

SEQ ID NO: 3981 - protein, 18 aa, Aspergillus sp.
MRQHSRMAVAALAAGANA

SEQ ID NO: 3982 - protein, 20 aa, Aspergillus sp.
MRSFAPWLVSLLGASAVVAA

SEQ ID NO: 3983 - protein, 18 aa, Aspergillus sp.
MLTKNLLLCFAAAKAALA

SEQ ID NO: 3984 - protein, 19 aa, Aspergillus sp.
MAVLSVLLPITFLLSSVTG

SEQ ID NO: 3985 - protein, 18 aa, Aspergillus sp.
MGALRWLSIAATASTALA

SEQ ID NO: 3986 - protein, 23 aa, Aspergillus sp.
MGVSAVLLPLYLLSGVTSGLAVP

SEQ ID NO: 3987 - protein, 20 aa, Aspergillus sp.
MVVFSKTAALVLGLSTAVSA

SEQ ID NO: 3988 - protein, 25 aa, Aspergillus sp.
MVKLTHLLARAWLVPLAYGASQSLL

SEQ ID NO: 3989 - protein, 25 aa, Aspergillus sp.
MVAFSALSGVSAVSLLLSLVQNAHG

SEQ ID NO: 3990 - protein, 18 aa, Aspergillus sp.
MSFRSLLALSGLVCTGLA

SEQ ID NO: 3991 - protein, 19 aa, Aspergillus sp.
MFTKQSLVTLLGGLSLAVA

SEQ ID NO: 3992 - protein, 18 aa, Aspergillus sp.
MFSRRNLVALGLAATVSA

SEQ ID NO: 3993 - protein, 6 aa, Unknown
  Description of Unknown: Kexin protease site peptide
NVISKR

SEQ ID NO: 3994 - protein, 21 aa, Unknown
  Description of Unknown: Ig-Kappa peptide
METDTLLLWVLLLWVPGSTGD

SEQ ID NO: 3995 - protein, 11 aa, Artificial Sequence
  Description of Artificial Sequence: Synthetic peptide
LFDKDNNGSIS

SEQ ID NO: 3996 - protein, 8 aa, Artificial Sequence
  Description of Artificial Sequence: Synthetic peptide
FDKDNNGS

SEQ ID NO: 3997 - protein, 10 aa, Artificial Sequence
  Description of Artificial Sequence: Synthetic peptide
FDKDNNGSIS

SEQ ID NO: 3998 - protein, 11 aa, Artificial Sequence
  Description of Artificial Sequence: Synthetic peptide
FDKDNNGSISS

SEQ ID NO: 3999 - protein, 14 aa, Artificial Sequence
  Description of Artificial Sequence: Synthetic peptide
FDKDNNGSISSSEL

SEQ ID NO: 4000 - protein, 8 aa, Artificial Sequence
  Description of Artificial Sequence: Synthetic peptide
DKDNNGSI

SEQ ID NO: 4001 - protein, 9 aa, Artificial Sequence
  Description of Artificial Sequence: Synthetic peptide
DKDNNGSIS

SEQ ID NO: 4002 - protein, 8 aa, Artificial Sequence
  Description of Artificial Sequence: Synthetic peptide
SLGLSPSE

SEQ ID NO: 4003 - protein, 8 aa, Artificial Sequence
  Description of Artificial Sequence: Synthetic peptide
NEIDVDGN

SEQ ID NO: 4004 - protein, 7 aa, Artificial Sequence
  Description of Artificial Sequence: Synthetic peptide
IDVDGNH

SEQ ID NO: 4005 - protein, 8 aa, Artificial Sequence
  Description of Artificial Sequence: Synthetic peptide
IDVDGNHQ

SEQ ID NO: 4006 - protein, 10 aa, Artificial Sequence
  Description of Artificial Sequence: Synthetic peptide
IDVDGNHQIE

SEQ ID NO: 4007 - protein, 9 aa, Artificial Sequence
  Description of Artificial Sequence: Synthetic peptide
KVFDKNGDG

SEQ ID NO: 4008 - protein, 11 aa, Artificial Sequence
  Description of Artificial Sequence: Synthetic peptide
VFDKNGDGLIS

SEQ ID NO: 4009 - protein, 7 aa, Artificial Sequence
  Description of Artificial Sequence: Synthetic peptide
DKNGDGL

SEQ ID NO: 4010 - protein, 7 aa, Artificial Sequence
  Description of Artificial Sequence: Synthetic peptide
KLTDAEV

SEQ ID NO: 4011 - protein, 16 aa, Artificial Sequence
  Description of Artificial Sequence: Synthetic peptide
LREVSDGSGEINIQQF

SEQ ID NO: 4012 - protein, 8 aa, Artificial Sequence
  Description of Artificial Sequence: Synthetic peptide
REVSDGSG

SEQ ID NO: 4013 - protein, 9 aa, Artificial Sequence
  Description of Artificial Sequence: Synthetic peptide
REVSDGSGE

SEQ ID NO: 4014 - protein, 10 aa, Artificial Sequence
  Description of Artificial Sequence: Synthetic peptide
REVSDGSGEI

SEQ ID NO: 4015 - protein, 11 aa, Artificial Sequence
  Description of Artificial Sequence: Synthetic peptide
REVSDGSGEIN

SEQ ID NO: 4016 - protein, 13 aa, Artificial Sequence
  Description of Artificial Sequence: Synthetic peptide
REVSDGSGEINIQ

SEQ ID NO: 4017 - protein, 15 aa, Artificial Sequence
  Description of Artificial Sequence: Synthetic peptide
REVSDGSGEINIQQF

SEQ ID NO: 4018 - protein, 9 aa, Artificial Sequence
  Description of Artificial Sequence: Synthetic peptide
EVSDGSGEI

SEQ ID NO: 4019 - protein, 10 aa, Artificial Sequence
  Description of Artificial Sequence: Synthetic peptide
EVSDGSGEIN

SEQ ID NO: 4020 - protein, 12 aa, Artificial Sequence
  Description of Artificial Sequence: Synthetic peptide
YSFEDSGVGDVT

SEQ ID NO: 4021 - protein, 13 aa, Artificial Sequence
  Description of Artificial Sequence: Synthetic peptide
YSFEDSGVGDVTG

SEQ ID NO: 4022 - protein, 12 aa, Artificial Sequence
  Description of Artificial Sequence: Synthetic peptide
SFEDSGVGDVTG

SEQ ID NO: 4023 - protein, 9 aa, Artificial Sequence
  Description of Artificial Sequence: Synthetic peptide
FEDSGVGDV

SEQ ID NO: 4024 - protein, 9 aa, Artificial Sequence
  Description of Artificial Sequence: Synthetic peptide
EDSGVGDVT

SEQ ID NO: 4025 - protein, 10 aa, Artificial Sequence
  Description of Artificial Sequence: Synthetic peptide
EDSGVGDVTG

SEQ ID NO: 4026 - protein, 11 aa, Artificial Sequence
  Description of Artificial Sequence: Synthetic peptide
EDSGVGDVTGF

SEQ ID NO: 4027 - protein, 8 aa, Artificial Sequence
  Description of Artificial Sequence: Synthetic peptide
DSGVGDVT

SEQ ID NO: 4028 - protein, 7 aa, Artificial Sequence
  Description of Artificial Sequence: Synthetic peptide
  MOD_RES (4)..(4): D-amino acid
LRGNGYD

SEQ ID NO: 4029 - protein, 10 aa, Artificial Sequence
  Description of Artificial Sequence: Synthetic peptide
  MOD_RES (4)..(4): D-amino acid
LRGNGYDIDV

SEQ ID NO: 4030 - protein, 10 aa, Artificial Sequence
  Description of Artificial Sequence: Synthetic peptide
ITHTNDIVPR

SEQ ID NO: 4031 - protein, 8 aa, Artificial Sequence
  Description of Artificial Sequence: Synthetic peptide
HTNDIVPR

SEQ ID NO: 4032 - protein, 7 aa, Artificial Sequence
  Description of Artificial Sequence: Synthetic peptide
TNDIVPR

SEQ ID NO: 4033 - protein, 6 aa, Artificial Sequence
  Description of Artificial Sequence: Synthetic peptide
NDIVPR

SEQ ID NO: 4034 - protein, 7 aa, Artificial Sequence
  Description of Artificial Sequence: Synthetic peptide
YSHSSPE

SEQ ID NO: 4035 - protein, 26 aa, Artificial Sequence
  Description of Artificial Sequence: Synthetic peptide
DIVKIEGIDATGGNNQPNIPDIPAHL

SEQ ID NO: 4036 - protein, 6 aa, Artificial Sequence
  Description of Artificial Sequence: Synthetic peptide
KIEGID

SEQ ID NO: 4037 - protein, 21 aa, Artificial Sequence
  Description of Artificial Sequence: Synthetic peptide
KIEGIDATGGNNQPNIPDIPA

SEQ ID NO: 4038 - protein, 20 aa, Artificial Sequence
  Description of Artificial Sequence: Synthetic peptide
IEGIDATGGNNQPNIPDIPA

SEQ ID NO: 4039 - protein, 19 aa, Artificial Sequence
  Description of Artificial Sequence: Synthetic peptide
EGIDATGGNNQPNIPDIPA

SEQ ID NO: 4040 - protein, 18 aa, Artificial Sequence
  Description of Artificial Sequence: Synthetic peptide
GIDATGGNNQPNIPDIPA

SEQ ID NO: 4041 - protein, 14 aa, Artificial Sequence
  Description of Artificial Sequence: Synthetic peptide
IDATGGNNQPNIPD

SEQ ID NO: 4042 - protein, 16 aa, Artificial Sequence
  Description of Artificial Sequence: Synthetic peptide
IDATGGNNQPNIPDIP

SEQ ID NO: 4043 - protein, 17 aa, Artificial Sequence
  Description of Artificial Sequence: Synthetic peptide
IDATGGNNQPNIPDIPA

SEQ ID NO: 4044 - protein, 18 aa, Artificial Sequence
  Description of Artificial Sequence: Synthetic peptide
IDATGGNNQPNIPDIPAH

SEQ ID NO: 4045 - protein, 16 aa, Artificial Sequence
  Description of Artificial Sequence: Synthetic peptide
DATGGNNQPNIPDIPA

SEQ ID NO: 4046 - protein, 12 aa, Artificial Sequence
  Description of Artificial Sequence: Synthetic peptide
ATGGNNQPNIPD

SEQ ID NO: 4047 - protein, 14 aa, Artificial Sequence
  Description of Artificial Sequence: Synthetic peptide
ATGGNNQPNIPDIP

SEQ ID NO: 4048 - protein, 15 aa, Artificial Sequence
  Description of Artificial Sequence: Synthetic peptide
ATGGNNQPNIPDIPA

SEQ ID NO: 4049 - protein, 16 aa, Artificial Sequence
  Description of Artificial Sequence: Synthetic peptide
ATGGNNQPNIPDIPAH

SEQ ID NO: 4050 - protein, 14 aa, Artificial Sequence
  Description of Artificial Sequence: Synthetic peptide
TGGNNQPNIPDIPA

SEQ ID NO: 4051 - protein, 12 aa, Artificial Sequence
  Description of Artificial Sequence: Synthetic peptide
GGNNQPNIPDIP

SEQ ID NO: 4052 - protein, 13 aa, Artificial Sequence
  Description of Artificial Sequence: Synthetic peptide
GGNNQPNIPDIPA

SEQ ID NO: 4053 - protein, 12 aa, Artificial Sequence
  Description of Artificial Sequence: Synthetic peptide
GNNQPNIPDIPA

SEQ ID NO: 4054 - protein, 11 aa, Artificial Sequence
  Description of Artificial Sequence: Synthetic peptide
NNQPNIPDIPA

SEQ ID NO: 4055 - protein, 10 aa, Artificial Sequence
  Description of Artificial Sequence: Synthetic peptide
NQPNIPDIPA

SEQ ID NO: 4056 - protein, 8 aa, Artificial Sequence
  Description of Artificial Sequence: Synthetic peptide
PNIPDIPA

SEQ ID NO: 4057 - DNA, 44 bp, Artificial Sequence
  Description of Artificial Sequence: Synthetic oligonucleotide
atcaccaccatcaccatcatagcagcagcgaaagcattcgtatg

SEQ ID NO: 4058 - DNA, 47 bp, Artificial Sequence
  Description of Artificial Sequence: Synthetic oligonucleotide
tgttagcagccggatccttaatctttgcccagtttattcagaatatc

SEQ ID NO: 4059 - DNA, 48 bp, Artificial Sequence
  Description of Artificial Sequence: Synthetic primer
ggaatggtacgcggaaaaccaaacagaataaagccatttttgcatgcc

SEQ ID NO: 4060 - DNA, 48 bp, Artificial Sequence
  Description of Artificial Sequence: Synthetic primer
ggaatggtacgcggaaaaccaatcagaataaagccatttttgcatgcc

SEQ ID NO: 4061 - DNA, 44 bp, Artificial Sequence
  Description of Artificial Sequence: Synthetic primer
ccgcttgccggatgaatcagcataccggtaatacgtgcaaccag

SEQ ID NO: 4062 - DNA, 44 bp, Artificial Sequence
  Description of Artificial Sequence: Synthetic primer
ccgcttgccggatgaatcagataaccggtaatacgtgcaaccag

SEQ ID NO: 4063 - DNA, 44 bp, Artificial Sequence
  Description of Artificial Sequence: Synthetic primer
gtaccttttgcaatctggcttgccagcatatcaccggttgccag

SEQ ID NO: 4064 - DNA, 44 bp, Artificial Sequence
  Description of Artificial Sequence: Synthetic primer
gtaccttttgcaatctggctacacagcatatcaccggttgccag

SEQ ID NO: 4065 - DNA, 44 bp, Artificial Sequence
  Description of Artificial Sequence: Synthetic primer
gtaccttttgcaatctggctacccagcatatcaccggttgccag

SEQ ID NO: 4066 - DNA, 44 bp, Artificial Sequence
  Description of Artificial Sequence: Synthetic primer
gtaccttttgcaatctggctaatcagcatatcaccggttgccag

SEQ ID NO: 4067 - DNA, 44 bp, Artificial Sequence
  Description of Artificial Sequence: Synthetic primer
gtaccttttgcaatctggcttttcagcatatcaccggttgccag

SEQ ID NO: 4068 - DNA, 44 bp, Artificial Sequence
  Description of Artificial Sequence: Synthetic primer
gtaccttttgcaatctggctcagcagcatatcaccggttgccag

SEQ ID NO: 4069 - DNA, 44 bp, Artificial Sequence
  Description of Artificial Sequence: Synthetic primer
gtaccttttgcaatctggctctgcagcatatcaccggttgccag

SEQ ID NO: 4070 - DNA, 44 bp, Artificial Sequence
  Description of Artificial Sequence: Synthetic primer
gtaccttttgcaatctggctggtcagcatatcaccggttgccag

SEQ ID NO: 4071 - DNA, 44 bp, Artificial Sequence
  Description of Artificial Sequence: Synthetic primer
gtaccttttgcaatctggctaaccagcatatcaccggttgccag

SEQ ID NO: 4072 - DNA, 20 bp, Artificial Sequence
  Description of Artificial Sequence: Synthetic primer
ggttttccgcgtaccattcc

SEQ ID NO: 4073 - DNA, 19 bp, Artificial Sequence
  Description of Artificial Sequence: Synthetic primer
ctgattcatccggcaagcg

SEQ ID NO: 4074 - DNA, 22 bp, Artificial Sequence
  Description of Artificial Sequence: Synthetic primer
agccagattgcaaaaggtacac

SEQ ID NO: 4075 - DNA, 22 bp, Artificial Sequence
  Description of Artificial Sequence: Synthetic primer
ggatccggctgctaacaaagcc

SEQ ID NO: 4076 - DNA, 26 bp, Artificial Sequence
  Description of Artificial Sequence: Synthetic primer
atgatggtgatggtggtgatgatgac

SEQ ID NO: 4077 - DNA, 70 bp, Artificial Sequence
  Description of Artificial Sequence: Synthetic primer
  modified_base (26)..(26): a, c, t, g, unknown or other
  modified_base (28)..(29): a, c, t, g, unknown or other
  modified_base (31)..(31): a, c, t, g, unknown or other
  modified_base (35)..(35): a, c, t, g, unknown or other
  modified_base (37)..(38): a, c, t, g, unknown or other
  modified_base (40)..(40): a, c, t, g, unknown or other
ggtcatcaatcataccaccagtgatntnntnggcntnntntccaatgaggttaagagtattccaaactgg

SEQ ID NO: 4078 - DNA, 62 bp, Artificial Sequence
  Description of Artificial Sequence: Synthetic primer
  modified_base (27)..(27): a, c, t, g, unknown or other
  modified_base (29)..(29): a, c, t, g, unknown or other
  modified_base (31)..(32): a, c, t, g, unknown or other
  modified_base (34)..(34): a, c, t, g, unknown or other
  modified_base (36)..(36): a, c, t, g, unknown or other
cagtcaattttggccgaatatcacaanrntnntnanrgagttccaatacggagaaatcctgc

SEQ ID NO: 4079 - DNA, 66 bp, Artificial Sequence
  Description of Artificial Sequence: Synthetic primer
  modified_base (26)..(26): a, c, t, g, unknown or other
  modified_base (28)..(28): a, c, t, g, unknown or other
  modified_base (30)..(30): a, c, t, g, unknown or other
  modified_base (35)..(35): a, c, t, g, unknown or other
  modified_base (37)..(38): a, c, t, g, unknown or other
  modified_base (40)..(40): a, c, t, g, unknown or other
  modified_base (42)..(42): a, c, t, g, unknown or other
tcgtaatctgggcgtgtcgaatatcntnanrtatntnntnanrgtgtctgcggacaagctagtgac

SEQ ID NO: 4080 - DNA, 56 bp, Artificial Sequence
  Description of Artificial Sequence: Synthetic primer
  modified_base (24)..(24): a, c, t, g, unknown or other
  modified_base (26)..(26): a, c, t, g, unknown or other
  modified_base (31)..(31): a, c, t, g, unknown or other
  modified_base (34)..(34): a, c, t, g, unknown or other
gatttcacaatgtgatggctggantncctanranrctctcgaacccgaatggaaac

SEQ ID NO: 4081 - DNA, 23 bp, Artificial Sequence
  Description of Artificial Sequence: Synthetic primer
ggtcatcaatcataccaccagtg

SEQ ID NO: 4082 - DNA, 24 bp, Artificial Sequence
  Description of Artificial Sequence: Synthetic primer
cagtcaattttggccgaatatcac

SEQ ID NO: 4083 - DNA, 19 bp, Artificial Sequence
  Description of Artificial Sequence: Synthetic primer
tcgtaatctgggcgtgtcg

SEQ ID NO: 4084 - DNA, 22 bp, Artificial Sequence
  Description of Artificial Sequence: Synthetic primer
gatttcacaatgtgatggctgg

SEQ ID NO: 4085 - DNA, 25 bp, Artificial Sequence
  Description of Artificial Sequence: Synthetic primer
tgtgatattcggccaaaattgactg

SEQ ID NO: 4086 - DNA, 24 bp, Artificial Sequence
  Description of Artificial Sequence: Synthetic primer
gatattcgacacgcccagattacg

SEQ ID NO: 4087 - DNA, 23 bp, Artificial Sequence
  Description of Artificial Sequence: Synthetic primer
tccagccatcacattgtgaaatc

SEQ ID NO: 4088 - DNA, 24 bp, Artificial Sequence
  Description of Artificial Sequence: Synthetic primer
atctgcacgcaaggtaatcgtcag

SEQ ID NO: 4089 - DNA, 22 bp, Artificial Sequence
  Description of Artificial Sequence: Synthetic primer
ctgacgattaccttgcgtgcag

SEQ ID NO: 4090 - DNA, 23 bp, Artificial Sequence
  Description of Artificial Sequence: Synthetic primer
cactggtggtatgattgatgacc

SEQ ID NO: 4091 - DNA, 70 bp, Artificial Sequence
  Description of Artificial Sequence: Synthetic primer
ggtcatcaatcataccaccagtgatcttctgggccttctgtccaatgaggttaagagtattccaaactgg

SEQ ID NO: 4092 - DNA, 70 bp, Artificial Sequence
  Description of Artificial Sequence: Synthetic primer
ggtcatcaatcataccaccagtgatattatcggcattatctccaatgaggttaagagtattccaaactgg

SEQ ID NO: 4093 - DNA, 70 bp, Artificial Sequence
  Description of Artificial Sequence: Synthetic primer
ggtcatcaatcataccaccagtgatgttgtgggcgttgtgtccaatgaggttaagagtattccaaactgg

SEQ ID NO: 4094 - DNA, 70 bp, Artificial Sequence
  Description of Artificial Sequence: Synthetic primer
ggtcatcaatcataccaccagtgattttttcggctttttctccaatgaggttaagagtattccaaactgg

SEQ ID NO: 4095 - DNA, 70 bp, Artificial Sequence
  Description of Artificial Sequence: Synthetic primer
ggtcatcaatcataccaccagtgattggtggggatggtggtccaatgaggttaagagtattccaaactgg

SEQ ID NO: 4096 - DNA, 70 bp, Artificial Sequence
  Description of Artificial Sequence: Synthetic primer
ggtcatcaatcataccaccagtgatatgatgggcatgatgtccaatgaggttaagagtattccaaactgg

SEQ ID NO: 4097 - DNA, 70 bp, Artificial Sequence
  Description of Artificial Sequence: Synthetic primer
ggtcatcaatcataccaccagtgatacaacgggcacaacgtccaatgaggttaagagtattccaaactgg

SEQ ID NO: 4098 - DNA, 70 bp, Artificial Sequence
  Description of Artificial Sequence: Synthetic primer
ggtcatcaatcataccaccagtgattataagaaaggcaagaaaaatgaggttaagagtattccaaactgg

SEQ ID NO: 4099 - DNA, 70 bp, Artificial Sequence
  Description of Artificial Sequence: Synthetic primer
ggtcatcaatcataccaccagtgattatcatcatggccatcacaatgaggttaagagtattccaaactgg

SEQ ID NO: 4100 - DNA, 62 bp, Artificial Sequence
  Description of Artificial Sequence: Synthetic primer
cagtcaattttggccgaatatcacaaagcttctgggcgagttccaatacggagaaatcctgc

SEQ ID NO: 4101 - DNA, 62 bp, Artificial Sequence
  Description of Artificial Sequence: Synthetic primer
cagtcaattttggccgaatatcacaaagattatcggcgagttccaatacggagaaatcctgc

SEQ ID NO: 4102 - DNA, 62 bp, Artificial Sequence
  Description of Artificial Sequence: Synthetic primer
cagtcaattttggccgaatatcacaaaggttgtgggcgagttccaatacggagaaatcctgc

SEQ ID NO: 4103 - DNA, 62 bp, Artificial Sequence
  Description of Artificial Sequence: Synthetic primer
cagtcaattttggccgaatatcacaaagttctttggcgagttccaatacggagaaatcctgc

SEQ ID NO: 4104 - DNA, 62 bp, Artificial Sequence
  Description of Artificial Sequence: Synthetic primer
cagtcaattttggccgaatatcacaaagtggtggggcgagttccaatacggagaaatcctgc

SEQ ID NO: 4105 - DNA, 62 bp, Artificial Sequence
  Description of Artificial Sequence: Synthetic primer
cagtcaattttggccgaatatcacaaagatgatgggcgagttccaatacggagaaatcctgc

SEQ ID NO: 4106 - DNA, 62 bp, Artificial Sequence
  Description of Artificial Sequence: Synthetic primer
cagtcaattttggccgaatatcacaaagacgacaggcgagttccaatacggagaaatcctgc

SEQ ID NO: 4107 - DNA, 62 bp, Artificial Sequence
  Description of Artificial Sequence: Synthetic primer
cagtcaattttggccgaatatcacaaagaaaggagcagagttccaatacggagaaatcctgc

SEQ ID NO: 4108 - DNA, 62 bp, Artificial Sequence
  Description of Artificial Sequence: Synthetic primer
cagtcaattttggccgaatatcacacatcatggagcagagttccaatacggagaaatcctgc

SEQ ID NO: 4109 - DNA, 66 bp, Artificial Sequence
  Description of Artificial Sequence: Synthetic primer
tcgtaatctgggcgtgtcgaatatccttcactatcttctggatgtgtctgcggacaagctagtgac

SEQ ID NO: 4110 - DNA, 66 bp, Artificial Sequence
  Description of Artificial Sequence: Synthetic primer
tcgtaatctgggcgtgtcgaatatcattcactatatcattgatgtgtctgcggacaagctagtgac

SEQ ID NO: 4111 - DNA, 66 bp, Artificial Sequence
  Description of Artificial Sequence: Synthetic primer
tcgtaatctgggcgtgtcgaatatcgttcactatgttgtggatgtgtctgcggacaagctagtgac

SEQ ID NO: 4112 - DNA, 66 bp, Artificial Sequence
  Description of Artificial Sequence: Synthetic primer
tcgtaatctgggcgtgtcgaatatcttccactatttctttgatgtgtctgcggacaagctagtgac

SEQ ID NO: 4113 - DNA, 66 bp, Artificial Sequence
  Description of Artificial Sequence: Synthetic primer
tcgtaatctgggcgtgtcgaatatctggcactattggtgggatgtgtctgcggacaagctagtgac

SEQ ID NO: 4114 - DNA, 66 bp, Artificial Sequence
  Description of Artificial Sequence: Synthetic primer
tcgtaatctgggcgtgtcgaatatcatgcactatatgatggatgtgtctgcggacaagctagtgac

SEQ ID NO: 4115 - DNA, 66 bp, Artificial Sequence
  Description of Artificial Sequence: Synthetic primer
tcgtaatctgggcgtgtcgaatatcacacactatacaacggatgtgtctgcggacaagctagtgac

SEQ ID NO: 4116 - DNA, 66 bp, Artificial Sequence
  Description of Artificial Sequence: Synthetic primer
tcgtaatctgggcgtgtcgaatatctccaagtataaagcaaaggtgtctgcggacaagctagtgac

SEQ ID NO: 4117 - DNA, 66 bp, Artificial Sequence
  Description of Artificial Sequence: Synthetic primer
tcgtaatctgggcgtgtcgaatatctcccattatcacgcacatgtgtctgcggacaagctagtgac

SEQ ID NO: 4118 - DNA, 56 bp, Artificial Sequence
  Description of Artificial Sequence: Synthetic primer
gatttcacaatgtgatggctggacttcctgaggaactctcgaacccgaatggaaac

SEQ ID NO: 4119 - DNA, 56 bp, Artificial Sequence
  Description of Artificial Sequence: Synthetic primer
gatttcacaatgtgatggctggaattcctgaggaactctcgaacccgaatggaaac

SEQ ID NO: 4120 - DNA, 56 bp, Artificial Sequence
  Description of Artificial Sequence: Synthetic primer
gatttcacaatgtgatggctggagttcctgaggaactctcgaacccgaatggaaac

SEQ ID NO: 4121 - DNA, 56 bp, Artificial Sequence
  Description of Artificial Sequence: Synthetic primer
gatttcacaatgtgatggctggattccctgaggaactctcgaacccgaatggaaac

SEQ ID NO: 4122 - DNA, 56 bp, Artificial Sequence
  Description of Artificial Sequence: Synthetic primer
gatttcacaatgtgatggctggatggcctgaggaactctcgaacccgaatggaaac

SEQ ID NO: 4123 - DNA, 56 bp, Artificial Sequence
  Description of Artificial Sequence: Synthetic primer
gatttcacaatgtgatggctggaatgcctgaggaactctcgaacccgaatggaaac

SEQ ID NO: 4124 - DNA, 56 bp, Artificial Sequence
  Description of Artificial Sequence: Synthetic primer
gatttcacaatgtgatggctggaacacctgaggaactctcgaacccgaatggaaac

SEQ ID NO: 4125 - DNA, 56 bp, Artificial Sequence
  Description of Artificial Sequence: Synthetic primer
gatttcacaatgtgatggctggaaagcctgaggaactctcgaacccgaatggaaac

SEQ ID NO: 4126 - DNA, 56 bp, Artificial Sequence
  Description of Artificial Sequence: Synthetic primer
gatttcacaatgtgatggctggacatcctgaggaactctcgaacccgaatggaaac

SEQ ID NO: 4127 - DNA, 22 bp, Artificial Sequence
  Description of Artificial Sequence: Synthetic primer
cttgaaattggaagggagattc

SEQ ID NO: 4128 - DNA, 23 bp, Artificial Sequence
  Description of Artificial Sequence: Synthetic primer
gtataaacttttcagttgcagac

SEQ ID NO: 4129 - protein, 401 aa, Aspergillus niger
  strain CBS 513.88 / FGSC A1513
MAFIKYALPALAAAQAAMAASCGSSGSTITISSQSDLDSYATCTTLKGDVEISESASGDLTLNGVTSIAGGLSCTGGSNITSFSSSSLSSIGDTFKLDGLTTLTTLSLTNLTSVGSISWTALPELQSLDFTKGVSEAGSVTITNTGLTSLDGISLKTVGTFDITENTNLKTVNVNELTNATGLINFAGNMDSLQIILPNLGTGTNMTFRNVSGVSIPSLETLSGQLGFWGNTFTNFSAANLTTTGDLVFDDNTKLNNISMPVLKTVNGGFQIARNDKLKSINFPDLKEVTGAIDFSGDFDEVSLSSLTEVKGGFNMQSTGNFSCSAFKTLRENNVIRGTYTCKASTSDPTTSDGSSGTTTSTGSSSSSSSTSSDSASVMNVANMPALGLAAVLGGLIQYAL

SEQ ID NO: 4130 - protein, 696 aa, Aspergillus niger
  strain CBS 513.88 / FGSC A1513
MAGSKAVALLFLLVNLTTASVIPRGQASSSAVAASASASAEASCWRYTLPTTLTEDDIEQNEDDTTSSTRRRGLNYYDRRDHTKTEKLGKCDLGQTIYKPKYFRSKNIQSGQTKASGYSFLGYFIPKLDSCEAAVTFTTIANAADVPKTTAGYWDDVETDSLQNYLDLGAQINKNNQEMPHINVDHVYELQILDAFLADIIEEYDFCDSFKEWFLTIDTTFKNKQGVNKPRLQKLYSYLPGETYPELVAMDSRLNSYKAPMFGTTALSGMAAVEGTGDARQSSALSIMNTLAVVVSMLRDNSVATYFKDTNTRMFKAFLGIDTLMNQDTCNSNLPKPKDGWATAYKSWMNKFMTEQANAVSTRISSVSAQVTSTADAAGVKNSYGKALDAFNAKYPTASWKWDENQLLDWSATDGTAFAKRGASSAAVCTPTATPSSSAVKSHSASSKATPSQTAGATTASETASHTVKSTVTSSSQKATITPATSTSTKAETTTKSKHSSGSAEAAQTTKSTSSKPKDTASATTKSSSSSAKDTATITSTKTTSTATPDSHDTSTKDTSTKDTTTTTSTSTKTKETTTSTKTSTTTKSTKTATKTTTKSSEETKDSSSSSSSCKKKKCKKGIVSELQMVDIIKGGATATPAKLPSHQPLLMPHHFRPQFLGWFSKFYKEHVLIPKASLSKFADCQSKKPERRAQG

SEQ ID NO: 4131 - protein, 338 aa, Aspergillus niger
  strain CBS 513.88 / FGSC A1513
MAILLTVAALAALVIQSVAASPLMDTLLQIPDLSTYAEVYNLTGGIVEINPLFLKRYNYDEDKRNYTFLAPTNDAWAKIPDAIFTTLMTQQAYPLTEALLRTHIIEARLTASELVKLSESEGAGGISTSLQLSNTTEQYHNGVLTKTVQGYYIDSVISSNGTVQIDDQAAIVTANIVADNGLIHAIDQVIDPFLIYGGGPSNRTLAPTSETTNLTIGELLKIDSRLVNSSKILTENSPDTLRRLSKQTGSMQFFVAPQNEAYDLMPTILPIFHTLVAPYKSPFNTLMWQYGWLDSDGETFADLNFTRPVTVASDVTGLNITVTQEKSAIFIMNAGLVT

SEQ ID NO: 4132 - protein, 250 aa, Bacillus subtilis
  strain 168
MAKPLSKGGILVKKVLIAGAVGTAVLFGTLSSGIPGLPAADAQVAKAASELPNGIGGRVYLNSTGAVFTAKIVLPETVKNNDSVSTPYIYSGFRATSGTEADIGLQYSKQYNVWKPLMKVGSKNEETYIEGKDKFTYNKGFRPGSTVQMTIYKNLSGNTRMTLWGTNNDGYTGRIITEIQGTNIGTISKWKTLATAAVSYESQRDAIKATFSTSFNNITIDNKAVTPVVDTQDFAKVSVAGNNVTISVNK

SEQ ID NO: 4133 - protein, 392 aa, Aspergillus niger
  strain CBS 513.88 / FGSC A1513
MAPKSLFYSLFSTISVALASSIPQTDYDVIVVGGGPAGLSVLSSLGRMRRKTVMFDSGEYRNGVTREMHDVLGFDGTPPAQFRGLARQQISKYNSTSVIDIKIDSITPVEDAAANSSYFRAVDANGTQYTSRKVVLGTGLVDVIPDVPGLREAWGKGIWWCPWCDGYEHRDEPLGILGGLPDVVGSVMETHTLYSDIIAFTNGTYTPANEVALAAKYPNWKQQLEAWNVGIDNRSIASIERLQDGDDHRDDTGRQYDIFRVHFTDGSSVVRNTFITNYPTAQRSTLPEELSLVMVDNKIDTTDYTGMRTSLSGVYAVGDCNSDGSTNVPHAMFSGKRAGVYVHVEMSREESNAAISKRDFDRRALEKQTERMVGNEMEDLWKRVLENHHRRS

SEQ ID NO: 4134 - protein, 537 aa, Aspergillus niger
  strain CBS 513.88 / FGSC A1513
MARLLKAVTVCALAGIAHAFNYDQPYRGQYHFSPQKNWMNDPNGLLYHNGTYHLFFQYNPGGIEWGNISWGHATSEDLTHWEEQPVALLARGYGSDVTEMYFSGSAVADVNNTSGFGKDGKTPLVAMYTSYYPVAQTLPSGQTVQEDQQSQSIAYSLDDGLTWTTYDAANPVIPNPPQPYQAQYQNFRDPFVFWHDESQKWVVVTSIAELHKLAIYTSDNLKDWKLVSEFGPYNAQGGVWECPGLFKLPLDGGSSTKWVITSGLNPGGPPGTVGSGTQYFVGEFDGTTFTPDADTVYPGNSTANWMDWGPDFYAAAGYNGLSIKDHVHIGWMNNWQYGANIPTYPWRSAMAIPRHLALKTINNKTTLVQQPQEAWSSISSKHPLYSRTYSTFSEGSTNASTTGETFRVDLSFSATSKASTFAIALRASANFTEQTLAGYDFAKQQIFLDRTKSGDVSFDNTFASVYHGPLVPDSTSMVRLSIFVDRSSVEVFGGQGETSLTAQIFPSNDAVHARLVSTGGATEDVRVDVHNITSTWN

SEQ ID NO: 4135 - protein, 371 aa, Aspergillus niger
  strain CBS 513.88 / FGSC A1513
MASKTLLLIPALATAALGSVLDLDIKVDLGTPGGPFDLMYDTGSSTLWVLDSNCTDDCPNVSGYSRHGYNLTSTGVNLGVNDSIAYSGGTVSGFTATDILTVPDTNVSYRQSFAVITDSTWAALAADGFIGLASSTIAFKNTTTAVEQMMQDGLLDEPRFAIYAGSGESTVTNPNPENNGVFTFGGSHEETYADGELQWMKMLSPFEIYKTNLLGIQGHNNSDGQALSSDVLNWYGQTNLFNVAGASSISIPNDQIEAMYALTPFSYADISSGYRPLCSDFNDTWSISFTMGFYGEGVTFNLTGDQLAVPGYQDDDHCFPPFNPWDSYNTIIGQHWLSNFYAVFDFGSFDPETYDIRVGLAPLKKEYLPSA

SEQ ID NO: 4136 - protein, 470 aa, Aspergillus niger
  strain CBS 513.88 / FGSC A1513
MASVTALLTLAGLAAGATITTTEPPLAAIQRAQATTVPQTWTSNVTGKSFDRFYQIWLENVDYVNAANDTNQQWLASKGITLVNYYGVGHTSQPNYCASVSGDNYGMDNDNFHNIPSNVSTLADLLNPKGISWAHYQEHLPYPGFQGYNYSNQRTGANDYMRKHDPLVMFDKISSNDTALRLIKNFTNFEEDMKNKVLPQWAFITPNMTNDAHDTNITYGSKWLRSFVEPLMNNTYFWDNTLLLLTFDETETYGVPESEIYNDRNRVFSILLGGAVPEHLIGTKDETVYTHYSTLATVEANWGLPSLGRWDCGANIFSFVADKVGYTNWDVDPTHLYINQSLPGPLEQWGYSKYRANWPIPTTNDTCSAGNGILQSVIDAYKGQNPTYNYTAPFPYDASYGLDVNIPYSRNGTTYVSGVNTTGVVGYDTNTTTSSSSSASSSAAVSAGSAMTMPAAGSVAAIFAAVVAFL

SEQ ID NO: 4137 - protein, 322 aa, Bacillus subtilis
  strain 168
MEERSQRRKKKRKLKKWVKVVAGLMAFLVIAAGSVGAYAFVKLNNASKEAHVSLARGEQSVKRIKEFDPGKDSFSVLLLGIDAREKNGETVDQARSDANVLVTFNRKEKTAKMLSIPRDAYVNIPGHGYDKFTHAHAYGGVDLTVKTVEEMLDIPVDYVVESNFTAFEDVVNELNGVKVTVKSDKVIQQIKKDTKGKVVLQKGTHTLDGEEALAYVRTRKADSDLLRGQRQMEVLSAIIDKSKSLSSIPAYDDIVDTMGQNLKMNLSLKDAIGLFPFITSLKSVESIQLTGYDYEPAGVYYFKLNQQKLQEVKKELQNDLGV

SEQ ID NO: 4138 - protein, 975 aa, Aspergillus niger
  strain CBS 513.88 / FGSC A1513
MERKHRWGSSFLLMWLLAAEGVYSAPRRSSSTASPKTQFPPGAETERILPGTNGLYPTSLEREGHPVLPTPTSTGNTKDPWGLDGLLESLGDTADLPNELLSEFLPGWGKNYPVTVPVSAYKPASAETTSSATEPQTQPETSDTSTPQAPSQNVPEATTDSSQVSSQASSTTSLTQPSSTTSTTQLSSTTSPTQPTSSASSAQPSSSASLTTTASQTTQADNSITSSVVQASVTPMSGQDVFVPLATTPFPQTITARNDHPVPKKGIENVTTPIETNKFYAGLFLGSQSNTTFTHPYGLSWAKGSGNAKSYGMAISHNEVNVVANGPTNANIPGNPISYYINPIGIQHMILSATELNTSTVLTAENLLPFSADAVLSPTPGSSQRITIPLVQGMGFVTGMYNNLQPLIQSGVFFSKVVTASSPRIGIYKYKVSLADGTEWLVYAIPQDGKDPDFRLESNTDFRGPSGWSGTVQITKNPAGDSGEKLLDGSSGVFALEAAVSGSVQDNSGTYNLAFAKSGKQLQQTPLLMYALPHHVESFDNTTKGRMTSITLRTTTKGNATAVVGETWTMLEPNLPTQMGFDPWSVSAGNVNNLSAAAKQVILSVAPTELNQSIDQQSDLNSMYYSGKALSKFATLVYTVNKLGGNPDLAASALQNLKTAFSRFVDNKQQFPLVYDSVWKGVVSSASYGGDSGADFGNTYYNDHHFHYGYFIHAAAIIGSLDSTWLTDSNKAWVNMLVRDAGNSAANDPYFPFSRSFDWYHGHSWAKGLFESFDGKDEESTSEDTMFAYALKMWGKTIGDASMEARGNLMLGILRRSLHNYFLMESDNKNQPANFIANKVTGILFENKVDHTTYFGNNLEYIQGIHMLPLLPSSPYVRSQNFVREEWNALFSANATDPALNVTGGWKGVLYANLALIDPASSWNFFAQSNFDYSWIDGGASRTWYLAFAAGQYIPPTSQSMMLLTTYAGLGGGPA

SEQ ID NO: 4139 - protein, 659 aa, Bacillus subtilis
  strain 168
MFAKRFKTSLLPLFAGFLLLFHLVLAGPAAASAETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAAISNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITLRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 4140 - protein, 490 aa, Bacillus amyloliquefaciens
  strain ATCC 23350 / DSM 7 / BCRC 11601 / NBRC 15535 / NRRL B-14393
MFIIEFQMRTGFKVKGRKEKVKKSLLTLGLASVIGTSSFLIPFTKTASAETLDSKKAKIESKQSEVASSLEAKEKELSKLQDKQAKIEKELKDINAKALDTSNKIEDKKAENEKTKKQIADLKKEIKETEARIEKRNEILKKRVRSLQENGGSQGYIDVLLGATSFGDFISRATAVSSIVDADKDLIKQQEQDKAKLEDAEAELNVKLKKVQDDLAKLESMQKDLNKQLDQKDKLFDEAKNGQKKAASAISDLKKEASQLANEKADTEKEQKRIKEEQAAAAALIKKQEEAQKASEDQNQKDDSQPAPAVKTVKKAAVSTETSDSSDSSSKPSNSGGSSHNSGGSDDSDGGSVISNSGGIEGAISVGSSLVGQSPYKFGGGRTQSDINNRIFDCSSFVRWAYANAGVNLGPVSGTSTDTLIGRGEAVSASDMKRGDLVFFDTYKTNGHVGIYLGNGTFLNDNTSHGVSIDSMSNPYWKKVFNGNVRRVVQ

SEQ ID NO: 4141 - protein, 213 aa, Bacillus subtilis
  strain 168
MFKFKKNFLVGLSAALMSISLFSATASAASTDYWQNWTDGGGIVNAVNGSGGNYSVNWSNTGNFVVGKGWTTGSPFRTINYNAGVWAPNGNGYLTLYGWTRSPLIEYYVVDSWGTYRPTGTYKGTVKSDGGTYDIYTTTRYNAPSIDGDRTTFTQYWSVRQSKRPTGSNATITFSNHVNAWKSHGMNLGSNWAYQVMATEGYQSSGSSNVTVW

SEQ ID NO: 4142 - protein, 159 aa, Bacillus subtilis
  strain 168
MFKKLLLATSALTFSLSLVLPLDGHAKAQEVTLQAQQEVTYQTPVKLSELPTNTTEQSGEFHTNGIKKWIAKEAMKATASALRHGGRIVGEVVDELGGSAGKTFAKHTDDVADALDELVKRGDVVEDAIIDTVSSYLIDAGVKSSTARTIASVFTFLAF

SEQ ID NO: 4143 - protein, 319 aa, Bacillus subtilis
  strain 168
MFKKWSGLFVIAACFLLVAACGNSSTKGSADSKGDKLHVVTTFYPMYEFTKQIVKDKGDVDLLIPSSVEPHDWEPTPKDIANIQDADLFVYNSEYMETWVPSAEKSMGQGHAVFVNASKGIDLMEGSEEEHEEHDHGEHEHSHAMDPHVWLSPVLAQKEVKNITAQIVKQDPDNKEYYEKNSKEYIAKLQDLDKLYRTTAKKAEKKEFITQHTAFGYLAKEYGLKQVPIAGLSPDQEPSAASLAKLKTYAKEHNVKVIYFEEIASSKVADTLASEIGAKTEVLNTLEGLSKEEQDKGLGYIDIMKQNLDALKDSLLVKS

SEQ ID NO: 4144 - protein, 569 aa, Aspergillus niger
  strain CBS 513.88 / FGSC A1513
MFLSLPLLGTLIASTVALDSSPLELRVPHLHQLSQLSKSHQASLNQDSASFPVYNLSVPIDHFHDESRYEPHTNATFGLRYWLDTSHYQPGGPVFVIAAGETDGSDRIPFLSQGVVTQLAAAYHGIGLILEHRYYGESYPFTNLTTENIRFLTTEQALADYAYFASNIVFPGLEDLDLTAATTPWIAYGGSYAGAFVAFLRKLYPELYWGAVSSSGVTEAIIDYWEYYEPIRLYGPSQCISTIQTSIDIVDRILIDHADNKTLAQQLKSAFGGSATNLSNQDFVSSLSYGLDSFQSRNWDKTIGTPLFRAFCNNITNSDLLYPEAAEPISASVKQLVQIAGYDPSNTTLVNNFLNWIGFLSTSKVFADSSSESSSSNITNFTTPQPLSKDSGTSWNYQVCVEWGYFTTGSSVPSTTKPLISRLLDLPYLSSFCPNTFGIKTPPDVQRINQFGGFNFSYPRVAIIGGLADPWRDATPLADGVDWQSRKSSDSEPIILLDIPAADVWDGVRGAVHHWDQNGLSGQQKKEGEKAPKEIVSVHEEVVRFVGVWLKEWKGKQSDADERVYQTVL

SEQ ID NO: 4145 - protein, 469 aa, Bacillus subtilis
  strain 168
MFNRLFRVCFLAALIMAFTLPNSVYAQKPIFKEVSVHDPSIIETNGTFYVFGSHLASAKSNDLMQWQQLTTSVSNDNPLIPNVYEELKETFEWAQSDTLWAADVTQLADGKYYMYYNACRGDSPRSAMGVAVADNIEGPYKNKGIFLKSGMEGTSSDGTPYDATKHPNVVDPHTFFDKDGKLWMVYGSYSGGIFILEMNPKTGFPLPGQGYGKKLLGGNHSRIEGPYVLYNPDTQYYYLYLSYGGLDATGGYNIRVARSKKPDGPYYDAEGNPMLDVRGKGGTFFDDRSIEPYGVKLMGSYTFETENEKGTGYVSPGHNSAYYDEKTGRSYLIFHTRFPGRGEEHEVRVHQLFMNKDGWPVAAPYRYAGETLKEVKQKDITGTYKLIQHGKDISADIKQTINIQLNKNHTISGEMTGTWRKTGKNTADITLAGKKYNGVFLRQWDSVREKNVMTFSVLNTSGEAVWGSK

SEQ ID NO: 4146 - protein, 486 aa, Aspergillus niger
  strain CBS 513.88 / FGSC A1513
MFPTYTQLFAAACAFATTANAVTPIEVKGKDFVNSKTGDRFQILGVDYQPGGSSGFSATQDPLSDADACLRDAALMQNLGINTIRVYNLSPNVDHSKCASIFNGAGIYMILDVNSPLSGGSLDRTNPSSTYNSVYYEQVFGVIEAFKNFPNTLGFFAGNEVINEQSVYEAPAYVRAVVRDMKDYISTNVNRSIPVGYSAADVRPILMDTLDYFECNLENSTSSRSDFFGLNSYSWCGESSYKASGYDVLTEDFSNASLPVFFSEYGCNAVQPRVFTEVQALYGSEMDQVFSGGLVYEWTQEANDYGLVAINSSDTATLLVDYENLQKQYNKLDMSSIESSNSSQTSKEAVTCSSDLITNNTFLNSWDLPTVPSKVADWIKNGYSNATVGSLVAVSATTIPQTIYDYNGNKVSSVKYKVLSGDESNTPGNSTSLTSSSNSSSTSSSSSSSSSGSGSSSDDSTSGSSALSAPFMGVLTGATLFAVFML

SEQ ID NO: 4147 - protein, 500 aa, Aspergillus niger
  strain CBS 513.88 / FGSC A1513
MFRLKMEVLTAIAAWAFATVSQQIPRSSSWESDLQTLSGRLSNTSQIYYPGSSGFTNATTRWSVLDEPEVNVVVVPGTENDVAEIVKFANQKDVPFLTYNGVHGALISLGEMTHGIAIYMGQLSSVEVAADGKTATIGGGTMSKEVTDQLWAAGKQTVTGTCECVSLVGPALGGGHGWLQGHHGLVLDQFVSMNIVLANGTLTHIDANSDLWWAVKGAGHNFGIVTSLTMKIYDIEYSDWAIETLTFSGDKVAEVYQAANDYLVKNGTQAAGVINWSYWMNNADADPNNPVIIFYIIQEGVKTVDSVYTAPFRKIGPISVSPNNGTYKDLAAWTEVAVDSAPCQKMGMANPRYPIYLETYNVTAQQKAWDVYANATRGFSAFNNSIFMFEGYSVGGVHDVDSRSSAFAFRNENVLAAPMINYYPDGAELDRRGANLGQELRNILFAGTDHEDIRAYVNYAHGDETPQQLYGSEGWRQQRLRSLKAKYDPTGKFSYYAPIP

SEQ ID NO: 4148 - protein, 297 aa, Aspergillus niger
  strain CBS 513.88 / FGSC A1513
MFSGRFGVLLTALAALSAAAPTPLDVRSVSTSTLDELQLFSQWSAAAYCSNNIDSDDSNVTCTADACPSVEEASTKMLLEFDLTNNFGGTAGFLAADNTNKRLVVAFRGSSTIKNWIADLDFILQDNDDLCTGCKVHTGFWKAWEAAADNLTSKIKSAMSTYSGYTLYFTGHSLGGALATLGATVLRNDGYSVELYTYGCPRVGNYALAEHITSQGSGANFRVTHLNDIVPRLPPMDFGFSQPSPEYWITSGTGASVTASDIELIEGINSTAGNAGEATVDVLAHLWYFFAISECLL

SEQ ID NO: 4149 - protein, 499 aa, Aspergillus niger
  strain CBS 513.88 / FGSC A1513
MFSRRNLVALGLAATVSAGPCDIYEAGDTPCVAAHSTTRALYSSFSGALYQLQRGSDDTTTTISPLTAGGVADASAQDTFCANTTCLITIIYDQSGNGNHLTQAPPGGFDGPDVDGYDNLASAIGAPVTLNGQKAYGVFMSPGTGYRNNEATGTATGDEPEGMYAVLDGTHYNDACCFDYGNAETSSTDTGAGHMEAIYLGNSTTWGYGAGDGPWIMVDMENNLFSGADEGYNSGDPSISYSFVTAAVKGGADKWAIRGGNAASGSLSTYYSGARPDYSGYNPMSKEGAIILGIGGDNSNGAQGTFYEGVMTSGYPSDDVENSVQENIVAAKYVSGSLVSGPSFTSGEVVSLRVTTPGYTTRYIAHTDTTVNTQVVDDDSSTTLKEEASWTVVTGLANSQCFSFESVDTPGSYIRHYNFELLLNANDGTKQFHEDATFCPQAPLNGEGTSLRSWSYPTRYFRHYDNVLYAASNGGVQTFDSKTSFNNDVSFEIETAFAS

SEQ ID NO: 4150 - protein, 626 aa, Aspergillus niger
MFSSTLVSLAVSWLAGQALAIELTVSKTGGNSSSPLLYGVMFEDINNSGDGGIHGQVLRNNGFQGDDPGLTAYSAVGNVTISQDTANPLSSAITSTLKVAVPSGATGYVGFANEGYDGVPVLGTDYDNYFYMKGDYSGTVNLRLVGNSSGIIYADHNITVASTSSNFTYYETSFSSSVSSDAHNVWQLRFDASKVAGSSLNFGLVQLFPPTYNSRYNGLRDDVASFLADIKPSFLRFPGGNNLEGATPSDRWKWNETIGPVVDRPGREGDWTYPNTDALGLDEYLQWCEDMDMEPLLAVWSGLSLGGGIVSGSALDPYVDDILNELEQYVLGSADTTYGSLRAKNGRTEPWDVKYLEVGNEDNLNSGCGTYANRFTLIYDAVHAAYPNLTIVASTTDTSCLPSTIPDGVITDIHHYLTPDEFIDLFDEWDNWSRDWPILVGEYASTTGNDGSTTYWSYMQGSCSEAVYMIGMERNSDIVKMASFAPLLEHFDMAEWSPDLFGLDSSPDSVTGSTSYYVQKMFSTNRGSTVLPVNTTADFDPLYWVASVSDEGTYYVKLANYGSSSQNVTVNIEGTTSGQLQMLSGGETVSNYPHDVSITTQSSTVSGSGSFTVDMPAWAVAVLAVS

SEQ ID NO: 4151 - protein, 416 aa, Aspergillus niger
  strain CBS 513.88 / FGSC A1513
MFVESAKKALLALSLLAASAQAVPRVRRQGASSSFDYKSQIVRGVNLGGWLVTEPWITPSLYDSTGGGAVDEWTLCQILGKDEAQAKLSSHWSSFITQSDFDRMAQAGLNHVRIPIGYWAVAPIDGEPYVSGQIDYLDQAVTWARAAGLKVLVDLHGAPGSQNGFDNSGHRGPIQWQQGDTVNQTMTAFDALARRYAQSDTVTAIEAVNEPNIPGGVNEDGLKNYYYGALADVQRLNPSTTLFMSDGFQPVESWNGFMQGSNVVMDTHHYQVFDTGLLSMSIDDHVKTACSLATQHTMQSDKPVVVGEWTGALTDCAKYLNGVGNAARYDGTYMSTTKYGDCTGKSTGSVADFSADEKANTRRYIEAQLEAYEMKSGWLFWTWKTEGAPGWDMQDLLANQLFPTSPTDRQYPHQCS

SEQ ID NO: 4152 - protein, 521 aa, Bacillus subtilis
  strain 168
MGLGKKLSVAVAASFMSLSISLPGVQAAEGHQLKENQTNFLSKNAIAQSELSAPNDKAVKQFLKKNSNIFKGDPSKRLKLVESTTDALGYKHFRYAPVVNGVPIKDSQVIVHVDKSDNVYAVNGELHNQSAAKTDNSQKVSSEKALALAFKAIGKSPDAVSNGAAKNSNKAELKAIETKDGSYRLAYDVTIRYVEPEPANWEVLVDAETGSILKQQNKVEHAAATGSGTTLKGATVPLNISYEGGKYVLRDLSKPTGTQIITYDLQNRQSRLPGTLVSSTTKTFTSSSQRAAVDAHYNLGKVYDYFYSNFKRNSYDNKGSKIVSSVHYGTQYNNAAWTGDQMIYGDGDGSFFSPLSGSLDVTAHEMTHGVTQETANLIYENQPGALNESFSDVFGYFNDTEDWDIGEDITVSQPALRSLSNPTKYNQPDNYANYRNLPNTDEGDYGGVHTNSGIPNKAAYNTITKLGVSKSQQIYYRALTTYLTPSSTFKDAKAALIQSARDLYGSTDAAKVEAAWNAVGL

SEQ ID NO: 4153 - protein, 261 aa, Bacillus amyloliquefaciens
  strain ATCC 23350 / DSM 7 / BCRC 11601 / NBRC 15535 / NRRL B-14393
MGMKKKLSLGVASAALGLALVGGGTWAAFNDVKSTDATFASGTLDLSAKEQSANVNLSNLKPGDKLTKDFEFRNNGSLAIKEVLMALNFTDFKGAKKGNESAEDFLSQFEITVLTVGKEGGNGYPKNIILKAASLKDLYLMSAKQDKAAAEAISKHIDPKFLSESGKVNVATINGKTAPEYDGVPKTPVDYDQVRMEIRFKNDTAKDANGLSVQNKFQGNAISLQFSFEATQWNGLTITKDHTDKDGYVKENEKAHSEDKN

SEQ ID NO: 4154 - protein, 581 aa, Aspergillus niger
  strain CBS 513.88 / FGSC A1513
MGVMRKTADQALGLTATALALVSAAQATSPSVTVSQGLIRGFEHNDTNVFLGIPFAETTAGENRWKAPKALSSFAGGEFNATTYGPSCAQAMSGTAITAQSEDCLSMNIWTPLSGSDLPVFVYVYGGAMVTGGSSNAQWQGYNFARKDVIYVNFNYRESIYASPNAPELEGQSQNFGIMDVDLAVQWVYDNIEAFGGNKSNIVLGGHSSGGVHVDHYLWNHPETFLAGAVEMSANAESGPAYAPTGVALAQVVEDMLAAGVTLGCDASNYTLDCLREADTYAFQTSYFNSTSNTWFSPIVDNITRFSNYTDRFAQGYYPKSLPLMVGNSDQEGRLFAYAYASENTKFNKWIHTFDADVAWVPSAELLAAYNSADYSSVSFESGACYGDARFLCATDYLVDVRSSEQPTWIYRWFGNYSNVLGIADIGPSHGSEVPFFHGGNECFSKLSDVTTAEQELADYMNDWFVAWIKAPSAGPGWDKAQPVNGPLARLGVPGNELAIEMSTTDIISFKDFISVSRLRLAPILAGSRLAPSAARLQLSLHVPGPERIVTRARRSPAGLQEHTTHHCATWCDAEDGRGQP

SEQ ID NO: 4155 - protein, 362 aa, Aspergillus niger
  strain CBS 513.88 / FGSC A1513
MHFLQNAVVAATMGAALAAAAPLEKRSCTFTSASAAKSGKSSCSTITLDNIAVPAGETLDLTGLKKGTTVIFEGETTFGYKEWKGPLISMSGTDITVKQASGAKINCDGARWWDGKGSNGGKTKPKFFQAHKLDQSSITGLKVYNTPVQGFSILADHLTITDVTIDNSAGTSKGHNTDAFDIGQSTYITIDGATVYNQDDCLAINSGEHITFTNGYCDGGHGLSIGSIGGRSDNTVNDVTISNSKVLNSQNGVRIKTIYGKTGTVENVKFEDITLSDISKYGIVVEQDYENGSPTGTPTNGVKVEDITFKKVTGSVKSSGTDIYILCGSGSCSNWTWSGVDVTGGKKSSKCKNVPSGASCSD

SEQ ID NO: 4156 - protein, 513 aa, Aspergillus niger
  strain CBS 513.88 / FGSC A1513
MHLSSLSLSLTALAIVSPSAAYPHLGSSQPVLHTNSDTTQSRADAIKAAFSHAWDGYLQYAFPHDELHPVSNGYGDSRNGWGASAVDALSTAVIMRNATIVNQILDHVAKIDYSKTNTTVSLFETTIRYLGGMLSGYDLLKGPVSDLVQDSSKIDVLLTQSKNLGDVLKFAFDTPSGVPYNNLNITSGGNDGAKTNGLAVTGTLALEWTRLSDLTGDTTYADLSQKAESYLLNPQPKSAEPFPGLVGSNINISNGQFTDAQVSWNGGDDSYYEYLIKMYVYDPKRFGLYKDRWVAAAQSTMQHLASHPSTRPDLTFLASYNNGTLGLSSQHLTCFDGGSFLLGGTVLNRTDFINFGLDLVSGCHDTYNSTLTGIGPESFSWDTSDIPSSQQSLYEKAGFYITSGAYILRPEVIESFYYAWRATGQETYREWIWSAFSAVNDYCRTDSGFSGLTDVNAANGGSRYDNQESFLFAEVMKYSYMAFAEDAAWQVQPGSGNQFVFNTEAHPVRVSST

SEQ ID NO: 4157 - protein, 454 aa, Aspergillus niger
  strain CBS 513.88 / FGSC A1513
MHPSALVGLLAFAAAASAIPANPSHKAHSDSAVQNLKSKIKNVVVLVMENRSVDNLLGGQTIKGLENPINNGPYCNPYNITDLSQGTVCSAARDYDSVTDDPDHAVYGNNIEFYGTFTPDNAAIAQGKLTPSQQGFVTEQLRLYSADANRTELSVQVMNYYTEQQVPVLTSLVQNYVVFNHWHSDVPGPTNPNRAALTSGTSYGHGTNDEAFDNHAFPQRSIFQQLTETGHSWINYWDTAGGTGPDAEFYNWTYTSNNTDKVKALEQFYTDAAAGALPEFSYVNPSCCGVGTNSMHPSGLISDGEKLIKNVYDALRAGPQWNETLFILSFDETGGFHDHVPPPLAPRPDNLTYTATTPSGEDYTFNFNRLGGRIPTLLISPWVGKGYVEQKGTSVTGETVSYSASSILRTLGYLWDFDPFTPRVEYAPSFEHLVQTRARDNTPTALPSPVPFRK

SEQ ID NO: 4158 - protein, 403 aa, Aspergillus niger
  strain CBS 513.88 / FGSC A1513
MHVKSYLSAVLYGLPALTQVAAAKSTGDPFQLYTISAENITAKLIPYGARLTSLLVPDRDGNFQDVVVGYDDPKQYLKDTETNHTYFGAVVGRYANRIKNGTFSIGSDVYHIPENENDGEDTLHGGTVGYDQRNWTVTAYSNSSITFTLVDRAFEDFPGDVITHATFSVQTKVTPENPQGLPQLTTKLVSLALTETTPIMLANHIYWNLNAFKDETILEDTWLQLPLSKRLIGTNGILIPNGTILDVDVYDGAPDFVSGKLVGQDIEKTDGLCGTDCIGYDNCFIVDRPPQYAARNSIVPIIHMNSSTTGISLDVATNQQALQIYACNSQNGTIPVKQSQVQRNKAEGVDGAEYVNQHGCIVIETEGWIDGINNPQWGQLPDQIYSPETGPAVNWATYQFGTV

SEQ ID NO: 4159 - protein, 651 aa, Aspergillus niger
  strain CBS 513.88 / FGSC A1513
MIDPLSLLVLFGVAGSSQLAYASPVTQKAEATRATSYSYSSFTYTQVTSTRYATSLSAPLSFATPFAPAFSKASTLLPSNVTYTTYSLQPSQTLSPDGEYGQSAYAALWANLSYTSAPPITTTVSPTPVPSSELVYPPTLYNRIDYADLKLPSDFIWGVAASAWQIEGGLKLEGRGTSILDTIGAIQSDDNSSDANIADLSYYMYKQDIARLAAIGIPYLSFSISWPRIVPFGVANSPVNTEGLQHYDDVINTCLQYGITPIVTLNHVDFPTAQAADYSTLTDNFLYYAKQVMTRYADRVPYWVTFNEPNIGIGNSFTSYNDLTHVLTAHAAVYHWYKEELQGTGQITMKFANNLGVPLDPSNSSHVDAALRYQDFILGIMANPLFLGEQYPSTVLNTPNLNLTPLTQTQLSTINNTVDFWAFDPYVAQFALPPLEGISACAANSSNSAWPECATLTMIQSDGWLMGDMSNAYSSIAPQYVRQQLGYVWNTFRPSGIVIAEFGFNPFDESLKEGNAQRYDLERTLYYQDFLEEMLKAIHEDGVNVIGTLAWSYLDNNEFGSYGNQYGMQSVNRTDGTWERRIEGIHSTYTPDEKNSSIKLLSSTKKQLTNPSNPPTTTEATTAVYIDQSNNSPTSIPPPIKNLYPSIYFTI

SEQ ID NO: 4160 - protein, 538 aa, Aspergillus niger
  strain CBS 513.88 / FGSC A1513
MIFFHLAPFFFLFGLVVSSQNPTVDLGYTRYKGKSLPNGISQWLGIRYAAAPTGSLRFSAPQDPDTVDGVQEAFKHGPRCVPTSQYPTPAGTSEDCLFLDVYAPSSVEATTRLPVFVWIQGGGFNANSSPNYNGTGLIEAANMSMVVVTFNYRVGPYGFLSGSEVLEGGSVNNGLKDQIKVLKWVQEHISKFGGDPSHVVIGGDSAGAASITLHLSAHGGRDDELFHAAAAESQSFAPMLTVNQSQFAYNNLVIRAGCASDSDTLACLRRLNTTELQRININTPLPTAQQAPLYLYGPVVDGSLIPDYTYRLFQQGKFIKVPVIFGDDTNEGTIFVPKTTSTVGEADTFIQDQFPNINFTHLTKLNDWYLKENQTREFPNSSPYWRPASTAYGEIRYICPGIYMSSVFASAGVNSWNYHYAVQDPAAEASGRGVSHTVEENAIWGPQYVSGTPPASYLTENAPIVPVMQGYWTSFIRVFDPNPLRYPGSPEWKTWSDGHGEDYRRIFVRTNETRMETVSEAQRERCEYWSSVGPDLSQ

SEQ ID NO: 4161 - protein, 321 aa, Bacillus subtilis
  strain 168
MIFLFRALKPLLVLALLTVVFVLGGCSNASVLDPKGPVAEQQSDLILLSIGFMLFIVGVVFVLFTIILVKYRDRKGKDNGSYNPEIHGNTFLEVVWTVIPILIVIALSVPTVQTIYSLEKAPEATKDKEPLVVYATSVDWKWVFSYPEQDIETVNYLNIPVDRPILFKISSADSMASLWIPQLGGQKYAMAGMLMDQYLQADKVGTYEGRNANFTGEHFADQEFDVNAVTEKDFNSWVKKTQNEAPKLTKEKYDELMLPENVDELTFSSTHLKYVDHGQDAEYAMEARKRLGYQAVSPHSKTDPFENVKKNEFKKSDDTEE

SEQ ID NO: 4162 - protein, 747 aa, Aspergillus niger
MIGSSHAVVALGLFTLYGHSAAAPAIGASNSQTIVTNGTSFALNGDNVSYRFHVNSSTGDLISDHFGGVVSGTIPSPVEPAVNGWVGMPGRIRREFPDQGRGDFRIPAVRIRESAGYTVSDLQYVSHEVIEGKYALPGLPATFGDAQDATTLVVHLYDNYSSVAADLSYSIFPKYDAIVRSVNVTNQGPGNITIEALASISIDFPYEDLDMVSLRGDWAREANVQRSKVQYGVQGFGSSTGYSSHLHNPFLAIVDPATTESQGEAWGFNLVYTGSFSAQVEKGSQGFTRALLGFNPDQLSWNLGPGETLTSPECVAVYSDKGLGSVSRKFHRLYRNHLMKSKFATSDRPVLLNSWEGVYFDYNQSSIETLAEESAALGVHLFVMDDGWFGDKYPRVSDNAGLGDWMPNPARFPDGLTPVVQDITNLTVNGTESTKLRFGIWVEPEMVNPNSTLYHEHPEWALHAGPYPRTERRNQLVLNLALPAVQDFIIDFMTNLLQDTGISYVKWDNNRGIHETPSPSTDHQYMLGLYRVFDTLTTRFPDVLWEGCASGGGRFDAGMLQYVPQIWTSDNTDAIDRITIQFGTSLAYPPSAMGAHLSAVPNAQTGRTVPFTFRAHVAMMGGSFGLELDPATVEGDEIVPELLALAEKVNPIILNGDLYRLRLPQDSQWPAALFVSQDGAQAVLFYFQVQPNVNHAVPWVRLQGLDPKADYTVDGDQTYSGATLMNLGLQYSFDTEYGSKVVFLERQ

SEQ ID NO: 4163 - protein, 499 aa, Bacillus subtilis
MKRSISIFITCLLITLLTMGGMLASPASAAGTKTPVAKNGQLSIKGTQLVNRDGKAVQLKGISSHGLQWYGEYVNKDSLKWLRDDWGITVFRAAMYTADGGIIDNPSVKNKMKEAVEAAKELGIYVIIDWHILNDGNPNQNKEKAKEFFKEMSSLYGNTPNVIYEIANEPNGDVNWKRDIKPYAEEVISVIRKNDPDNIIIVGTGTWSQDVNDAADDQLKDANVMDALHFYAGTHGQFLRDKANYALSKGAPIFVTEWGTSDASGNGGVFLDQSREWLKYLDSKTISWVNWNLSDKQESSSALKPGASKTGGWRLSDLSASGTFVRENILGTKDSTKDIPETPAKDKPTQENGISVQYRAGDGSMNSNQIRPQLQIKNNGNTTVDLKDVTARYWYNAKNKGQNVDCDYAQLGCGNVTYKFVTLHKPKQGADTYLELGFKNGTLAPGASTGNIQLRLHNDDWSNYAQSGDYSFFKSNTFKTTKKITLYDQGKLIWGTEPN

SEQ ID NO: 4164 - protein, 496 aa, Aspergillus niger
  strain CBS 513.88 / FGSC A1513
MILLSPLTTALLCLLTLTTATNTTTTPFNLHSTWGNLSPYTSSPGFGIPPGTPKTCQLTQAHILHRHAQRYPTSYLLDADSMESFAQKLKNYTQAHPNSTLATGPLSFLNNWRYLMGTEALLPTGAATEATSGAFHWSRYGRVLRSKPMFRTTSQARILESARWWLSGFFSNIAANSSSDDYDLVIIPEGDGYNNTLSGSCPNGDTSEGDDSAEQFLKIYTPPIITRFSQYLPSTLNLTYLDILSMQNLCAYETAVLGTSSFCALFTPSEWESYAYILDLQFYGDYGFGSPSGRAQGIGYVLELASRLQGKVIEKQVANVNITYDSNPSTFPLHQPLYLDMSHDDVIVSVLAALGVEYFNIGKDGMKGNISANEVPLNRTFRLNRIAPFGARFVTEIWRCDSSSAADIEVDAGGEVVYENPTVSEGVGKEYVRWVLNEMPVPVDGVSGCESDGGNGFCSLEGFLGGVKEMQELAGFEEACIEGAGSGGGQVGDGRP

SEQ ID NO: 4165 - protein, 799 aa, Aspergillus niger
  strain CBS 513.88 / FGSC A1513
MINWRHLVLSVAFPCIAGCANSSGSVDDYDVLQYINPLIGSANGGNVFAGATIPYGMAKAVADTDSDNNQGGFAYDGSSITGFSSMHDSGTGGQPSLGVFPLFPYVNCKDDDVNGCAYPKKERKTSYNSSSVKSSPGYFGLNMSSGIQVDMTTAHHTALFRFQFPVDKPSSPLILLDLSDLSDTRQDNGTISVDPTTGRMTGHARFLPSFGSGSYVPYFCADYHGAGDIRDNGIFVDARASVDVKNLTISRSINGYPLPGGAFIRFNSSADNVVHARVGLSFISSDQACQNAEAEIPDFDFNKTQSAAVNMWTQKMAPIRVSRNGINSSMLTNFYSGIYRTMVNPQDYTGENPLWDSSEPYFDSFYCLWDSFRSQMPFLTIFDPASLTRIIRSLIDTQRHLGWLPDCRMSLCKGYTQGGSNADVILADAYAKGISDGIDWDAGYAAVVKDAEEEPFDWSNEGRGGLMSWKALNYIPVEDFDYIGFGTLTRSISRTLEYSYNDFTIAQMARAMNKTGDAEKYEGTSQYWQNLFRADQTSFLNGTDTGFQGFFQPKYLNGTWGSQLHSQDPLTCSNIDTSGRSCSLQNNGAETFESSIWEYQFFVPHDMATLVTLLGGPAQFVRRLDYLHDQGITYIGNEPAFLTVFQYHYASRPGKSTARAHYYIPRYFNPTPTGLPGNDDSGAMGSFVAMTMMGLFPNPGQNVYLITAPFFESVQITSPLTGKTATVKTTNFDSTYQNIYIQSATLNGQPYTKSYVGHEFFTEGQELVLVLGRNESDWGTAAGDLPPSLSTSQMYSVDV

SEQ ID NO: 4166 - protein, 545 aa, Aspergillus niger
MIQGLESIMNQGTKRILLAATLAATPWQVYGSIEQPSLLPTPPMGFNNWARFMCDLNETLFTETADTMAANGLRDAGYNRINLDDCWMAYQRSDNGSLQWNTTKFPHGLPWLAKYVKAKGFHFGIYEDSGNMTCGGYPGSYNHEEQDANTFASWGIDYLKLDGCNVYATQGRTLEEEYKQRYGHWHQVLSKMQHPLIFSESAPAYFAGTDNNTDWYTVMDWVPIYGELARHSTDILVYSGAGSAWDSIMNNYNYNTLLARYQRPGYFNDPDFLIPDHPGLTADEKRSHFALWASFSAPLIISAYIPALSKDEIAFLTNEALIAVNQDPLAQQATLASRDDTLDILTRSLANGDRLLTVLNKGNTTVTRDIPVQWLGLTETDCTYTAEDLWDGKTQKISDHIKIELASHATAVFRLSLPQGCSSVVPTGLVFNTASGNCLTAASNSSVAFQSCNGETSQIWQVTPSGVIRPVSQTTQCLAADGNLVKLQACDSTDSDGQKWTYPVTGNLKNAKTDGCLTEGSVQMKSCLYERDGQVFGLPSGVQLA

SEQ ID NO: 4167 - protein, 570 aa, Aspergillus niger
  strain CBS 513.88 / FGSC A1513
MKASWSFAASVAALASKAVASSDCHCLPGDSCWPSTSSWDSLNNTVGGRLVATVPIGTPCHDPNYNGAECTNLQDDWYYPQTHLVSSSSVMQPYFANQSCDPFQPESRPCLLGNYVSYAVNVSTTDDVVAAVKFAQENNIRLVIRNTGHDYLGRSTGAGALAIWTHYLNDVEITEWSDSTYAGSAVKLGSGVTGYNVLDATHGKGIVVVGGECPTVGLAGGYTMGGGHSALSTAFGLGADQTLSFEVVTASGEVITASRTNNTDLYWALSGGGAGNFGVVTSLTVKAHPDATISGAALEFTIANITSDLFYEAVERFHTLLPAMVDAGTTVIYEMTNQVFLINPLTAYNKTTAEVKTILSPFLSALTDLGIEYTVAYTQYSSYYDHYEKYMGPLPYGNLEVGQYNYGGRLLPRDTLTSNAADLVSVLRNITSDGLIAVGVGLNVTNSNDTANAVFQPWRNAAVTMQFGSTWNETAPWSEMVADQLRIAHDYIPQFEAVTPGSGAYENEGSFRQQNWQKEFFGDNYAQLCEVKEKYDPDHVFYVTKGAGSEYWSVAESGRMCKTQQACAAV

SEQ ID NO: 4168 - protein, 646 aa, Aspergillus niger
  strain CBS 513.88 / FGSC A1513
MKFFSTICSLTLAVSALALPTSDHVIHEKRSATPSRWEKISRVNGTEHVLVRIGLTQNNLDRAYEYLMSVSDSVSPNYGKFWTPEEVHSTFAPSNETVNAVRNWLIESGVDESRLVHTKNQGWIVFDATTKEAENLLHTKYYHYTDRISGFKTLAAEEYRVPQKIQQHIDFIKPGVLLPLTSKGPSAKHTKKYKPLKQTSVNATSLTTCDEVITPACVAALYKIPHASGNVSASNSLGIFEEGDYYAQEDLDLFFRNFTPYIPKGTHPKPAFIDGASAPVSVADAGAESDLDFQLAYPIVYPQTITLYQTDDYDYASGEVETDGFFNTFLDAVDGSYCTYCAYGECGDSPTLDPTYPDNSTGGYKGQLMCGVYKPTNVISVSYGGQEADLPAYYQQRQCNEFLKLGLQGISILFASGDDGVAGPPGDDSTNGCLGNGTIFSPAFPNSCPWVTNVGATKLYPGKTIADGESAVVDPAGHPYSVAFSSGGGFSNIYTIPDYQAEAVAEYFKKHNPPYPYYEGNASFGKNGGVYNRLGRGYPDVAANGDNIAEYNAGEFILEGGTSASTPIFSSVINRIIEKRIAAGKGPLGFLNPVLYRNAWALNDITNGSNPGCGTEGFYTAPGWDPVTGLGTPNFPKLLDVFLNLP

SEQ ID NO: 4169 - protein, 332 aa, Aspergillus niger
  strain CBS 513.88 / FGSC A1513
MKFLKAKGSLLSSGIYLIALAPFVNAKCALPSTYSWTSTDALATPKSGWTALKDFTDVVSNGKHIVYASTTDTQGNYGSMGFGAFSDWSDMASASQTATSFSAVAPTLFYFQPKSIWVLAYQWGSSTFTYRTSQDPTNVNGWSSEQALFTGKISGSSTGAIDQTVIGDDTNMYLFFAGDNGKIYRSSMSINDFPGSFGSQYEEILSGATNDLFEAVQVYTVDGGEGDSKYLMIVEAIGSTGHRYFRSFTASSLGGEWTAQAASEDQPFAGKANSGATWTDDISHGDLVRNNPDQTMTVDPCNLQLLYQGHDPNSNSDYNLLPWKPGVLTLKQ

SEQ ID NO: 4170 - protein, 504 aa, Aspergillus niger
  strain CBS 513.88 / FGSC A1513
MKFLKLPVLALAGLFTAVSCAPTGQNTTVPVNGTTEASTDRLVFCHFMIGITSNRQSAADYDDDMKRAKSLGIDAFALNIGVDPYTDTQLNFAYESAARNDMKVFISFDFNWYNTGQASTVGQKIRQYGSLPAQLKVDGKVFASSFAGNGLDINQMQSAAGTEVFFAPNFHPGQGNFGNIQGALNWMAWDNNGDNKAPSAGRNVTVGDGDKAYVNALNGKPYIAPASGWFFTHFGGEVSYSKNWAFPSDLLWYNRWFEILNLAPRFVEIVTWNDYGESHYIAPLASPHTDDGASKWVMDMPHDGWLQMSKPFIAAYKNGDKSPDKYITEEKLIYWYRPTPRNINCDSTDTTMDGSPNNSSGNFFRGRPNGWESLQDAVFVVSLLKSPGTIQVASGQNSQKFDAPVGASAFTVPMGVGQQKFALVRDGKTVLSDTSLKDIVNTCICGIYNFNAYVGTVPAPSTIDKLGPAGLSALQQGLRVSCPTNTLGLGSVASATPIPTPSPA

SEQ ID NO: 4171 - protein, 640 aa, Aspergillus niger
  strain CBS 513.88 / FGSC A1513
MKFNALLTTLAALGYIQGGAAVPTTVDLTYADISPRALDNAPDGYTPSNVSCPANRPTIRSASTLSSNETAWVDVRRKQTVSAMKDLFGHINMSSFDAISYINSHSSNITNIPNIGIAVSGGGYRALTNGAGALKAFDSRTENSTHNGQLGGLLQSATYLSGLSGGGWLLGSIYINNFTTVSNLQTYKEGEVWQFQNSITKGPKTNGLQAWDTAKYYRDLAKVVAGKKDAGFNTSFTDYWGRALSYQLINATDGGPGYTWSSIALTQDFKNGNMPMPLLVADGRNPGETLIGSNSTVYEFNPWEFGSFDPSIFGFAPLEYLGSYFENGEVPSSRSCVRGFDNAGFVMGTSSSLFNQFILKLNTTDIPSTLKTVIASILEELGDRNDDIAIYSPNPFYGYRNATVSYEKTPDLNVVDGGEDKQNLPLHPLIQPARNVDVIFAVDSSASTSDNWPNGSPLVATYERSLNSTGIGNGTAFPSIPDKSTFINLGLNTRPTFFGCNSSNITGHAPLVVYLPNYPYTTLSNKSTFQLKYEILERDEMITNGWNVVTMGNGSRKSYEDWPTCAGCAILSRSFDRTNTQVPDMCSQCFDKYCWDGTRNSTTPAAYEPKVLMASAGVRGISMSRLVLGLFPVVVGVWMM

SEQ ID NO: 4172 - protein, 391 aa, Aspergillus niger
  strain CBS 513.88 / FGSC A1513
MKFSVVPLLFGATSAVASRLYAASYAGTVTTLSLSQSSKGQYELETVAQSTDCGTNPSWLMLDHDNRVLYCLDEAVDLANGTLTSFAIRPNGTLSKVLQLETIAGPVMSQFYSAPGVPHRNEGSAVTSYSLDPISGVFNRSQTFTYTLPAPGPVADRQDAPHSHGVVVDPTGQFVLVPDLGADLIRIFHINPSTGLLEPQAPLVAAPGSGPRHGVFWTPAGTTAKQAKHEDVIFYLTSELNNHVTGYRVTYPSNGTISFTEFYTANSYGGAVPPNGSKVAEIAISPQNNRLVVSNRDDNTFGTNNDSIAVFNCADESGSHPTNVSFGGLYPAYGSSPRQFEMSARNEMIAEALQNTHAVGVTQWNGKTGKPVPLVAKKSLVGEVVSVVWDE

SEQ ID NO: 4173 - protein, 614 aa, Aspergillus niger
  strain CBS 513.88 / FGSC A1513
MKGTAASALLIALSATAAQARPVVDERFPYTGPAVPIGDWVDPTINGNGKGFPRLVEPPAVKPATANPRNNVNVISLSYIPKGMHIHYQTPFGLGQLPAVRWGKDPRNLNSTAQGYSHTYDRTPSCSQVKAITQCSQFFHEVSIDGLEPDTTYYYQIPAANGTTQSDVLSFKTGRPAGHPGSFSVAVLNDMGYTNAHGTHKQLVKAANEGTAFAWHGGDISYADDWYSGILPCADDWPVCYNGTGSTLPGGGPIPDEYKKPLPAGEIPDQGGPQGGDMSVLYESNWDLWQQWLNNVTLKMPYMVMPGNHEASCAEFDGPHNILTAYLNDDIANGTAPTDNLTYYSCPPSQRNFTAYQHRFRMPGPETGGVGNFWYSFDYGLAHFVSIDGETDFANSPEWNFAEDVTGNETLPSEAETFITDSGPFGNVNGSVHETKSYEQWHWLKQDLAKVDRSKTPWVFVMSHRPMYSSAYSSYQLHVREAFEGLLLKYGVDAYFSGHIHWYERLYPLGANGTIDTAAIVNNNTYYAHNGKSITHIINGMAGNIESHSEFSSGEGLTNITALLDKVHYGFSKLTIFNETALKWELIRGDDGTVGDSLTLLKPSHVAGGKKFHA

SEQ ID NO: 4174 - protein, 458 aa, Aspergillus niger
  strain CBS 513.88 / FGSC A1513
MKGTAVATALALGASTALAAPSSTIKARDDVTAITVKGNAFFKGDDRFYIRGVDYQPGGSSKLADPIADADGCKRDIEKFKELGLNTIRVYSVDNSKDHDECMNALADAGIYLVLDVNTPKYSLNRADPAPSYNDVYLQYIFATVDKFASYKNTLAFFSGNEVINDGPSSKAAPYVKAVTRDLRQYIRSRNYREIPVGYSAADIDTNRLQMAEYMNCGTDDERSDFFAFNDYSWCDPSSFTTSGWDQKVKNFTGYGLPLFLSEYGCNTNKREFEEVSALYDTKMTGVYSGGLVYEYSQESSNYGLVEINGDSVKTLSDYDALKSAYSKTSNPEGDGGYNKTGGANPCPAKDSPNWDVDGDSLPAIPEPAKKYMTEGAGKGAGFSGSGSMNAGTASTSTATPGSGSASSSSSSSGSSGTSTSSTGAAAGLQVPGFAMAPVMVGLVTVLSTVFGAGLVLL

SEQ ID NO: 4175 - protein, 277 aa, Bacillus subtilis
  strain 168
MKISMQKADFWKKAAISLLVFTMFFTLMMSETVFAAGLNKDQKRRAEQLTSIFENGTTEIQYGYVERLDDGRGYTCGRAGFTTATGDALEVVEVYTKAVPNNKLKKYLPELRRLAKEESDDTSNLKGFASAWKSLANDKEFRAAQDKVNDHLYYQPAMKRSDNAGLKTALARAVMYDTVIQHGDGDDPDSFYALIKRTNKKAGGSPKDGIDEKKWLNKFLDVRYDDLMNPANHDTRDEWRESVARVDVLRSIAKENNYNLNGPIHVRSNEYGNFVIK

SEQ ID NO: 4176 - protein, 257 aa, Bacillus subtilis
  strain 168
MKKAFILSAAAAVGLFTFGGVQQASAKELSCQPVVTVKTGNTVQNMSLNDAVKKLHINTNIKTLNAANEKEMKQLLQKHAKQSNVKVQDVQKTETAKPAQKTTEKAAADQNTASKAPATAEKTNTTTSAPSSVSAYEKKVVELTNAERQKQGLKPLQIDETLSKSARAKSQDMKDKNYFDHQSPTYGSPFDMMKSFGISYKTAGENIAKGQKTPEEVVKAWMNSEGHRKNILNPNFTHIGVGYVESGSIWTQQFIGK

SEQ ID NO: 4177 - protein, 268 aa, Bacillus subtilis
  strain 168
MKKALLALFMVVSIAALAACGAGNDNQSKDNAKDGDLWASIKKKGVLTVGTEGTYEPFTYHDKDTDKLTGYDVEVITEVAKRLGLKVDFKETQWDSMFAGLNSKRFDVVANQVGKTDREDKYDFSDKYTTSRAVVVTKKDNNDIKSEADVKGKTSAQSLTSNYNKLATNAGAKVEGVEGMAQALQMIQQGRVDMTYNDKLAVLNYLKTSGNKNVKIAFETGEPQSTYFTFRKGSGEVVDQVNKALKEMKEDGTLSKISKKWFGEDVSK

SEQ ID NO: 4178 - protein, 181 aa, Bacillus subtilis
  strain 168
MKKCLLFLTTIALILSLSTNAFAKNTSGDLSQKQALQLALSAREHFWNTMSGHNPKVKKAVCPSGTFEYQNLQYVYMCSDLGTKAKAVNYLTPIFTKTAIEKGFKDYHFTVSKGKLAVPIGDGDNLLNWKKSTAKLISKKGSTITYEFTVPTLDGSPSAKRKVTFVKENKKWKVNQFDAVI

SEQ ID NO: 4179 - protein, 409 aa, Bacillus subtilis
  strain 168
MKKELLASLVLCLSLSPLVSTNEVFAATTNKETKENVSITNEIGYEKVKDMLEQQKYDFEHNTPLAHPKESKLTDSDEGVLLYSALSKVDKQKFHEFTYDIDDVKTSEKNNKLIVEAYITRNFVFGVEKVTTSLGDNIKLEIPKTTSNKQSSQSTNTSNLSFSQVKNSSNQLNVIPLSNSSKQLNVTQLNNSSSTLQYENDEEYSSDVKLDEFLKKYKQEVKNDDKEEVKSEDKPVSMNFNAANSNQLTVTATSVKGYSGYAAMKYAEKYALKPNKNYKYYKDKDCTNFVSQALRAGRMPYFKEWKPYTDAWVNAGAFRSYILKAGGIKMKTVSDTYSNVKLGDVYHYDYHNKIGLRYADGWMDHTAIVTSRANMKLYVSYHSTNRLNVPREYVTSKEGGKRYVSSIRN

SEQ ID NO: 4180 - protein, 317 aa, Bacillus subtilis
  strain 168
MKKFALLFIALVTAVVISACGNQSTSSKGSDTKKEQITVKHQLDKNGTKVPKNPKKVVVFDFGSLDTLDKLGLDDIVAGLPKQVLPKYLSKFKDDKYADVGSLKEPDFDKVAELDPDLIIISARQSESYKEFSKIAPTIYLGVDTAKYMESFKSDAETIGKIFDKEDKVKDELANIDHSIADVKKTAEKLNKNGLVIMANDGKISAFGPKSRYGLIHDVFGVAPADQNIKASTHGQSVSYEYISKTNPDYLFVIDRGTAIGETSSTKQVVENDYVKNVNAVKNGHVIYLDSATWYLSGGGLESMTQMIKEVKDGLEK

SEQ ID NO: 4181 - protein, 462 aa, Bacillus subtilis
  strain 168
MKKFPKKLLPIAVLSSIAFSSLASGSVPEASAQEKKKGNQDEIKNVIVLIGDGMGVSYTSAYRYLKDNKKTKVVEPTAFDQYLVGQQTTYPDDPEQNVTDSAAAATAMSAGIKTYNNAIAVDNDGSEAKTVLEAAKEKGKATGLVATSEITHATPASFGSHDHSRKNMNSIADDYFDEMVNGKHKIDVLLGGGKSNFDRKDRNLIKEFKKAGYSYVDDRKDMLKNKDSQVLGLFADGGLPKKIDRTKDIPSLKDMTNTAIKKLNKDKDGFFLMVEGSQIDWAGHDNDIVGAMSEMEDFEQAYKAAIDFAKKDKHTLVVATADHSTGGYSIGADGIYNWFSEPIKAAKRTPDFMAEKIADGADVEKTLKTYIDQKKLALTKAEIQSVEEAAKSKEVLDIDNAIENIFNKRSHTGWTTGGHTGEDVPVYAYGPSSETFAGQIDNTEIAKNVFKALQYNIKINDK

SEQ ID NO: 4182 - protein, 806 aa, Bacillus subtilis
  strain 168
MKKGIIRFLLVSFVLFFALSTGITGVQAAPASSKTSADLEKAEVFGDIDMTTSKKTTVIVELKEKSLAEAKEAGESQSKSKLKTARTKAKNKAIKAVKNGKVNREYEQVFSGFSMKLPANEIPKLLAVKDVKAVYPNVTYKTDNMKDKDVTISEDAVSPQMDDSAPYIGANDAWDLGYTGKGIKVAIIDTGVEYNHPDLKKNFGQYKGYDFVDNDYDPKETPTGDPRGEATDHGTHVAGTVAANGTIKGVAPDATLLAYRVLGPGGSGTTENVIAGVERAVQDGADVMNLSLGNSLNNPDWATSTALDWAMSEGVVAVTSNGNSGPNGWTVGSPGTSREAISVGATQLPLNEYAVTFGSYSSAKVMGYNKEDDVKALNNKEVELVEAGIGEAKDFEGKDLTGKVAVVKRGSIAFVDKADNAKKAGAIGMVVYNNLSGEIEANVPGMSVPTIKLSLEDGEKLVSALKAGETKTTFKLTVSKALGEQVADFSSRGPVMDTWMIKPDISAPGVNIVSTIPTHDPDHPYGYGSKQGTSMASPHIAGAVAVIKQAKPKWSVEQIKAAIMNTAVTLKDSDGEVYPHNAQGAGSARIMNAIKADSLVSPGSYSYGTFLKENGNETKNETFTIENQSSIRKSYTLEYSFNGSGISTSGTSRVVIPAHQTGKATAKVKVNTKKTKAGTYEGTVIVREGGKTVAKVPTLLIVKEPDYPRVTSVSVSEGSVQGTYQIETYLPAGAEELAFLVYDSNLDFAGQAGIYKNQDKGYQYFDWDGTINGGTKLPAGEYYLLAYAANKGKSSQVLTEEPFTVE

SEQ ID NO: 4183 - protein, 292 aa, Bacillus subtilis
  strain 168
MKKIAIAAITATSILALSACSSGDKEVIAKTDAGDVTKGELYTNMKKTAGASVLTQLVQEKVLDKKYKVSDKEIDNKLKEYKTQLGDQYTALEKQYGKDYLKEQVKYELLTQKAAKDNIKVTDADIKEYWEGLKGKIRASHILVADKKTAEEVEKKLKKGEKFEDLAKEYSTDSSASKGGDLGWFAKEGQMDETFSKAAFKLKTGEVSDPVKTQYGYHIIKKTEERGKYDDMKKELKSEVLEQKLNDNAAVQEAVQKVMKKADIEVKDKDLKDTFNTSSTSNSTSSSSSNSK

SEQ ID NO: 4184 - protein, 285 aa, Bacillus amyloliquefaciens
  strain ATCC 23350 / DSM 7 / BCRC 11601 / NBRC 15535 / NRRL B-14393
MKKIAIATITATSVLALSACSSGDNDVIAKTDAGNVTKGELYTNMKKTAGASVLTQLVQEKVLAKKYKVSDKEIDNKLKEYKTQLGDQYSALKQQYGEDYLKDQVKYELLAQKAAKDNIKVTDSDTKEYYDGLKGKIRASHILVADKKTADEVEKKLKKGEKFETLAKEYSTDSSKDNGGDLGWFDKKSMDETFSKAAFGLKVGQVSDPVKTKFGYHIIKKTEERGKYDDMKKELKEEVLKQKLNDNSAVQAAIQKVMKKADVKVEDKDLKDTFNTSASTSSESK

SEQ ID NO: 4185 - protein, 161 aa, Bacillus subtilis
  strain 168
MKKIGLLFMLCLAALFTIGFPAQQADAAEAPYKASITNISTDGGVYGKINYGQGQYWRVKYNITVSGKLLDQNGQPVPNAPVRFEADTKVGNTTQTASGTTDANGTFEVPMYLGPAAGYYTYYTSVSVHYYDIIPFRVFSGESRLVSTDNSLYHFAYQVRR

SEQ ID NO: 4186 - protein, 232 aa, Bacillus subtilis
  strain 168
MKKIMSAFVGMVLLTIFCFSPQASAAYDDLHEGYATYTGSGYSGGAFLLDPIPSDMEITAINPADLNYGGVKAALAGSYLEVEGPKGKTTVYVTDLYPEGARGALDLSPNAFRKIGNMKDGKINIKWRVVKAPITGNFTYRIKEGSSRWWAAIQVRNHKYPVMKMEYEKDGKWINMEKMDYNHFVSTNLGTGSLKVRMTDIRGKVVKDTIPKLPESGTSKAYTVPGHVQFPE

SEQ ID NO: 4187 - protein, 221 aa, Bacillus subtilis
  strain 168
MKKIVSILFMFGLVMGFSQFQPSTVFAADKVVHETIIVPKNTTYDGKGQRFVAGKELGDGSQSENQDPVFRVEDGATLKNVVLGAPAADGVHTYGNVNIQNVKWEDVGEDALTVKKEGKVTIDGGSAQKASDKIFQINKASTFTVKNFTADNGGKFIRQLGGSTFHVDVIIDKCTITNMKEAIFRTDSKTSTVRMTNTRYSNVGQKWIGVQHIYENNNTQF

SEQ ID NO: 4188 - protein, 488 aa, Bacillus subtilis
  strain 168
MKKKLAAGLTASAIVGTTLVVTPAEAATIKVKSGDSLWKLAQTYNTSVAALTSANHLSTTVLSIGQTLTIPGSKSSTSSSTSSSTTKKSGSSVYTVKSGDSLWLIANEFKMTVQELKKLNGLSSDLIRAGQKLKVSGTVSSSSSSSKKSNSNKSSSSSSKSSSNKSSSSSSSTGTYKVQLGDSLWKIANKVNMSIAELKVLNNLKSDTIYVNQVLKTKSSGSDTSSKDNSSKSNQTSATTKYTVKSGDSLWKIANNYNLTVQQIRNINNLKSDVLYVGQVLKLTGKASSGSSSSSSSSSNASSGTTTTYTVKSGDSLWVIAQKFNVTAQQIREKNNLKTDVLQVGQKLVISGKASSSSSSGSSNTTSSTSAKINTMISAAKAQLGVPYRWGGTTPSGFDCSGFIYYVLNKVTSVSRLTAAGYWNTMKSVSQPAVGDFVFFSTYKAGPSHVGIYLGNGEFINANDSGVVISNMNNSYWKQRYLGAKRYF

SEQ ID NO: 4189 - protein, 172 aa, Bacillus subtilis
  strain 168
MKKKQVMLALTAAAGLGLTALHSAPAAKAAPLHDISVSMPSSDTYIIKAGKLNVRTEPNHEGDILGTVSSEQKVKVDRFVNADWAQIHFKGKKAYISTHFLMKTASQAKTTKQTAFYTPTPENGKAKQLSSGTEVTILGWGFSENGGFDFTWAFVDYGGVKGYIHTKDLQMR

SEQ ID NO: 4190 - protein, 274 aa, Bacillus subtilis
  strain 168
MKKLFLGALLLVFAGVMAACGSNNGAESGKKEIVVAATKTPHAEILKEAEPLLKEKGYTLKVKVLSDYKMYNKALADKEVDANYFQHIPYLEQEMKENTDYKLVNAGAVHLEPFGIYSKTYKSLKDLPDGATIILTNNVAEQGRMLAMLENAGLITLDSKVETVDATLKDIKKNPKNLEFKKVAPELTAKAYENKEGDAVFINVNYAIQNKLNPKKDAIEVESTKNNPYANIIAVRKGEEDSAKIKALMEVLHSKKIKDFIEKKYDGAVLPVSE

SEQ ID NO: 4191 - protein, 455 aa, Bacillus subtilis; identical to SEQ ID NO: 308
  strain 168

SEQ ID NO: 4192 - protein, 143 aa, Bacillus subtilis
  strain 168
MKKMLMLAFTFLLALTIHVGEASAVIVKDEEKVSFTMTENEKWFMKSDDLNSNHWTSHFGYRFTIFDTEGCTINARIMRMTLSGYEITVSEKNFSGDHFDFSATDRVETMPYKTHYLILTKDPDCGDVKVKGLYGFQFDQPEW

SEQ ID NO: 4193 - protein, 461 aa, Bacillus subtilis
  strain 168
MKKMSLFQNMKSKLLPIAAVSVLTAGIFAGAELQQTEKASAKKQDKAEIRNVIVMIGDGMGTPYIRAYRSMKNNGDTPNNPKLTEFDRNLTGMMMTHPDDPDYNITDSAAAGTALATGVKTYNNAIGVDKNGKKVKSVLEEAKQQGKSTGLVATSEINHATPAAYGAHNESRKNMDQIANSYMDDKIKGKHKIDVLLGGGKSYFNRKDRNLTKEFKQAGYSYVTTKQALKKNKDQQVLGLFADGGLAKALDRDSKTPSLKDMTVSAIDRLNQNKKGFFLMVEGSQIDWAAHDNDTVGAMSEVKDFEQAYKAAIEFAKKDKHTLVIATADHTTGGFTIGANGEKNWHAEPILSAKKTPEFMAKKISEGKPVKDVLARYANLKVTSEEIKSVEAAAQADKSKGASKAIIKIFNTRSNSGWTSTDHTGEEVPVYAYGPGKEKFRGLINNTDQANIIFKILKTGK

SEQ ID NO: 4194 - protein, 300 aa, Bacillus subtilis
  strain 168
MKKNKLVLMLLMAAFMMIAAACGNAGESKKSNSDSAKGEEKASGSLTISGSSAMQPLVLAAAEKFMEENPDADIQVQAGGSGTGLSQVSEGAVQIGNSDVFAEEKEGIDAKALVDHQVAVVGMAAAVNPDAGVKDISKDELKKIFTGKIKNWKELGGKDQKITLVNRPDSSGTRATFVKYALDGAEPAEGITEDSSNTVKKIIADTPGAIGYLAFSYLTDDKVTALSIDGVKPEAKNVATGEYPIWAYQHSYTKGEATGLAKEFLDYLKSEDIQKSIVTDQGYIPVTDMKVTRDANGKQS

SEQ ID NO: 4195 - protein, 334 aa, Bacillus subtilis
  strain 168
MKKQIITATTAVVLGSTLFAGAASAQSIKVKKGDTLWDLSRKYDTTISKIKSENHLRSDIIYVGQTLSINGKSTSSKSSSSSSSSSTYKVKSGDSLWKISKKYGMTINELKKLNGLKSDLLRVGQVLKLKGSTSSSSSSSSKVSSSSTSTYKVKSGDSLSKIASKYGTTVSKLKSLNGLKSDVIYVNQVLKVKGTSTSSSKPASSSSSSSSKTSSTSLNVSKLVSDAKALVGTPYKWGGTTTSGFDCSGFIWYVLNKQTSVGRTSTAGYWSSMKSIASPSVGDFVFFTTYKSGPSHMGIYIGNNSFIHAGSDGVQISSLNNSYWKPRYLGAKRF

SEQ ID NO: 4196 - protein, 155 aa, Bacillus subtilis
  strain 168
MKKRITYSLLALLAVVAFAFTDSSKAKAAEALPLYYLQITGITSDGNDFAWDNLTSSQTKAPNVLKGNKLYVKARFMGYTKLTVITGKDGKNLLYNGTAKMFKSDAILGQNKVVIGWDKYFEIPMDALQDNSIQIKALSSGTTFVYSQKIDFERE

SEQ ID NO: 4197 - protein, 544 aa, Bacillus amyloliquefaciens
  strain ATCC 23350 / DSM 7 / BCRC 11601 / NBRC 15535 / NRRL B-14393
MKKRWSIVGLMLIFSLVLSACGGFSGGSGDGKKDTKGQTSLNINIKTEPFSLHPGLANDSVSGGVIRQTFEGLTRVNSKGEPEEGTASKIETSKDGKTYTFTIRDGAKWSNGDPVTAQDFEYAWKWALDPNNESQYAYQLYYIKGAEAANTGKGKLDDVGVKAVNDKTLKVELNNPTPYFLQLTSFYTYMPINKKIAEKHKNWNTNAGDNYVSNGPFKMTAWKHSGSITLEKNDQYWDKDSVKLKKINMVMINNNNTELKKFQAGELNWAGMPLGQLPTESLPTLKKDGSLHVEPIAGVYWYKFNTEAKPLNNVNIRKALAYAIDRSSIVKNVTQGEQIPAMAAVPPSMKGFKDNTKGYFKDNDVKTAKEFLNKGLKELGVKSASDLPAIKLSFNTDDAHAKIAQAVQEMWKKNLGVKVELDNSEWNVYIDKLHSQDYQIGRMGWLGDFNDAINFLELFRDKEGGNNDTGWEDPEFKKLLNQSQLETDPDKRIAELKKAEKIFIDAMPVAPVYFYTDTWVQDKNLKNVIITGTGEVYFRNASFE

SEQ ID NO: 4198 - protein, 545 aa, Bacillus subtilis
  strain 168
MKKRWSIVTLMLIFTLVLSACGFGGTGSNGEGKKDSKGKTTLNINIKTEPFSLHPGLANDSVSGGVIRQTFEGLTRINADGEPEEGMASKIETSKDGKTYTFTIRDGVKWSNGDPVTAQDFEYAWKWALDPNNESQYAYQLYYIKGAEAANTGKGSLDDVAVKAVNDKTLKVELNNPTPYFTELTAFYTYMPINEKIAEKNKKWNTNAGDDYVSNGPFKMTAWKHSGSITLEKNDQYWDKDKVKLKKIDMVMINNNNTELKKFQAGELDWAGMPLGQLPTESLPTLKKDGSLHVEPIAGVYWYKFNTEAKPLDNVNIRKALTYSLDRQSIVKNVTQGEQMPAMAAVPPTMKGFEDNKEGYFKDNDVKTAKEYLEKGLKEMGLSKASDLPKIKLSYNTDDAHAKIAQAVQEMWKKNLGVDVELDNSEWNVYIDKLHSQDYQIGRMGWLGDFNDPINFLELFRDKNGGNNDTGWENPEFKKLLNQSQTETDKTKRAELLKKAEGIFIDEMPVAPIYFYTDTWVQDENLKGVIMPGTGEVYFRNAYFK

SEQ ID NO: 4199 - protein, 290 aa, Bacillus amyloliquefaciens
  strain ATCC 23350 / DSM 7 / BCRC 11601 / NBRC 15535 / NRRL B-14393
MKKTIMSFVAVAAISTTAFGAHASAKEITVQKGDTLWGISQKNGVNLKDLKEWNQLSSDLIIEGEKLTISSVETTTSGQYTVKQGDSLWKIAQKFGTSVNNLKSLNNLQSDIIYAGTTLKVKGQAQAAQPAQEASQPQTEQKPAAETAQPKQEAVQKEQPKQEPVQEQQQPKQEAKAVEAKQQPVQSNTNQQEPKKQLTMTATAYSANDGGISGVTATGVDLNKNPDAKVIAVDPSVIPLGSKVYVEGYGVATAADTGGAIKGNKIDVFVAKKSDANNWGVRTVNVKVLD

SEQ ID NO: 4200 - protein, 287 aa, Bacillus subtilis
  strain 168
MKKTIMSFVAVAALSTTAFGAHASAKEITVQKGDTLWGISQKNGVNLKDLKEWNKLTSDKIIAGEKLTISSEETTTTGQYTIKAGDTLSKIAQKFGTTVNNLKVWNNLSSDMIYAGSTLSVKGQATAANTATENAQTNAPQAAPKQEAVQKEQPKQEAVQQQPKQETKAEAETSVNTEEKAVQSNTNNQEASKELTVTATAYTANDGGISGVTATGIDLNKNPNAKVIAVDPNVIPLGSKVYVEGYGEATAADTGGAIKGNKIDVFVPSKSDASNWGVKTVSVKVLN

SEQ ID NO: 4201 - protein, 213 aa, Bacillus subtilis
  strain 168
MKKVLLLLFVLTIGLALSACSQSSDASEKEKPKEKKSQEELEKELDKELKKGGEPKTKKDDQIHKIGETFKAGHTNFTVNKVDRVQKGEYMNVGGAVNEETKTIKDDEERLIIEVTMENIGEDSISYNFIGFDLRDKNDQSVRPVFSIEEKGRILMGGTLVSGKKVTGVLSYVIPKGEQKHYTLVYNPFLADTNSSNTEERVKDDIDYLVKLD

SEQ ID NO: 4202 - protein, 420 aa, Bacillus subtilis
  strain 168
MKKVMLATALFLGLTPAGANAADLGHQTLGSNDGWGAYSTGTTGGSKASSSNVYTVSNRNQLVSALGKETNTTPKIIYIKGTIDMNVDDNLKPLGLNDYKDPEYDLDKYLKAYDPSTWGKKEPSGTQEEARARSQKNQKARVMVDIPANTTIVGSGTNAKVVGGNFQIKSDNVIIRNIEFQDAYDYFPQWDPTDGSSGNWNSQYDNITINGGTHIWIDHCTFNDGSRPDSTSPKYYGRKYQHHDGQTDASNGANYITMSYNYYHDHDKSSIFGSSDSKTSDDGKLKITLHHNRYKNIVQRAPRVRFGQVHVYNNYYEGSTSSSSYPFSYAWGIGKSSKIYAQNNVIDVPGLSAAKTISVFSGGTALYDSGTLLNGTQINASAANGLSSSVGWTPSLHGSIDASANVKSNVINQAGAGKLN

SEQ ID NO: 4203 - protein, 267 aa, Bacillus subtilis
  strain 168
MKKWIYVVLVLSIAGIGGFSVHAASSAHEKHLNVSKMNVDDEFKDTDGTFILHDLQKDQTFVYNRKRANQRQTPQSTFKVVNALIGLQVKAVRDEYDVKRWDGVKREFESWNRDHTLGSAMRESAIWYYQALARDIGEERMKTWLHTLSYGNEDISGGIDQFWLQSSLTISPLEQETFLEKLAKEELPFDKPVMKIVKRMMIQEEGDHYTLYGKTGTRLTDMGLGWFVGFIKTEHGSYVFVTNVDDSGTKAKNITVDILKKYGLITS

SEQ ID NO: 4204 - protein, 255 aa, Bacillus subtilis
  strain 168
MKKWLLLLVAACITFALTACGSSNSGSESGKKKLIMGTSADYKPFEYKEGDNIVGFDVELAKALAKKAGYEIEVQDMDFNSLITALKSKQVDLVLSGMTPTPERKKQVDFSDVYYTANHMIVSKKDSGIQSLKDLKGKTVGVQLGSIQEEKGKELSPEYGFKTEDRNRISDLVQEIKSDRFDAAIIEDIVAEGYFKSNDDLQGFVIPDAKAEEAGSAIAFRKDSELTDKFNKALKEMEDNGELEKLKKKWFTGEK

SEQ ID NO: 4205 - protein, 541 aa, Aspergillus niger
  strain CBS 513.88 / FGSC A1513
MKLAASAVAAAALVDVAVASVPAIVIKGSKFFYENNGTEFFIRGVAYQPPYDGTGTTTSAGTVDFVDPLANETICKRDLPYLQELNTNVVRVYDVDPDADHSTCMNLLADAGIYVLADLSSADYSIDSSDPEWNLELYDYYASVVDSLANYTNTLGFFAGNENSNSVNTTGASAYVKAAVRDMKAYIKSKNYRSIGVGYSAADVSEIRTDLVDYFNCGDSDDSVDFFGDNVYEWCGDSSYTESGYNVMTEDLSNLSIPYFFSEYGCITVQPRSFSNVPVMYGPKMDGWLAGGIVYEYFQDANDYGLVTISDGSVSTLTGFSSYSEEINSVSPTGTNSASYTPTNTVARSCPTVGSSWEAASALPPAPNSELCSCMEETLTCVVKDSVSSKKYADLYSTVCGYGVCAGITGNTTTGEYGAYSMCNTKQMLNWALNAYYEEQKSAGNGASACDFAGSATTTSTTSPTGTCSSLLKAVGTAGTGTVSLSAAAGTSTGDSSSSGSSESSSAGVPGYMTYTATLGLGQLVAFVAVGVLSGTGMILL

SEQ ID NO: 4206 - protein, 393 aa, Bacillus subtilis
  strain 168
MKLAKRVSALTPSTTLAITAKAKELKAAGHDVIGLGAGEPDFNTPQHIIDAAVRSMNEGHTKYTPSGGLAELKNSIAEKFKRDQNIEYKPSQIIVCTGAKHALYTLFQVILDEEDEVIIPTPYWVSYPEQVKLAGGKPVYVEGLEENHFKISPEQLKNAITEKTKAIVINSPSNPTGVMYTEEELSALGEVCLEHDILIVSDEIYEKLTYGGKKHVSIAQLSDRLKEQTVIINGVSKSHSMTGWRIGYAAGSEDIIKAMTNLASHSTSNPTSIAQYGAIAAYNGPSEPLEEMREAFEHRLNTIYAKLIEIPGFSCVKPEGAFYLFPNAKEAAQSCGFKDVDEFVKALLEEEKVAIVPGSGFGSPENVRLSYATSLDLLEEAIERIKRFVEKHS

SEQ ID NO: 4207 - protein, 306 aa, Bacillus amyloliquefaciens; identical to SEQ ID NO: 307

SEQ ID NO: 4208 - protein, 467 aa, Aspergillus niger
  strain CBS 513.88 / FGSC A1513
MKLNVAAISALATVASALPHRRNVEQWDHIRSNIKHVIYLMMENHSFDNIAGYWDFHPDIDNLRNISYCNEYTNPNWTVWDEPLNICAAPFETEVPLTDPDHNFAGTSYEIFRKWQPTKDDVPNMGGFIERQSEKYASSPGESSFVIKAYDEKKTATLIEVAKNFAFWDSYFAEHPGPTNTNRQFATSGSTCGFVDNTYQAAGWYANYTGTTCATSIFEALSNKNITWKNYYETDIVDAYMYKWVQDNAMDRLVHSDQFYRDLEEGTLPQFSYYNPECCTIDSMHPTSNMASGEQLIKHLYDAVRKSKYWDNVLIILNFDEHGGFADHVPTPINVPQPEDGITFTGMSDGHNVTYDFTRLGVRVPSFIISPYIPANHLIHDQGTMYANNSAYTHTSFLHFLQELWGLEGLNNRVQWAKTFEYIFSSEKRDDTPEKLTTPTWYGSSWEPKPDPYYKLNQNYDYYENLD

SEQ ID NO: 4209 - protein, 239 aa, Aspergillus niger
  strain CBS 513.88 / FGSC A1513
MKLPVTLAMLAATAMGQTMCSQYDSASSPPYSVNQNLWGEYQGTGSQCVYVDKLSSSGASWHTEWTWSGGEGTVKSYSNSGVTFNKKLVSDVSSIPTSVEWKQDNTNVNADVAYDLFTAANVDHATSSGDYELMIWLARYGNIQPIGKQIATATVGGKSWEVWYGSTTQAGAEQRTYSFVSESPINSYSGDINAFFSYLTQNQGFPASSQYLINLQFGTEAFTGGPATFTVDNWTASVN

SEQ ID NO: 4210 - protein, 92 aa, Bacillus subtilis
  strain 168
MKLRKVLTGSVLSLGLLVSASPAFATSPSAMVKENNIVQDEISVKELHTKYIYHHNINDFKNIEKDENGRNWYLKGIEYKDGWYVGKYQANY

SEQ ID NO: 4211 - protein, 1007 aa, Aspergillus niger
  strain CBS 513.88 / FGSC A1513
MKLSSACAIALLAAQAAGASIKHRINGFTLTEHSDPAKRELLQKYVTWDDKSLFINGERIMIFSGEFHPFRLPVKELQLDIFQKVKALGFNCVSFYVDWALVEGKPGEYRADGIFDLEPFFDAASEAGIYLLARPGPYINAESSGGGFPGWLQRVNGTLRSSDKAYLDATDNYVSHVAATIAKYQITNGGPIILYQPENEYTSGCCGVEFPDPVYMQYVEDQARNAGVVIPLINNDASASGNNAPGTGKGAVDIYGHDSYPLGFDCANPTVWPSGDLPTNFRTLHLEQSPTTPYAIVEFQGGSYDPWGGPGFAACSELLNNEFERVFYKNDFSFQIAIMNLYMIFGGTNWGNLGYPNGYTSYDYGSAVTESRNITREKYSELKLLGNFAKVSPGYLTASPGNLTTSGYADTTDLTVTPLLGNSTGSFFVVRHSDYSSEESTSYKLRLPTSAGSVTIPQLGGTLTLNGRDSKIHVTDYNVSGTNIIYSTAEVFTWKKFADGKVLVLYGGAGEHHELAISTKSNVTVIEGSESGISSKQTSSSVVVGWDVSTTRRIIQVGDLKILLLDRNSAYNYWVPQLATDGTSPGFSTPEKVASSIIVKAGYLVRTAYLKGSGLYLTADFNATTSVEVIGVPSTAKNLFINGDKTSHTVDKNGIWSATVDYNAPDISLPSLKDLDWKYVDTLPEIQSSYDDSLWPAADLKQTKNTLRSLTTPTSLYSSDYGFHTGYLLYRGHFTATGNESTFAIDTQGGSAFGSSVWLNGTYLGSWTGLYANSDYNATYNLPQLQAGKTYVITVVIDNMGLEENWTVGEDLMKTPRGILNFLLAGRPSSAISWKLTGNLGGEDYEDKVRGPLNEGGLYAERQGFHQPEPPSQNWKSSSPLEGLSEAGIGFYSASFDLDLPKGWDVPLFLNIGNSTTPSPYRVQVYVNGYQYAKYISNIGPQTSFPVPEGILNYRGTNWLAVTLWALDSAGGKLESLELSYTTPVLTALGEVESVDQPKYKKRKGAY

SEQ ID NO: 4212 - protein, 359 aa, Aspergillus niger
  strain CBS 513.88 / FGSC A1513
MKLSSLTPLALALTATAQASYINYTTVTGYFLQDEDSTDASTFDYTTTNFGLINRTYPSDNTHNHHQDLTQWERFYHYVLSLNHNSPSNVAYKVLFLGRHGEGYHNAAEDYYGTPAWNCYWSLLTGNGTTTWLDADLTPTGIQQAQIAHDFWNIQISAQRIHTPDSYFVSPLLRALRTANITFSDLSLGTPFIPEIKEFFRESISIHTCDHRHNASHIHSVFPTWPFEKGFAEDDELWNGVTGETSAAQDVRSRRALDDVFGEEKNGVFVSVTSHSGEIASLLRVVGHRVFGLRTGAVIPVLVKGEIVGDSEVEPTVTGTVSWTTSAHCTAPPVTSVSSGCVCASSAAPVTTPLVTVAY

SEQ ID NO: 4213 - protein, 313 aa, Bacillus subtilis
  strain 168
MKLVPRFRKQWFAYLTVLCLALAAAVSFGVPAKAAENPQTSVSNTGKEADATKNQTSKADQVSAPYEGTGKTSKSLYGGQTELEKNIQTLQPSSIIGTDERTRISSTTSFPYRATVQLSIKYPNTSSTYGCTGFLVNPNTVVTAGHCVYSQDHGWASTITAAPGRNGSSYPYGTYSGTMFYSVKGWTESKDTNYDYGAIKLNGSPGNTVGWYGYRTTNSSSPVGLSSSVTGFPCDKTFGTMWSDTKPIRSAETYKLTYTTDTYGCQSGSPVYRNYSDTGQTAIAIHTNGGSSYNLGTRVTNDVFNNIQYWANQ

SEQ ID NO: 4214 - protein, 645 aa, Bacillus subtilis
  strain 168
MKNMSCKLVVSVTLFFSFLTIGPLAHAQNSSEKEVIVVYKNKAGKETILDSDADVEQQYKHLPAVAVTADQETVKELKQDPDILYVENNVSFTAADSTDFKVLSDGTDTSDNFEQWNLEPIQVKQAWKAGLTGKNIKIAVIDSGISPHDDLSIAGGYSAVSYTSSYKDDNGHGTHVAGIIGAKHNGYGIDGIAPEAQIYAVKALDQNGSGDLQSLLQGIDWSIANRMDIVNMSLGTTSDSKILHDAVNKAYEQGVLLVAASGNDGNGKPVNYPAAYSSVVAVSATNEKNQLASFSTTGDEVEFSAPGTNITSTYLNQYYATGSGTSQATPHAAAMFALLKQRDPAETNVQLREEMRKNIVDLGTAGRDQQFGYGLIQYKAQATDSAYAAAEQAVKKAEQTKAQIDINKARELISQLPNSDAKTALHKRLDKVQSYRNVKDAKDKVAKAEKYKTQQTVDTAQTAINKLPNGTDKKNLQKRLDQVKRYIASKQAKDKVAKAEKSKKKTDVDSAQSAIGKLPASSEKTSLQKRLNKVKSTNLKTAQQSVSAAEKKSTDANAAKAQSAVNQLQAGKDKTALQKRLDKVKKKVAAAEAKKVETAKAKVKKAEKDKTKKSKTSAQSAVNQLKASNEKTKLQKRLNAVKPKK

SEQ ID NO: 4215 - protein, 321 aa, Bacillus amyloliquefaciens
  strain ATCC 23350 / DSM 7 / BCRC 11601 / NBRC 15535 / NRRL B-14393
MKNRFKRLIRFSCAAVTAGLLLMSSSPASAAFWGASNELLHDPTMAKEGNTWYAFGTGLEGERGLRVLKEGSGGVWTVQKSIFTSPLSWWSNYVPNYGLNQWAPDVQYYNGKYWLYYAVSSFGKNTSAIGLASSTSLSSGNWKDEGLVIRSTSANDYNAIDPELTIDKDGNPWLAFGSFWSGIKLTRLDKNTMKPTGSLYSIAARPNNGGALEAPAITYQNGYYYLMVSFDKCCSGVNSTYKIAYGRSKSITGPYLDKSGKSMSEGGGTILDSGNDRWKGPGGQDIVNGNILVRHAYDAEDSGIPKMLINDINWSSGWPSY

SEQ ID NO: 4216 - protein, 142 aa, Bacillus subtilis
  strain 168
MKQGKFSVFLILLLMLTLVVAPKEKAEAASSGWQPVSGISGCKIRVITDAYTYTKSATSIDAYAETNGKCGKLNYKSFGVSIVEGGDIGPQYSGYFSSRTPTKKFYFSKLPKPTGTPWAVGLSVYKGKAKGAAFVYINPQKR

SEQ ID NO: 4217 - protein, 161 aa, Bacillus subtilis
  strain 168
MKRIRIPMTLALGAALTIAPLSFASAEENPAPKMSQTTTAGTTAADVGLNVNLDVLGIANQIADAIKSAQNRDGFVKNLMESSFYASGQKYNVMVFNLSQEYEDHLNGVQFYGSAVYDGITYGIWVFEDGTFTNKGDGGWINWAFRGWFDRDGSTVAFHRP

SEQ ID NO: 4218 - protein, 304 aa, Bacillus amyloliquefaciens
  strain ATCC 23350 / DSM 7 / BCRC 11601 / NBRC 15535 / NRRL B-14393
MKRKATLKFGICIGLLCVSFTGFNSLFGSTHAEAKSIENTKMTSCITNQKFVQLEKKFDARLGVYAIDTGSNKTIAYRPNERFAYASTYKVLAAAAVLKQKPIEKLNDVIRYTKEDLVTYSPITEKHLDTGMSLKEISEAAIRYSDNTAGNILLQQLGGPKGFEKSLKQIGDHVTKADRFETDLNSAIPGDIRDTSTAKALATDLKAFTLGNTLTTDKRTILTDWMRGNATGDELIRAGAPAGWEVGDKSGAGSYGTRNDIAIVWPPDRAPIVLAILTKRFTKDAEYDNALIAEAAKVALDDLK

SEQ ID NO: 4219 - protein, 181 aa, Bacillus subtilis
  strain 168
MKRKLLSSLAISALSLGLLVSAPTASFAAESTSTKAHTESTMRTQSTASLFATITGASKTEWSFSDIELTYRPNTLLSLGVMEFTLPSGFTANTKDTLNGNALRTTQILNNGKTVRVPLALDLLGAGEFKLKLNNKTLPAAGTYTFRAENKSLSIGNKFYAEASIDVAKRSTPPTQPCGCN

SEQ ID NO: 4220 - protein, 345 aa, Bacillus subtilis
MKRFCLWFAVFSLLLVLLPGKAFGAVDFPNTSTNGLLGFAGNAKNEKGISKASTTGGKNGQIVYIQSVNDLKTHLGGSTPKILVLQNDISASSKTTVTIGSNKTLVGSYAKKTLKNIYLTTSSASGNVIFQNLTFEHSPQINGNNDIQLYLDSGINYWIDHVTFSGHSYSASGSDLDKLLYVGKSADYITISNSKFANHKYGLILGYPDDSQHQYDGYPHMTIANNYFENLYVRGPGLMRYGYFHVKNNYSNNFNQAITIATKAKIYSEYNYFGKGSEKGGILDDKGTGYFKDTGSYPSLNKQTSPLTSWNPGSNYSYRVQTPQYTKDFVTKYAGSQSTTLVFGY

SEQ ID NO: 4221 - protein, 446 aa, Bacillus subtilis
  strain 168
MKRMIVRMTLPLLIVCLAFSSFSASARAASEEKYWDHWIERHAQPLDASNASNKDLRFLKKVLKGKRIVQLGETTHGAGEINATKVRMIKYLHEELGYDVLAFESGFPDTNASYLNMDQLTPKSTMKNSIYAVWHTEDVVELFDYMKEQKEKGDPLILTGFDIQSMKNSFNVAATQWVKAVDPEKAELLSQSENDFSTLVTDSNTFDEFSQKKEKLVKNYQKLIKFTKTHASELKENLPKEPKAYEMFMHSLQLRIDVMETYMLEEMKEKLEEYPENIEDFSFFMRDRMMAEQFQWVADTLYPKKKIIVWGHNYHLRKQNTKMIKDWVQLNGPNMGDYLPERLKKQTYTIGIYAYSGASLDSSDNKTVKPVTSPPPSGSLEALLKAADRPAVFVDFLHTKNKKGTSWMYTPRTALYWGYMEEQMILKEQYDGVIWLEHITPSVIIK

SEQ ID NO: 4222 - protein, 466 aa, Bacillus subtilis
  strain 168
MKRQLKLFFIVLITAVVASALTLFITGNSSILGQKSASTGDSKFDKLNKAYEQIKSDYYQKTDDDKLVDGAIKGMIQSLDDPYSTYMDQEQAKSFDETISASFEGIGAQVEEKDGEILIVSPIKGSPAEKAGIKPRDQIIKVNGKSVKGMNVNEAVALIRGKKGTKVKLELNRAGVGNIDLSIKRDTIPVETVYSEMKDNNIGEIQITSFSETTAKELTDAIDSLEKKGAKGYILDLRGNPGGLMEQAITMSNLFIDKGKNIMQVEYKNGSKEVMKAEKERKVTKPTVVLVNDGTASAAEIMAAALHESSNVPLIGETTFGKGTVQTAKEYDDGSTVKLTVAKWLTADGEWIHKKGIKPQVKAELPDYAKLPYLDADKTYKSGDTGTNVKVAQKMLKALGYKVKVNSMYDQDFVSVVKQFQKKEKLNETGILTGDTTTKLMIELQKKLSDNDTQMEKAIETLKKEM

SEQ ID NO: 4223 - protein, 894 aa, Bacillus subtilis
  strain 168
MKRRKFSSVVAAVLIFALIFSLFSPGTKAAAAGAIDQAAALENGKEQTGAMKEPEQVKWYKVTPGATDIQKNSHMALTVKSDSVLNVSVYPSKEKALKDETFEMYRSFTAEDGKSEVIFPYAWSGPYYVKVEYLGEEEPEDGGTAEAAAEAKYTIGYKGTKKQPSDLEEEEACPVEMSVDQKKSGKGILDKLRSIRDEQLSQTAEGKELTSLYYKAAPFIVAKLALNKTARNEIYQDLVTLKPLFDDVSENGASSSYKVTEKDQKAINRLYDKALQSVPSFLKEEIKKQADRLNMKQLQGKTAGAILTENNIAAKSEVQTTKVIFKVKDNKSLSSVHNEMKGFSASAQSKKDISNVKKAKKLFDNLYSFELPKDEKQNGAYTASAKRVKSAAATLSKMSNVEFAEPVQEYKSLANDIQYPYQWPLKNNGENGGVKNADVKYEPANTLLSKRKLNDTLIAVVDTGVDSTLADLKGKVRTDLGHNFVGRNNNAMDDQGHGTHVAGIIAAQSDNGYSMTGLNAKAKIIPVKVLDSAGSGDTEQIALGIKYAADKGAKVINLSLGGGYSRVLEFALKYAADKNVLIAAASGNDGENALSYPASSKYVMSVGATNRMDMTADFSNYGKGLDISAPGSDIPSLVPNGNVTYMSGTSMATPYAAAAAGLLFAQNPKLKRTEVEDMLKKTADDISFESVDGGEEELYDDYGDPIEIPKTPGVDWHSGYGRLNVMKAVSAADLQLKVNKLESTQTAVRGSAKEGTLIEVMNGKKKLGSAKAGKDNAFKVNIATQKQDQVLYLKATKGDAKTSYKVVVVKGKPSGTPKVNAVKTKDTAVKGKANSKAMIRVKNKSKKVIASAKADAKGTFSVKIKKQKAGTVLYVTAVDTDKKESKEAKVVVEK

SEQ ID NO: 4224 - protein, 495 aa, Aspergillus niger
  strain CBS 513.88 / FGSC A1513
MKRSALLASFLPLALGCDSAETHSCASAFSVSSAAAASFCATFTASTVTATTGVPDVFLSNCDYKTKHLSSACSCLGTADGSAPASTPAAPAVSSSSKVGKAPAVAATRTSAIPTTFHTTAVRVPLSTSAAAAVTSQAVLPAQSSVAGNGGTTCTVTEYASISSAVASCSNILLSNINAPASSTIDLTGLQTGAAVIFAGETTFGDTYDSDFDPIVISGTDVTITGEEGHVINGNGEAYWDGEGSNGGQDKPDHFIVVKDMYNSKIENLNILNWPVHCFEIENTEYLTISGLILNNTAGDAANSKSDGDPAAHNTDGFDIKQSDFLTLSNSWVHNQDDCVAVTSGSSIVVDNLYCYGGHGLSIGSIGGKSNNTVDGVTFSNSQVINSENGCRIKSNADTTGEVYNVKYENITLSGISDYGIDIQQDYENGGATGDPTNGVKIENISFVNVKGTMSDGKDYYILCGDGSCSNFVFTDVDITGGSDDSCNYPSSGCP

SEQ ID NO: 4225 - protein, 499 aa, Bacillus subtilis
  strain 168
MKRSISIFITCLLITLLTMGGMIASPASAAGTKTPVAKNGQLSIKGTQLVNRDGKAVQLKGISSHGLQWYGEYVNKDSLKWLRDDWGITVFRAAMYTADGGYIDNPSVKNKVKEAVEAAKELGIYVIIDWHILNDGNPNQNKEKAKEFFKEMSSLYGNTPNVIYEIANEPNGDVNWKRDIKPYAEEVISVIRKNDPDNIIIVGTGTWSQDVNDAADDQLKDANVMYALHFYAGTHGQFLRDKANYALSKGAPIFVTEWGTSDASGNGGVFLDQSREWLKYLDSKTISWVNWNLSDKQESSSALKPGASKTGGWRLSDLSASGTFVRENILGTKDSTKDIPETPSKDKPTQENGISVQYRAGDGSMNSNQIRPQLQIKNNGNTTVDLKDVTARYWYKAKNKGQNFDCDYAQIGCGNVTHKFVTLHKPKQGADTYLELGFKNGTLAPGASTGNIQLRLHNDDWSNYAQSGDYSFFKSNTFKTTKKITLYDQGKLIWGTEPN

SEQ ID NO: 4226 - protein, 587 aa, Bacillus subtilis
  subsp. natto
MKRTWNVCLTALLSVLLVAGSVPFHAEAKKPPKSYDEYKQVDVGKDGMVATAHALASEIGADVLKKGGNAIDAAVAIQFALNVTEPMMSGIGGGGFMMVYDGKTKDTTIIDSRERAPAGATPDMFLDENGKAIPFSERVTKGTAVGVPGTLKGLEEALDKWGTRSMKLLITLTIKLAEKGFPIDSVLADAISDYQEKLSRTAAKDVFLPNGEPLKEGDTLIQKDLAKTFKLIRSKGTDAFYKGKFAKTLSDTVQDFGGSMTEKDLENYDITIDEPIWGDYQGYQIATTPPPSSGGIFLLQMLKILDDFNLSQYDVRSWEKYQLLAETMHLSYADRASYAGDPEFVNVPLKGLLHPDYIKERQQLINLDQVNKKPKAGDPWKYQEGSANYKQVEQPKDKVEGQTTHFTVADRWGNVVSYTTTIEQLFGTGIMVPDYGVILNNELTDFDAIPGGANEVQPNKRPLSSMTPTILFKDDKPVLTVGSPGGATIISSVLQTILYHIEYGMGLKAAVEEPRIYTTSMSSYRYEDGVPKDVLSKLNGMGHRFGTSPVDIGNVQSISIDHENGTFKGVVISGSNDAAIGINLKRK

SEQ ID NO: 4227 - protein, 543 aa, Bacillus subtilis
  strain 168
MKRVKKLWGMGLALGLSFALMGCTANEQAGKEGSHDKAKTSGEKVLYVNNENEPTSFDPPIGFNNVSWQPLNNIMEGLTRLGKDHEPEPAMAEKWSVSKDNKTYTFTIRENAKWTNGDPVTAGDFEYAWKRMLDPKKGASSAFLGYFIEGGEAYNSGKGKKDDVKVTAKDDRTLEVTLEAPQKYFLSVVSNPAYFPVNEKVDKDNPKWFAESDTFVGNGPFKLTEWKHDDSITMEKSDTYWDKDTVKLDKVKWAMVSDRNTDYQMFQSGELDTAYVPAELSDQLLDQDNVNIVDQAGLYFYRFNVNMEPFQNENIRKAFAMAVDQEEIVKYVTKNNEKPAHAFVSPGFTQPDGKDFREAGGDLIKPNESKAKQLLEKGMKEENYNKLPAITLTYSTKPEHKKIAEAIQQKLKNSLGVDVKLANMEWNVFLEDQKALKFQFSQSSFLPDYADPISFLEAFQTGNSMNRTGWANKEYDQLIKQAKNEADEKTRFSLMHQAEELLINEAPIIPVYFYNQVHLQNEQVKGIVRHPVGYIDLKWADKN

SEQ ID NO: 4228 - protein, 203 aa, Bacillus subtilis
  strain 168
MKSKLLRLLIVSMVTILVFSLVGLSKESSTSAKENHTFSGEDYFRGLLFGQGEVGKLISNDLDPKLVKEANSTEGKKLVNDVVKFIKKDQPQYMDELKQSIDSKDPKKLIENMTKADQLIQKYAKKNENVKYSSNKVTPSCGLYAVCVAAGYLYVVGVNAVALQTAAAVTTAVWKYVAKYSSSASNNSDLEAAAAKTLKLIHQ

SEQ ID NO: 4229 - protein, 265 aa, Aspergillus niger
  strain CBS 513.88 / FGSC A1513
MKTTTLLCLAAALTQTYAFPQQGAPHPLPWSPPGPNDVRAPCPMLNTLANHGYLPHNGKDITERHTINALYNALGIEEELAIYLHQEAVTTNPAPNATTFSLNDLSRHDILEHDASLSRQDAYFGDNHDFNQTIFDETRSYWTSPIIDVKQAAVSRQARVNTSMATNPNYTMSELGDSFSYGETAAYIIVLGDKEKGLVNRSRVEYLFENERLPLDLGWSRAKENITFDDLSTMLQRIINATGGEMDFRATIALPRLVYIYYEEA

SEQ ID NO: 4230 - protein, 521 aa, Aspergillus niger
  strain CBS 513.88 / FGSC A1513
MKVSSLLSVALPGAALAATDSFQSRCNEFQNKIDIANVTVRSVAYVAAGQNISQAEVASVCKASVQASVDLCRVTMNISTSDRSHLWAEAWLPRNYTGRFVSTGNGGLAGCVQETDLNFAANFGFATVGTNGGHDGDTAKYFLNNSEVLADFAYRSVHEGTVVGKQLTQLFYDEGYNYSYYLGCSTGGRQGYQQVQRFPDDYDGVIAGSAAMNFINLISWGAFLWKATGLADDPDFISADLWSVIHQEIVRQCDLVDGALDGIIEDPDFCAPVIERLICDGTTNGTSCITGAQAAKVNRALSDFYGPDGTVYYPRLNYGGEADSAYLYFTGSMYSRTEEWYKYVVYNDTNWNSSQWTLESAKLALEQNPFNIQAFDPNITAFRDRGGKLLSYHGTQDPIISSTDSKLYYRRVANALNAAPSELDEFYRFFQISGMGHCGDGTGASYIGQGYGTYTSKAPQVNLLRTMVDWVENGKAPEYMPGNKLNANGSIEYMRKHCRYPKHNVHTGPGNYTDPNSWTCV

SEQ ID NO: 4231 - protein, 340 aa, Aspergillus niger
  strain CBS 513.88 / FGSC A1513
MKYLPLVVAATASLAPTASAHYIFSKLVLNGEASADWQYIRETTRSVVYEPTKYTSTFDNLTPNDNDFRCNLGSFSNAAKTEVAEVAAGDTIGMKLFYDTSIAHPGPGQVYMSKAPTGNVQEYEGDGEWFKIWEKTLCNENADLTKDAWCTWGMSQFEFQIPAETPAGEYLVRAEHVGLHGAQANEAEFFYSCAQVKVTGSGTGSPSLTYKIPGLYNDNMTLFNGLNLWVDSAEKIETDILETPIGDDVWSGHGSESSSAASPSVSSASVASPGTTTAVAHAHVQTPASSSTSSTAASSGNLVSHWGQCGGLNYAGPTECESPCTCVEQNPWYHQCVTSS

SEQ ID NO: 4232 - protein, 441 aa, Aspergillus niger
  strain CBS 513.88 / FGSC A1513
MLAHVLLASVAIANVATASLQIVPGATWTAAGTNQHIQAHGGGIIEVDGTYYWAGENHLNGSAFQSINCYSSTNLVEWAFESELLSLQSSGDLGPDRIVERPKIIYNEDTSTYVMWMHIDDSSYAEAKTGVATSSSVCGQYDYLGSFQPLGHQSRDIGLFKDDDGTAYLLSEDRPNGLRIDRLTDNYLNVSYTTHLFPEHYEAPAIYKQDGDGVRAANDNKYTTSTDLNGTWSDWSDFATAGTDTYDSQTSFVMQVGKSVMYMGDRWVSSNLMASTYIWLPLTLSGTNATLIDSSNWIPSTDGTWSSGGDETDPEAEASTSVLSNGAKVISCSGCSGDESVGWIGGSDNGTLEMRNISSDASTTTTIQVRYENGDSTQRYATVTVNGKSQILAFIPSDSGNTPATSVLNAQLESGDDNVITFSAYEEEYGPDIDRLLVPDE

SEQ ID NO: 4233 - protein, 565 aa, Aspergillus niger
  strain CBS 513.88 / FGSC A1513
MLAPTLWTSLLALTATASASAISSNSSCRCFPGDACWPSQSEWAQFNKTVDGRLIKTIPLGKPCHAPYYNASVCASLKEQWTEPELHYTSSSSVMAPWFANGSCDPFHPIDKPCTMGNYIDYAVNVSTPAHISATLRFADTHNIRLVIRNTAHDYNGKSTGAGGLGVWTHNLKSRTLIGNYTDSHYTGPAVRLGAGVQGFEAYEFADAHGYQIVGGECSSVGIAGGYSQGGGHSALSSRYGMAADQVLAWEVVTGTGEFVTATRDNEYKDLYWALSGGGGGTYGVVVAMTSKLHTSTPTSGLSLTFTNSNITQDTFFEAVTLYHALLPSIVDAGVMSVWYFTNTSFYISPLTGPGVPVATLRSLVAPFETGLTKLGINYTLEAKEFDTYLEEFNTMEAEIAVGKAQYGGWLIPREVVVQNTTALTEAYRQIVSDGATFIGVGLNVNRSIAGDVDNAVLPAWREALIDTTLTTPWEWDARAEMIVEQDKMTYDYIPLLEALAPNSGAYMNEGNFQQPNWKKAFYGVNYDRLLQVKNKYDPNGLFYALKAVGSDAWTQLEDGRLCRA

SEQ ID NO: 4234 - protein, 531 aa, Aspergillus niger
MLFRSLLSTAVLAVSLCTDNASAAKHGRFGQKARDAMNIAKRSANAVKHSLKIPVEDYQFLNNKTKPYRVESLPDVHFDLGEMYSGLVPIEKGNVSRSLFFVFQPTIGEPVDEITIWLNGGPGCSSLEAFLQENGRFVWQPGTYQPVENPYSWVNLTNVLWVDQPVGTGFSLGVPTATSEEEIAEDFVKFFKNWQQIFGIKNFKIYVTGESYAGRYVPYISAAFLDQNDTEHFNLKGALAYDPCIGQFDYVQEEAPVVPFVQKNNALFNFNASFLAELESIHEQCGYKDFIDQYLVFPASGVQPPKAMNWSDPTCDVYDIVNNAVLDPNPCFNPYEINEMCPILWDVLGFPTEVDYLPAGASIYFDRADVKRAMHAPNITWSECSVESVFVGGDGGPEQEGDYSANPIEHVLPQVIEGTNRVLIGNGDYDMVILTNGTLLSIQNMTWNGKLGFDTAPSTPINIDIPDLMYNEVFIENGYDPQGGQGVMGIQHYERGLMWAETFQSGHMQPQFQPRVSYRHLEWLLGRRDTL

SEQ ID NO: 4235 - protein, 941 aa, Aspergillus niger
  strain CBS 513.88 / FGSC A1513
MLFVSYVFLLLSVPVALVNAVPTSGSVDVTSHLAVRASDYWVGTIKRQGSVPFGNTTSSYAIYRNVKDYGAKGDGSTDDTDAINKAISSGGRCGSGCDSSTTTPALVYFPAGTYVVSKPIVQYYYTQLVGDANDLPVLKAASSFSGMAVIDADPYDSNGSNWYTNQNNFFRAVRNFVIDLTAMPASSGAGIHWQVGQATSLQNIRFEMVKGGSNNKQQGIFMDNGSGGFMSDLTFNGGNYGAFFGNQQFTTRNLTFNDCNTAIYMNWNWAWTFKSVSINNCQVGLNMSASPSNQTVGSVLMLDSTFTSTPTGVVTAFSSDSIPTGGGALVLENVDFSGATVAIASVNGDTILKGGSVVSNYVQGNVYTPGSTSNSTVSKRSPAVEAEDVHVVTQTITETITACGADYATETAAGSFGTASEAGAEGSTTTAAGGVLPLPSMSVQYPSAGSYSWEGFDSETSQATTATNEASVPAAGTSGGSSPAVPTSQSAGASVVAQGSGSASTASSTSSSGSYFGTSSNSTGQCSTKTVTKTRIETTIPSQAMASSLLTSSGSVFEKSKPLYASYAASSFVSVKSAGAKGDGTTDDTAIIQSVLNNATEDQIVYFDHGAYIITDTIKVPKNIKITGEVWPMLMAYGDKFSDQKNPIPMLQVGEAGESGSVEISDLVLETKGPAPGAILVQWNLQAASQGSVGMWDVHARIGGSAGTELQSDTCAKTPSQTTTANEKCIGAFLLFHATQNASVYLENTWFWTADHDLDASGHGQINIYNGRGVLLESEGPAWLYGTAAEHNQLYNYQVSNAKNVFMGLIQTETPYYQANPNALTPFTPQTSWNDPDFSYCTTDSCRKAWGLRVINSSETYIYGAGLYSFFDNYSQTCLATESCQENIVEVDCSDVHIYGLSTKASTNMITSSSGDGLVPQEGNESTYCSTIALFEQSSSI

SEQ ID NO: 4236 - protein, 375 aa, Aspergillus niger
  strain CBS 513.88 / FGSC A1513
MLGLGVLALLPFAAAKAVRPRSTACNNSPDLCSKSYGEITHLGAHDSPFLRDASTDYSTFGDQYYNTTLQLDAGVRLVTAQVHKSNSQWRLCHSSCDYLDAGLLSTWLSDIKSWLDSNPNDVVTVLLVNSDDATASDLHSQFETANLTNYTYTPTSQTSAPSSWPTLQELINNGTRLMTFVASLDASSNTVAPYLMDEFTFIWENNYDVTSASNFSCEPDRPTSLQNELSTALSSNRLPFMNHFLYQETLDIEYPNVSYISTTNAASGGTGNLGDTATKCKKEYNGRQPTFILVDFFDKGPAIDTVDSLNNVTNATGRKNLTSVSVTSSASTYSNVFKGLVEVVQKAKDGANPSMGEWIWAGGDWGSLLGGGIAV

SEQ ID NO: 4237 - protein, 865 aa, Aspergillus niger
  strain CBS 513.88 / FGSC A1513
MLGSLLLLLPLVGAAVIGPRANSQSCPGYKASNVQKQARSLTADLTLAGTPCNSYGKDLEDLKLLVEYQTDERLHVMIYDADEEVYQVPESVLPRVGSDEDSEDSVLEFDYVEEPFSFTISKGDEVLFDSSASPLVFQSQYVNLRTWLPDDPYVYGLGEHSDPMRLPTYNYTRTLWNRDAYGTPNNTNLYGSHPVYYDHRGKSGTYGVFLLNSNGMDIKINQTTDGKQYLEYNLLGGVLDFYFFYGEDPKQASMEYSKIVGLPAMQSYWTFGVCPPPPNPITVRVVVYNYSQAKIPLETMWTDIDYMDKRRVFTLDPQRFPLEKMRELVTYLHNHDQHYIVMVDPAVSVSNNTAYITGVRDDVFLHNQNGSLYEGAVWPGVTVFPDWFNEGTQDYWTAQFQQFFDPKSGVDIDALWIDMNEASNFCPYPCLDPAAYAISADLPPAAPPVRPSSPIPLPGFPADFQPSSKRSVKRAQGDKGKKVGLPNRNLTDPPYTIRNAAGVLSMSTIETDLIHAGEGYAEYDTHNLYGTRLVMSSASRTAMQARRPDVRPLVITRSTFAGAGAHVGHWLGDNFSDWVHYRISIAQILSFASMFQIPMVGADVCGFGSNTTEELCARWASLGAFYTFYRNHNELGDISQEFYRWPTVAESARKAIDIRYKLLDYIYTALHRQSQTGEPFLQPQFYLYPEDSNTFANDRQFFYGDALLVSPVLNEGSTSVDAYFPDDIFYDWYTGAVVRGHGENITLSNINITHIPLHIRGGNIIPVRTSSGMTTTEVRKQGFELIIAPDLDDTASGSLYLDDGDSLNPSSVTELEFTYSKGELHVKGTFGQKAVPKVEKCTLLGKSARTFKGFALDAPVNFKLK

SEQ ID NO: 4238 - protein, 221 aa, Aspergillus niger
  strain CBS 513.88 / FGSC A1513
MLIFPTIATLVALSTSTTALLHPRSITPPDGCPIPTWEVTTFHWYNGSKSLDCVHNQADINFKDCLCGHGWCAPDPATCNGSMVNVCWTGMPNYQPWGYGPPETLDIDFADGLTCHDEYIGYRVHDIGNGASNCGYADRGEGRIVSFYGSSNYATSTGHMDYVLGDGHALECANGSLITYSGSTDFTLSCTHDEYFNATFRTQYTSESSSDGQGYCHILSN

SEQ ID NO: 4239 - protein, 668 aa, Bacillus subtilis
  strain 168
MLKKCILLVFLCVGLIGLIGCSKTDSPEDRMEAFVKQWNDQQFDDMYQSLTKDVKKEISKKDFVNRYKAIYEQAGVKNLKVTAGEVDKDDQDNKTMKHIPYKVSMNTNAGKVSFKNTAVLKLEKTDDEESWNIDWDPSFIFKQLADDKTVQIMSIEPKRGQIYDKNGKGLAVNTDVPEIGIVPGELGDKKEKVIKELAKKLDLTEDDIKKKLDQGWVKDDSFVPLKKVKPDQEKLVSEATSLQGVTRTNVSSRYYPYGEKTAHLTGYVRAITAEELKKKKEGTYSDTSNIGIAGLENVYEDKLRGTTGWKIYVPQTGEVIAEKKAKDGEDLHLTIDIKTQMKLYDELKDDSGAAVALQPKTGETLALVSAPSYDPNGFIFGWSDKEWKKLNKDKNNPFSAKFNKTYAPGSTIKPIAAAIGIKNGTLKADEKKTIKGKEWQKDSSWGGYSVTRVSERLQQVDLENALITSDNIYFAQNALDMGADTFTKGLKTFGFSEDVPYEFPIQKSSIANDKLDSDILLADTGYGQGQMQMSPLHLATAYTPFVDNGDLVKPTLIKKDSQTADVWHKQVVTKEGAADITKGLKGVVEDERGSAYQPVVKGITVAGKTGTAELKTSKDDKDGTENGWFVGYDYENKDLLVAMMIQNVQDRGGSHYVVEKAKKQFQSN

SEQ ID NO: 4240 - protein, 170 aa, Bacillus subtilis
  strain 168
MLKKKWMVGLLAGCLAAGGFSYNAFATENNENRQASSKTDALTEQEAEAIAKTVVDGTVEDIDRDLYNGKEVYEVEIEKEGEDYDVYVDIHTKQALNDPLKEKAEQVAITKEEAEEIALKQTGGTVTESKLDEDDGAYIYEMEIQTKQGTETEFEISAKDGRIIKQEIDD

SEQ ID NO: 4241 - protein, 561 aa, Aspergillus niger
  strain CBS 513.88 / FGSC A1513
MLKLAVALFSLLAVGNAAPTKVARSTASPTAKVRNGTYVGVTNAHYQQDFFLGMPYAQQPLGDLRFTVPQSLNESWSGERDAKEYSNICVGYGTDSIWYPQSEACLTLNVIRDSSANENSKLPVGVWIHGGGFFEGSSADQRYNMSAIVANSYKIGKPFIAVSLNYRLSAWGFLSSSQVWGTGNTNLGIRDQRLALHWIKENIAAFGGDPDKITIWGESAGAMSVGYHLAAYGGRDDGLFRGGIMESGGTIAASPANYTGYQAHYDELAGQVGCSDVVDSLQCLREVPFEKLNAALNTTSGNSDFNFGPVIDGDIIRDWGSLQLDKHEFVKVPILAGTNTDEGTAFGPTGINTTEEFYAYLTDGESGFQLPPTIAQEILQLYPDDPALGIPEFLGDTRVPSKGYQWRRTCAYAGDYVMHANRRRQCEAWTETSTTAYCYRFNMRAADVPILSGATHFEEVAFVFNNIAGLGYHYGKPFAGMPESYVQLSNLMTSMWASFIHDLDPNSGIKDSAVQWQPYGKDQPVDLVFDANVTSYSYMEPDTWRKEGIDYINSVANAYWR

SEQ ID NO: 4242 - protein, 154 aa, Bacillus subtilis
  strain 168
MLKRTSFVSSLFISSAVLLSILLPSGQAHAQSASIEAKTVNSTKEWTISDIEVTYKPNAVLSLGAVEFQFPDGFHATTRDSVNGRTLKETQILNDGKTVRLPLTLDLLGASEFDLVMVRKTLPRAGTYTIKGDVVNGLGIGSFYAETQLVIDPR

SEQ ID NO: 4243 - protein, 604 aa, Aspergillus niger
  strain CBS 513.88 / FGSC A1513
MLLARLWPACLTLLVAGAAAVKVNPLPAPRNISWTSSGPKQLASFVSLRASQDTPDFILANGWNRAWDSIVSLQWVPAATEGPMSSYQPFPTATAAAGVTKRSSQALPSLQFVDVNVADLDADLQHGVDESYTLEVTESATSVVIEAPTVWGALHAFTTLQQLVISDGQGGLIIEQSVKIQDAPLYPYRGIMLDTGRNFISVSKIYEQLDGMSLSKLNVLHWHMEDTQSWPVQIDAYPEMIHDAYSPREVYSHADMRNIVAYARARGVRVIPEIDMPSHSASGWKQVDPQMVTCVDSWWSNDDYALHTAVEPPPGQMDIIYNGTYDVVREVYNELSGIFPDNWFHVGADEIQPNCFNFSSYVTQWFAEDPSRTYNDLAQYWVDHAVPIFQNYSSSRQLVMWEDIVLSTEHAHDVPTNIVMQTWNNGLDYINQLTAKGYDVIVSSSDFMYLDCGMGGFLTNDPRYDVMSNPDPNTPNFNYGGNGGSWCAPYKTWQRIYDYDFTQNLTDAQAQHIVGAEAPLWSEQVDDVTVSSLFWPRAAALAELVWSGNRDENGHKRTTLMTQRILNFREYLVANGVQAKALVPKYCVQRPHTCDLYRNQSVIQ

SEQ ID NO: 4244 - protein, 558 aa, Aspergillus niger
  strain CBS 513.88 / FGSC A1513
MLLDKLSVLSFLGLAPIFAAAQLSGSVGPLTSASTKAATKTCNVLDYGAKADKSTDLGAPLASAFADCKSGGLVYVPSGDYALSTWARLSGGEAWALQIDGIIYRTGTDGGNMIYIEHSSDFELFSSTSEGAMQGLGYEFHADDNWSGPRLLRLYEVTDFSVHDFILVDSPSFHFSLDTCTNGEIYNMAIRGGNHGGLDGIDVWSNNIWVHDVEVTNKDECVTVKSPSKNILIESIYCNWSGGCGMGSFGSDTNVSDITYRNIYTWSSNNMMLIKSNGGSGFVENVLLENFIGHGNAYSLDIDSYWASMSAVDGDGVQLSNITVKNWKGTEAYGAERGPVKVVCADGAPCYDITIEDFAMWTEEGDSQWYSCESAYGSGYCLQDSDDHVSYSVTTSTVSSAPSGYSATSMAADLTTDFGSTVSIPIPTIPTSFYPGATPYSALMANSASTAAASSIASHATVHSSSASVAASVPSAVAPSESIPAATSAVVSSAAAIAPSPAVGAQEGSTTSAPSFAAPSGAGNSPQGPTGASGFGEKGQQGEQGEQGEQGEQGVCYV

SEQ ID NO: 4245 - protein, 397 aa, Aspergillus niger
  strain CBS 513.88 / FGSC A1513
MLLHGLLLALQAILASSAAITSPSSNHLSTAAREKCQTTLQCPPGTLIVSNTHPQLSNFTTLQAAINALPNDNSSQTILLLSGSYNEQVNITRSGPITLLGQQPDRAALTDPARNTVNLTFAGANSDSTGDIDNVWFSVMVVAPTLDASLTGSGTTGYPVPADTPFGNTDFRVYNIDFRNTYAPYSAGPAHAISFSRSNGGFYYCGFYSYQDTIYIGKLGSAYMYKSILAGQTDFLYGFGTLFIQSSQIVLRSCGGGITAWKGTNTTVRNNYGVYIHDSTVNAANTSIAEQIKGSCALGRPWNSLHRSIFANTYEDGSIEPSGYINWEDRWSKNETLMAEYKAYGPGFNLTGRRESEVSVLLSSSEEERYRDPSRLFLFEDGREGNVAWIDWDVVSS

SEQ ID NO: 4246 - protein, 318 aa, Aspergillus niger
  strain CBS 513.88 / FGSC A1513
MLSFVLLLCVALVNAYSDPGACSGTCWAHDPNVIRRVSDGTYFRFSTGGGVHISSASAITGPWTDLGYALPNGSIVTVGNASNLWAPDVHYVDGTYYMYYASSTLGSRDSTIGVATSTTLEADSWTDHGEIGVTSSSSTPYNAIDPNWITIGSTPYLQFGSYWQGLYQVEMTDSLSASSSTPTNLAYNASGNHAIEASYLYEYGGYYYLTFSSGKAQGYTTSLPAQGDEYRIVVCRSKTGTGNFVDKDGVSCLNSGGTTVLASHDYVYGPGGQGIINTTSHGIVVYYHYANKNIGLAVDDYQFGWNTLTWTDGWPVVA

SEQ ID NO: 4247 - protein, 611 aa, Aspergillus niger
  strain CBS 513.88 / FGSC A1513
MLSSLLSQGAAVSLAVLSLLPSPVAAEIFEKLSGVPNGWRYANNPQGNEVIRLQIALQQHDVAGFEQAVMDMSTPGHADYGKHFRTHDEMKRMLLPSETAVDSVRDWLESAGVHNIQVDADWVKFHTTVNKANALLDADFKWYVSDAKHIRRLRTLQYSIPDALVSHINMIQPTTRFGQIQPNRATMRSKPKHADETFLTAATLAQNTSHCDSIITPHCLKQLYNIGDYQADPKSGSKIGFASYLEEYARYADLERFEQHLAPNAIGQNFSVVQFNGGLNDQLSSSDSGEANLDLQYILGVSAPVPITEYSTGGRGELVPDLSSPDPNDNSNEPYLDFLQGILKLNNSDLPQVISTSYGEDEQTIPVPYARTVCNLYAQLGSRGVSVIFSSGDSGVGAACLTNDGTNRTHFPPQFPASCPWVTSVGATSKTSPEQAVSFSSGGFSDLWPRPSYQHAAVQTYLTKHLGNKFSGLFNASGRAFPDVSAQGVNYAVYDKGMLGQFDGTSCSAPTFSGVIALLNDARLRAGLPVMGFLNPFLYGVGSEKGALNDIVNGGSVGCDGRNRFGGTPNGSPVVPFASWNATTGWDPVSGLGTPDFAKLKGVALGEEGGN

SEQ ID NO: 4248 - protein, 1217 aa, Bacillus subtilis
  strain 168
MLSVEMISRQNRCHYVYKGGNMMRRILHIVLITALMFLNVMYTFEAVKAAEPQQPISIEKAIQQKEGQALVEGYAVGQAVSPQHYKLTSPFSNDYNVALADRKNKTSPEHILPVQIPSAFRSQFGLQTNPLLLGKKITVQGKLENYFNTTGLKNVQSMNVTDDTKTPPAEQQVTINEARGRLNEEVTIKGIITADQNAIGGGKLSTFLQDETGGINIYSPSPEQFPELKEGMDVTVTGKITSYQGLKEIVPNSSGIKINQSNQSLPAPKHLTINELINGSLGDQYEGRLVKLTAFVSSIPSSPAGGGYNVTMIDDDHHAMTLRVMNETGVINELDEGKWYEFTGVLSRYQTFQLLPRKSADLKLLEEQPAPPSAEGEYEGIVDRVVDGDTIHLKSPVLGTTKIRFVNVDAPETYHTPKNDADENQLRFGKKASDYLKTVLSPGDKITVKVGSEAKDSYGRLLGQVITESGSNVNLELVKNGYAPTYFIWPVDNEEDYQQFQAAVAAAKKDQKGIWNENDPLMEMPFEFRAREQGKGLTRYVGDSSNKTYVQPADWKKIAVENRIFFASASEAESAGYKKRQTAPQEHVPLRILSMNDLHGKIDQQYELDLDGNGTVDGTFGRMDYAAAYLKEKKAEKKNSLIVHAGDMIGGSSPVSSLLQDEPTVELMEDIGFDVGTVGNHEFDEGTDELLRILNGGDHPKGTSGYDGQNFPLVCANCKMKSTGEPFLPAYDIINVEGVPVAFIGVVTQSAAGMVMPEGIKNIEFTDEATAVNKAAEELKKKGVKAIAVLAHMSAEQNGNAITGESADLANKTDSEIDVIFAAHNHQVVNGEVNGKLIVQAFEYGKAIGVVDVEIDKTTKDIVKKSAEIVYVDQSKIEPDVSASAILKKYETIAEPIISEVVGEAAVDMEGGYSNDGDTPLGNLIADGMRAAMKTDFALMNGGGIREALKKGPITWGDLYNIQPFGNVLTKLEIKGKDLREIINAQISPVFGPDYSISGFTYTWDKETGKAVDMKMADGTEIQPDATYTLTVNNFMATATGAKYQPIGLLGKNPVTGPEDLEATVEYVKSFDEPIAYTKEGRIKLAEASDIEDPVTEDPITEEPGDDPGTEDPIKEDPRPGEDLPDIKETPGTAPVHQLPPSAISRFNEIPINNTKTADTANSISTLPLQTETAESGSDHQLPDTSAGYYNFMVIGAAVTLSGTYLYVRRKRSASRT

SEQ ID NO: 4249 - protein, 411 aa, Bacillus amyloliquefaciens
  strain ATCC 23350 / DSM 7 / BCRC 11601 / NBRC 15535 / NRRL B-14393
MLTSWRKYILAGLMICLVAPAVTRTEIAEADSQVSALMVSDAQKLVGNKYVYGGDEPKDGFDPSGLIQYLFSRQNIHLPRTVSDQWKVGAAVKENELLPGDIVFFKKSDSLQTAPVQDGLYIGNGEMIHSSPSEGVTVTSFQKSNYWMNLYLGAKRITKDPELADNPIVQEAARYLDIPYVFGGSTPEEGFDCSGLVQYVFENKLHIYLPRSAEQQWLVGEKIKLSSIKPGDVIYFSDTYKKGISHAGIYAGEGRFIQASRSAKVTISYLSEDYWKKHYTGVRRFSNLAISKDNPVVSTAADYIGISYLKGGASPETGFDTAGFVQYVYQKAKGISLPRYAEKQMQAGAPVSKQDLKPGDLVFFKAESLNPAIYIGNGQVIHVTLSAGVTITNMNTSAYWKDKYAGSIRIP

SEQ ID NO: 4250 - protein, 664 aa, Aspergillus niger
  strain CBS 513.88 / FGSC A1513
MLVRQLALALAIAALSDAIPTSIKHVLHEKRHKPASDWVKGARVESDAVLPMRIGLAQNNLDKGYDFLMEVSDPKSSKYGQYWSADEVHDIFSPSEEAVEAVREWLVASGIHPSRVVHSDNKGWLAFDAYAHEAERLFMTEFHEHESDRSAKIRVGCDQYHVPEHIQKHIDYITPGVKLTQVVKRTNKVKRASQLAHSSKAKSAAQGPQPLPNKAKFLPEDLRGCGYNITPSCIKALYQIPDAKTATPNNSLGLYEQGDYFAKSDLDLFYKEYAPWVPQGTYPIPALIDGANYSVPSYSSLNTGESDIDIDMAYSLLYPQQVTLYQVDDQLYEPVEVDTTNLFNTFLDALDGSYCTYSAYGETGDDPSIDPVYPDTRPGGYKGKLQCGVYKPTNVISASYGQSEADLPVSYTKRQCNEFMKLGLQGHSILFASGDYGVASFAGDGDENGCLGPEGKIFNPQYPSNCPYVTSVGGTMLYGYQTVNDSESVMHVNLGGTASNFSTSGGFSNYFPQPAYQFAAVEQYFQSANLSYPYYSEFEVDVNTTKGLYNRLGRAYPDVSANGAHFRAYMDGYDYHWYGSSLASPLFASVLTLLNEERFAIGKGPVGFVNPVLYAYPQVLNDITNGTNAGCGTYGFSAIEGWDPASGLGTPNYPLMKELFLSLP

SEQ ID NO: 4251 - protein, 782 aa, Aspergillus niger
  strain CBS 513.88 / FGSC A1513
MLVSRKVHSAIPAVFLAWVVTGQESSNSSFDVLDYVNPLIGTSNGGHSFAGATLPFDTIGENQAGFAYDTTYVSGFSHMHDDGTGGSPSLGNFPIFVHPGCPNDALDKCTWQQSDRGIPWTKGSPKARPGYFGITLQSGVFAEMTVTNHSALYRFTFDNATTESLSPVVLVDLMDLPQSRTNGTATVNPSTGRLTGNGTFSPSFGIGTYDLHFCVDFKGGDVRDTGVWSNNRAGQGQTTISLTSDGSNTAATLSASTFTRFNMSTNDQALMARVGVSFISVEQACANAEKEQPNFDFAGTVSAAEAAWRDKLNVFSVNPGNASSDLQEVFWSGMYRAMISPQDYTGENPLWQSDEPYYDSYYCIWESFRGVHQLLTLADPLSQSRMMRSLVDIYRHEGYLPDCRMSLGKGYTQGGSNADILLADALLKNVSDIDWSTAYEAVVKDAEVEPANWNVEGRGGLTSWKTLNYIPTDDFDPYGVGLHTRSISRTVEYAYDDFCIAQMAQRLGHQSDYETYMLRANNWQNMFKDDQKSYLQGKDTNFTGFLQPRYPNGTWGYQDPIFCSPLLNFTSCYLSADGHETYEGSAWLYSFFVPQDMAALVTRLGGPQTFTSRLSYLHDSGLLYVGDEQAFLTVFQFHYSGRPGLSTQRAHYYIPSQFNTSVSGIPGNDDGGAMGAFAVLSMMGLFPVHGQDVYLISPPFFEEISLQNKQTGKVATIRNVNFDPTYKSIYIQSAKRDGQAWTKNWISHDFFLNGGTLELELGPTESDWGTRDLDLPPSMSNH

SEQ ID NO: 4252 - protein, 235 aa, Bacillus subtilis
  strain 168
MMKKGLLAGALTATVLFGTCAVDVPGIISPKTAEAASQLTDGIGGRAYLNSNGAILVTKIQLPSSTQVSNGTAYIYSGFSGGTESDIGFQYSDKYNVWKPYMKVGSKGQDQVQYLEGGSQFTNTKGFRPGSTVQLTIYKNLNGNTRATYWGTNNAGYNGRLISEISKTNVGSISKWKALATVATTGSRQSIKSNFSTSFTNITIDNKAITPVIDTQDFAKVTVSGNSVSLSVVKN

SEQ ID NO: 4253 - protein, 423 aa, Bacillus amyloliquefaciens
  strain ATCC 23350 / DSM 7 / BCRC 11601 / NBRC 15535 / NRRL B-14393
MMSGVKKPICLLLACFTMLSVLLMGPGAAEVLAASDVTVNVSAEKQVIRGFGGMNHPAWVGDLTAAQRETAFGNGQNQLGFSILRIHVDENRNNWYKEVETAKSAIKHGAIVFASPWNPPNDMVETFNHNGDTSAKRLRYDKYAAYAQHLNDFVTFMKNNGVNLYAISMQNEPDYAHEWTWWTPQEILRFMRENASSINARVIAPESFQYLKNISDPILNDPQALRNMDILGTHLYGTQVSQFPYPLFKQKGAGKDLWMTEVYYPNSDNNSADRWPEALDVSQHIHNSMTEGDFQAYVWWYIRRSYGPMKEDGTISKRGYNMAHFSKFVRPGYVRIDATKNPNPNVYVSAYKGDNKVVIVAINKTNTGVNQNFVLQNGSASQVSRWVTSSSSNLQPGTDLNVTDNHFWAHLPAQSVTTFVVKR

SEQ ID NO: 4254 - protein, 115 aa, Bacillus subtilis
  strain 168
MNFKKTVVSALSISALALSVSGVASAHEINSTPTEVKNISISPTHVIKIQDYNLPLKVGETYSVKNNSATRYWTDNQKVAEVDQNGLVTAKSKGKATITLFKGTAVFGKVYVTVY

SEQ ID NO: 4255 - protein, 443 aa, Bacillus subtilis
  strain 168
MNIKKCKQLLMSLVVLTLAVTCLAPMSKAKAASDPIDINASAAIMIEASSGKILYSKNADKRLPIASMTKMMTEYLLLEAIDQGKVKWDQTYTPDDYVYEISQDNSLSNVPLRKDGKYTVKELYQATAIYSANAAAIAIAEIVAGSETKFVEKMNAKAKELGLTDYKFVNATGLENKDLHGHQPEGTSVNEESEVSAKDMAVLADHLITDYPEILETSSIAKTKFREGTDDEMDMPNWNFMLKGLVSEYKKATVDGLKTGSTDSAGSCFTGTAERNGMRVITVVLNAKGNLHTGRFDETKKMFDYAFDNFSMKEIYAEGDQVKGHKTISVDKGKEKEVGIVTNKAFSLPVKNGEEKNYKAKVTLNKDNLTAPVKKGTKVGKLTAEYTGDEKDYGFLNSDLAGVDLVTKENVEKANWFVLTMRSIGGFFAGIWGSIVDTVTGWF

SEQ ID NO: 4256 - protein, 251 aa, Bacillus subtilis
  strain 168
MNILFSKRLGILTIGSLLVLAGCQTSGSSAGESNQTTSSSAVEEDSSKTQEQTSDSHTHEHSHDHSHAHDEETEKIYEGYFKNSQVKDRLLSDWEGDWQSVYPYLQDGTLDEVFSYKSEHEGGKTAEEYKEYYKKGYQTDVDRIVIQKDTVTFFKNGKEYSGKYTYDGYEILTYDAGNRGVRYIFKLAKKAEGLPQYIQFSDHSIYPTKASHYHLYWGDDREALLDEVKNWPTYYPSKMDGHDIAHEMMAH

SEQ ID NO: 4257 - protein, 518 aa, Bacillus subtilis
  strain 168
MNKKYFVLIVCIIFTSALFPTFSSVTAAQGEAVIATDEMNVRSGPGLSYGITAEVKKGERYPILKEDGDWVQIQLGSGEKGWVVSWLITKEDQASTSSSGSSDTVTSTDPDLRMRSGPGTSYEVIGKFPQGSQASVIDKDSGWIKISYHSATGWVSSEYVTSGGSSSASDESDQTEDSGASTTGTVGVSSLNVRASASHDAAIITKLDRGTKLTVLNEKNGWAHIEVNGLKGWVASHYLLTSSVPADDSANAGSSSSAKKAYIMYGGTNLRSDASTSASIVERAAKGDSYTITGSKGSWYEIKLDNGQTAYVANWVVQTSKSAEEAGEPPVSDSPSGNGSLNNKTIIVDPGHGGKDSGTIGYSGKFEKNLTIKTAKLLASKLRSAGADVYVTRQDDTFVSLQSRVSTSHYRNADAFISIHYDSYADTSTRGSTAYYYSPAKDQELASDVHSEVVKRSSIPDRGVLFGDYYVLRENRQPAMLYELGYVSHPQEEAIVHSNSYQEKVTDGIESGLEKYFQ

SEQ ID NO: 4258 - protein, 119 aa, Bacillus subtilis
  strain 168
MNKLKRLSMLTVMIASVFIFSSHALAAQYYTVSTSSGAPVNMRSGPGTSWGIVTTIPSGTRIPIYCYKTGTTVTGKYGTSNIWNYTERTLASGEIVPGFVSDTYMYTGSDGPVVPKCSW

SEQ ID NO: 4259 - protein, 248 aa, Aspergillus niger
  strain CBS 513.88 / FGSC A1513
MNRYLSIPLCLASAVPALAGLAARDPIGTICTKNNIITTDDFILYNNLWGEDYATSGSECTYLDYDSGNSISWQTSWTWAGGDDYVKSYPNAVLNVGAKQLSTITSIPSTWKWSYTGNDLVADVSYDAFLSTTDSTTATHEYEIMIWLAAYGGIEPIGNSDGPIASPTIGGYTWDLYKGPNDWTVYSFVARETITDFSADVLEFFTYLVDNEGVSSSLYLQTLGAGTEPKTGSDAWFTVSPYTVSINT

SEQ ID NO: 4260 - protein, 378 aa, Aspergillus niger
  strain CBS 513.88 / FGSC A1513
MPLKPILLSALASLASASPLLYSRTTNETFVFTNANGLNFTQMNTTLPNVTIFATGGTIAGSDSSSTATTGYTSGAVGVLSLIDAVPSMLDVANVAGVQVANVGSEDITSDILISMSKKLNRVVCEDPTMAGAVITHGTDTLEETAFFLDATVNCGKPIVIVGAMRPSTAISADGPFNLLEAVTVAASTSARDRGAMVVMNDRIASAYYVTKTNANTMDTFKAMEMGYLGEMISNTPFFFYPPVKPTGKVAFDITNVTEIPRVDILFSYEDMHNDTLYNAISSGAQGIVIAGAGAGGVTTSFNEAIEDVINRLEIPVVQSMRTVNGEVPLSDVSSDTATHIASGYLNPQKSRILLGLLLSQGKNITEIADVFALGTDA

SEQ ID NO: 4261 - protein, 479 aa, Aspergillus niger
  strain CBS 513.88 / FGSC A1513
MPRTSLLTLACALATGASAFSYGAAIPQSTQEKQFSQEFRDGYSILKHYGGNGPYSERVSYGIARDPPTGCEVDQVIMIKRHGERYPSPSAGKSIEEALAKVYSINTTEYKGDLAFLNDWTYYVPNECYYNAETTSGPYAGLLDAYNHGNEYKARYGHLWDGETVVPFFSSGYGRVINTARKFGEGFFGYNYSTNAALNIISESEVMGADSLTPTCDTDNDQTTCDNLTNQLPQFKIAAARLNSQNPGMNLTASDVYNLMVMASFELNARPFSNWINAFTQDEWVSFGYVEDLNYYYCAGPGDKNMAAVGAVYANASLTLLNQGPKEAGSLFFNFAHDTNITPILAALGVLIPTEDLPLDRVAFGNPYSTGNIVPQGGHLTIERLSCQATALSDEGTYVRLVLNEAVLPFNDCTSGPGYSCPLANYTAILNKDLPDYTTTCNVSASYPQHLSFWWNYNTTTELNYRSSPIACQEGAAMD

SEQ ID NO: 4262 - protein, 370 aa, Aspergillus niger
  strain CBS 513.88 / FGSC A1513
MPSAKPLFCLATLAGAALAAPAPSRVSDFTKRSTCTFTDAATASESKTSCSDIVLKDITVPAGETLNLKDLNDGTTVTFEGTTTWEYEEWDGPLLRISGKDITVTQSSDAVLDGNGAKWWDGEGTNGGKTKPKFFYAHDLDDSKISGLYIKNTPVQAISVESDNLVIEDVTIDNSDGDSEGGHNTDGFDISESTYITITGATVKNQDDCVAINSGENIYFSGGTCSGGHGLSIGSVGGRDDNTVKNVTFIDSTVSDSENGVRIKTVYDATGTVEDITYSNIQLSGISDYGIVIEQDYENGDPTGTPSNGVTISDVTLEDITGSVDSDAVEIYILCGDGSCSDWTMSGIDITGGETSSDCENVPSGASCDQ

SEQ ID NO: 4263 - protein, 583 aa, Aspergillus niger
  strain CBS 513.88 / FGSC A1513
MPSFASWLLTSGLAAVASAITANDSLVARQIDTQPFPYDFPQLGVNGSDLFPMRDCHGFTLEEASIDEIQAQLKAGRFTGSQLLQCYLERIYQVQPYTNAVLQFNPDAMAIAEALDAERKQGTVRGPLHGIPFLVKDNIASKDKMETTAGSWALVGSVVPRDSHVVHRLRQAGAVLLGKATLSEWADMRSNDYSEGYSGRGGQCRNPYNFTVNPGGSSSGSGVAVTSNQVPFALGTETDGSVINPAERSNVVGIKPTVGLTSRAGVIPESLHQDTVGTFGKTVRDAAYALDAIYGIDPRDNETYAQQGKTPAGGYAQFLTNQTALKGAVFGLPWLSFWQYNDAAQNAQLMELLALIEAAGATIINGTELPHYKEIVDPSGWNWDYGTTRGYPNQSEYSYVKVDFYNNIRDYLAELNNTNMRSLEDLVQYNLDNAGSEGGVPGVNPAFASGQDGFLASLATKGEMNETYWQALEYCHRTSREEGIDAALHYQGRNLTALLVPPDFAPSIEIAAQAGYPVVTLPAGINQDSHMPYGLALMGTAFSEATLIKYASAIEDLQLSSNTPWKRSLATWSGYLDRNIPVN

SEQ ID NO: 4264 - protein, 242 aa, Bacillus subtilis
  strain 168
MPYLKRVLLLLVTGLFMSLFAVTATASAQTGGSFFDPFNGYNSGFWQKADGYSNGNMFNCTWRANNVSMTSLGEMRLALTSPAYNKFDCGENRSVQTYGYGLYEVRMKPAKNTGIVSSFFTYTGPTDGTPWDEIDIEFLGKDTTKVQFNYYTNGAGNHEKIVDLGFDAANAYHTYAFDWQPNSIKWYVDGQLKHTATNQIPTTPGKIMMNLWNGTGVDEWLGSYNGVNPLYAHYDWVRYTKK

SEQ ID NO: 4265 - protein, 460 aa, Aspergillus niger
  strain CBS 513.88 / FGSC A1513
MQLAQLAAFAMTLATSEAAYQGFNYGNKFSDESSKFQADFEAEFKAAKNLVGTSGFTSARLYTMIQAYSTSDVIEAIPAAIAQDTSLLLGLWASGGGMDNEITALKTAISQYGEELGKLVVGISVGSEDLYRNSVEGAEADAGVGVNPDELVEYIKEVRSVIAGTALADVSIGHVDTWDSWTNSSNSAVVEAVDWLGFDGYPFFQSSMANSIDNAKTLFEESVAKTKAVAGDKEVWITETGWPVSGDSQGDAVASIANAKTFWDEVGCPLFGNVNTWWYILQDASPTTPNPSFGIVGSTLSTTPLFDLSCKNSTTSSSSAVVSAAASSAAGSKAVGSSQASSGAAAWATSASGSAKPTFTVGRPGVNGTVFGNGTYPLRPSGSASARPSAGAISSGSGSSSSGSGSSGSTGTSATSGQSSSSGSSAAAGSSSPAAFSGASTLSGSLFGAVVAVFMTLAAL

SEQ ID NO: 4266 - protein, 184 aa, Aspergillus niger
  strain CBS 513.88 / FGSC A1513
MQLKNLIFAAATAAALPATDAATNEPFGVISIHSGSGVQYAPINAALGSIFAGLKSQNASCSNPQDQTATFFLDDGALYLYDQSATPQELYVDRSGMGQGKIGYTTGAQPAPKNGERKGWSIDANNHLQFGGKDLIACPNSIEGAWSIWADAGVAKPGYNEGCEGIAARVEVSKNPNVCSYTSN

SEQ ID NO: 4267 - protein, 407 aa, Aspergillus niger
  strain CBS 513.88 / FGSC A1513
MQLLQSVSTGLLLASSCLSSLAAARSVPAAKSIAARQSTDKIAPKVFIVSMFEPEAAIWWGIPEFNVLEHNITIPGASPLFPDVHCTADHNICQLVTGEAEINAAVTVSSIIFNPTFDLTNTYFLIAGIAGVNPELTTICSVTLARYAVQVALQYEIDIREMPANATTGYFPQGSYYPWQYPGSIYGTEVFEVNDNLRQLAAAFASKATLADSDDAKAYRAKYNTSDGIYAAGAAAPSVVQCDVATSDVYYSGNILGDTFANTTKVLTNGTGNYCASAQEDNATLEAMVRAAKAKLVDFSRIIVMRTASDFDRPYPGESARENLLYATTGAYEPSVQNIYNAGVKIVEGIISQWNSTFAAGITPSNYIGDIFGTLGGSPDFGPYANAAEAGVTLKRSVPRRRSLRGY

SEQ ID NO: 4268 - protein, 525 aa, Aspergillus niger
  strain CBS 513.88 / FGSC A1513
MQLSLLALLGALALPSAAVPHARDEGQCKQTTVAILGGGMAGIAAAQTLHNASMDDFMILEYRDTIGGRAWHKPFGQDKDGNPYIIEMGCNWVQGLGTPGGPQNPVWTLAQVYNLSTIYSNYSNVSTYNQHGYKDYSHLIDTWDDIYDTAAAQAGVMLLDNLQDQTAQTGLALAGWRPKVDDMEAQAVDWWSWDFEDAYTPLESSFIFGVAGQNLTVNGFSDEDNFVIDQRGYSHIIHGMASTFLKPNDTRLLLNNHITNISYSDSGVTVHSSDGSCVRASYAICTFSLGVLQHDAVTFTPSLPEWKKEAIEGFTMATYTKIFLQFNETFWPEDTQYFLYADPYMRGYYPVFQSLSTEGFFPGSNIIFVTVTEQFAWRAERQSDEKTKAEVMEVLRKMFPEKDIPDPIAFMYPRWTLEPWAYGSYSNWPPSTTLEMHENLRANAGRLWFAGEATSPTYFGFLHGAWFEGQAAGLHLSSILNGTCKANTTCKGRKHYETLHGTTPLSDYSFVDGWNGNSFYDFNDD

SEQ ID NO: 4269 - protein, 92 aa, Aspergillus niger
  strain CBS 513.88 / FGSC A1513
MQLTSIAIILFAAMGAIANPIAAEADNLVAREAELSKYGGECSVEHNTCTYLKGGKDHIVSCPSAANLRCKTERHHCEYDEHHKTVDCQTPV

SEQ ID NO: 4270 - protein, 171 aa, Aspergillus niger
  strain CBS 513.88 / FGSC A1513
MQTKSLLTILLSAALAAATVDPATSNTKGKCPGTYNCSAAKTSTAIQAAECSHNTRTSGTFPFPQRQSAQKKKKKYTDVCDVETQTFAVFVTDHQYDSSYGAPYGTCKAYTCTAPTDSEMTDSDDDCWTFFWNDNGESSGSGTGCIRSPDDGTCGCENSDGTFVYGGTDCS

SEQ ID NO: 4271 - protein, 605 aa, Aspergillus niger
MQTLLVSSLVVSLAAALPHYIRSNGIEASLLTDPKDVSGRTVDYIIAGGGLTGLTTAARLTENPNISVLVIESGSYESDRGPIIEDLNAYGDIFGSSVDHAYETVELATNNQTALIRSGNGLGGSTLVNGGTWTRPHKAQVDSWETVFGNEGWNWDNVAAYSLQAERARAPNAKQIAAGHYFNASCHGVNGTVHAGPRDTGDDYSPIVKALMSAVEDRGVPTKKDFGCGDPHGVSMFPNTLHEDQVRSDAAREWLLPNYQRPNLQVLTGQYVGKVLLSQNGTTPRAVGVEFGTHKGNTHNVYAKHEVLLAAGSAVSPTILEYSGIGMKSILEPLGIDTVVDLPVGLNLQDQTTATVRSRITSAGAGQGQAAWFATFNETFGDYSEKAHELLNTKLEQWAEEAVARGGFHNTTALLIQYENYRDWIVNHNVAYSELFLDTAGVASFDVWDLLPFTRGYVHILDKDPYLHHFAYDPQYFLNELDLLGQAAATQLARNISNSGAMQTYFAGETIPGDNLAYDADLSAWTEYIPYHFRPNYHGVGTCSMMPKEMGGVVDNAARVYGVQGLRVIDGSIPPTQMSSHVMTVFYAMALKISDAILEDYASMQ

SEQ ID NO: 4272 - protein, 1072 aa, Aspergillus niger
  strain CBS 513.88 / FGSC A1513
MQVKFLATLLPLLLHLPAAVDGLPGKNARISASLKRHAGRDVPQTALNSTNVYQTKFSGVTWDEDHWLLTTTTPDQGHYQSRGSVANGYLGINVANIGPFFELDEPVNGDVINGWPLYSRRQSFATISGFWDRQAHTNGSNFPWLSQYGDDSVISGVPHWSGLILDLGDDTYLDATVDNRTISNFKSTYDFKSGVLSWSYTWTPQGNKGSYAITYRLFAHKLYVNRAVVDMEITPLTNGNATVVNVLDGYAAVRTDFVASGQEEGAIFSAVRPWGVNNVTAYVYATLDGSDSVDLSSRRIVTDKPYVSTNSSSVAQAVDVMFTANETVRITKFVGGATTDYFLATQETAKAACLAGLADGYVKSLQSHVGEWATIMHDHSVDRFTDPATGKLPEDSHIVDSAIIAVTNTYYLLQNTAGTNAIVAAGGIPVNVDSCAPGGLTSDSYGGQIFWDADLWMQPGLVASHPESAQRFTNYRIALHYQAQANIETAFTGSKNQTSFSSSAAIYPWTSGRFGNCTATGPCWDYQYHLNGDIGLAMINQWVASGDTAWFKNYLFPIYDAAATLYSELVERNGSSWTLTNMTDPDEYANSINAGGYTMPLIAETLQNANKLRKQFGLEPNETWDEIAEDVLILRENGVTLEYTSMNGSAVVKQADIVLNTFPLTYESDNYTATNSLTDLDYYANKQSADGPAMTYAIFAIVASDVSPSGCSAFTYHQYSYAPYARGPWYQLSEQMIDDASINGGTHPAFPFLTGHGGANQVALYGYLGLRLHPDDTIYIDPNLPPQIPHITYRTFYWHGWPISAWSNYTHTTIQRDSSLAPLASADLLFSNVSIKVQVGQSTASADEATIYYLPLSGALTVPNRMIGSVNTTPGNQVQCHPVYSPDAYEPGQFPISAVDGATSTKWQPSTSDLTSLTVTLSTTAEAGAEEVSGFYFDWSQAPPENLTVIFHDSPIGNPSTVFAAAGSNSTGYRVITSMSNIVQSKPYNAISAEELNVVSIPTANTTTITLDAPVQKARYATLLIAGNQANETAGATVAEWVILGQNSTSSSSAQAKRKMSARSKATLAQLS

SEQ ID NO: 4273 - protein, 301 aa, Aspergillus niger
  strain CBS 513.88 / FGSC A1513
MRASSLLPALLAAIPAVSASGTLGLSIGDKNGDSSCKSTSDYEADFDALKSVTTLVRTYSASDCNTAQNIVPAAKAKGFKVVLGVWADYDQSFDQDFNALKQIVPGNEDVVSAITVGSEVLYRGSLSAQALLSKIQQVQNQFPSVTVGTVDSWNKFADGTADPIIQGGVTYLLANGFAYWQDVDINNAPSTYSSDMTQAEDHIKQVAGANAGNIRFGNGETGWPTDGGSDYGAAKAGTQNAAQYYKSAVCPMLQKGTDVFYFEAFDEVWKPNSTGDNGQSMDEKHWGLFTADRKLKFDVTC

SEQ ID NO: 4274 - protein, 860 aa, Aspergillus niger
MRFTLIEAVALTAVSLASADELAYSPPYYPSPWANGQGDWAEAYQRAVDIVSQMTLAEKVNLTTGTGWELELCVGQTGGVPRLGIPGMCAQDSPLGVRDSDYNSAFPAGVNVAATWDKNLAYLRGQAMGQEFSDKGADIQLGPAAGPLGRSPDGGRNWEGFSPDPALSGVLFAETIKGIQDAGVVATAKHYIAYEQEHFRQAPEAQGYGFNITESGSANLDDKTMHELYLWPFADAIRAGAGAVMCSYNQINNSYGCQSSYTLNKLLKAELGFQGFVMSDWAAHHAGVSGALAGLDMSMPGDVDYDSGTSYWGTNLTISVLNGTVPQWRVDDMAVRIMAAYYKVGRDRLWTPPNFSSWTRDEYGFKYYYVSEGPYEKVNQFVNVQRNHSELIRRIGADSTVLLKNDGALPLTGKERLVALIGEDAGSNPYGANGCSDRGCDNGTLAMGWGSGTANFPYLVTPEQAISNEVLKNKNGVFTATDNWAIDQIEALAKTASVSLVFVNADSGEGYIDVDGNLGDRRNLTLWRNGDNVIKAAASNCNNTIVIIHSVGPVLVNEWYDNPNVTAILWGGLPGQESGNSLADVLYGRVNPGAKSPFTWGKTREAYQDYLYTEPNNGNGAPQEDFVEGVFIDYRGFNKRNETPIYEFGYGLSYTTFNYSNLQVEVLSAPAYEPASGETEAAPTFGEVGNASDYLYPDGLQRITKFIYPWLNSTDLEASSGDASYGQDASDYLPEGATDGSAQPILPAGGGAGGNPRLYDELIRVTVTIKNTGKVAGDEVPQLYVSLGGPNEPKIVLRQFERITLQPSEETQWSTTLTRRDLANWNVETQDWEITSYPKMVFVGSSSRKLPLRASLPTVH

SEQ ID NO: 4275 - protein, 553 aa, Aspergillus niger
  strain CBS 513.88 / FGSC A1513
MRGSRLVLLLPLAALSCAMPENEWSSTIRRQLPKASTGVKSIKTPNNVTIRYKEPGTEGICETTPGVKSYSGYVDLSPESHTFFWFFESRRDPENDPVTLWLNGGPGSDSLIGLFEELGPCHITPEYESIINQYSWNEVTNLLFLSQPLGVGFSYSETEAGSLNPFTGAVENASFAGVQGRYPVIDATIIDTTDIAARATWEVLQGFLSGLSQLDSEVKSKEFNLWTESYGGHYGPAFFNHFYEQNSKIASGEVNGVQLNFNSLGIINGIIDAAIQADYYADFAVNNTYGIKAVSNDTVYNYMKFANTMPNGCQDQVASCKLTNRTSLSDYAICTEAANMCRDNVEGPYYQFGGRGVYDIRHPYNDPTPPSYFVDYLKKDSVMDAIGVDINYTESSGEVYYAFQQTGDFVWPNFIEDLEEILQLPVRVSLIYGDADYICNWFGGQAISLAVNYPHAAQFRAAGYTPMTVDGVEYGETREYGNFSFTRVYQAGHEVPYYQPIAALQLFNRTLFGWDIAAGTTQIWPEYSTNGTSQATHTESFVPLSTASSTTVN

SEQ ID NO: 4276 - protein, 730 aa, Aspergillus niger
  strain CBS 513.88 / FGSC A1513
MRHFWLLPAVAGIAGAQCPYLSGEMSFTQEQDNAGDTIEVTEQPIDNTLYVNDTGSYMTTDFGTPISDQTSLKAGPRGPTLLEDFIFRQKLQRFDHERVPERVVHARGAGAYGTFKSYADWSNVTAADFLSANDKETPMFCRFSTVVGFRGSVDTARDVHGHACQFYTDEGNYDIVGINFAPFFIQDAIQFPDLVHAIKPMPNNEIPQAATAHTSAWDFFSQQSTALHSALWLMSGNGIPRSFRHMNGYGVHSFRFVAANGTSKVVRYRWKSQQGVASLVWDEAQAAAGKNSDYHRQDLYNAIANGHYPKYELQAQIMDEADMLRFGFDLLDPTKLVPEEVVPYTPLGMMELNANPTNYFAEVEQAGFQPGHVVPGIDFTDDPLLQGRLFSYLDTQLTRHGGPNFEQIPVNRPRKPVHNNNRDGFGQQQIPTNNWAYTPNSMSNGYPMQANQTQGHGFFTAPYRYASGHLVRQTSPTFNDHWSQPAMFWNSLIPAEQQMVVNAIVFQNSKVNSPHVRKNVVNQLNMVNNNLAVRVARGLGLDEPSPNPTYYTSNKTSNVGTFGKPLLSIEGLQVGFLASNSHPESIKQGQAMAAQFSAAGVDLNIVSEAYADGVNTTYALSDAIDFDALIIADGVQSLFASPALANQMNSTATSTLYPPARPFQILVDSFRYGKPVAAVGSGSVALKNAGIDSSRSGVYTGSSETTEKIAKEVLEGLYTFRFVDRFALDE

SEQ ID NO: 4277 - protein, 180 aa, Bacillus subtilis
  strain 168
MRHKIITFILAVVVIIIIGNMIGGGGGSEATSKTSSSSKAETEKTYNIGDTVKTEKTEVTVTKVEDRDTVGTQYVEKKASEGGTIVAVQYTIKNVSKKPISSFSIPTVKLVDADGTSYDSDIDASVNYATETKVDNSKILSDLNPNIKVTGVKAFEVDKEAYAKGTWKLKFSNDVIVKIK

SEQ ID NO: 4278 - protein, 931 aa, Aspergillus niger
MRHSIGLAAALLAPTLPVALGQHIRDLSSEKWTLSSRALNRTVPAQFPSQVHLDLLRAGVIGEYHGLNDFNLRWIAAANWTYTSQPIKGLLDNYGSTWLVFDGLDTFATISILWTANRIHGQSVSPVSGSMYLPALEACQRRILIRKVSFRGGVTAEVNTCYLHIEWPDDVQLTYEYPNRWFMRKEQSDFGWDWGPAFAPAGPWKPAYIVQLDKKESVYVLNTDLDIYRKNQINYLPPDQSQPWVVNASIDILGPLPAKPTMSIEVRDTHSGTILTSRTLNNVSVAGNAITGVTVLDGLNPKLWWPQSSVIRTSTMFLSLSKVEGTRPWPVWTNGRASAPFFLNQRNITEVQRAQGIAPGANWHFEVNGHEFYAKGSNLIPPDSFWTRVTEERISRLFDAVVVGNQNMLRVWSSGAYLHDYIYDLADEKGILLWSEFEFSDALYPSDDAFLENVAAEIVYNVRRVNHHPSLALWAGGNEIESLMLPRVKDAAPSSYSYYVGEYEKMYISLFLPLVYENTRSISYSPSSTTEGYLYIDLSAPVPMAERYDNTTSGSYYGDTDHYDYDTSVAFDYGSYPVGRFANEFGFHSMPSLQTWQQAVDTEDLYFNSSVVMLRNHHDPAGGLMTDNYANSATGMGEMTMGVISYYPIPSKSDHISNFSAWCHATQLFQADMYKSQIQFYRRGSGMPERQLGSLYWQLEDIWQAPSWAGIEYGGRWKVLHHVMRDIYQPVIVSPFWNYTTGSLDVYVTSDLWSPAAGTVDLTWLDLSGRPIAGNAGTPKSVPFTVGGLNSTRIYGTNVSSLGLPDTKDAVLILSLSAHGRLPNSDRTTNLTHENYATLSWPKDLKIVDPGLKLGYSSKKTTVTVEATSGVSLYTWLDYPEGVVGYFEENAFVLAPGEKKEIGFTVLDDTTNGAWVRNITVQSLWDQKVRG

SEQ ID NO: 4279 - protein, 494 aa, Aspergillus niger
  strain CBS 513.88 / FGSC A1513
MRIASLLPLTAAATTVAAKATSAGCKALNKSLSSAVFAPSSTVYQYEAQNFWSNTEIMSPGCVFRPQSAEELGQGVKALVDAEAQFAVRGGGHMGIRGSNNIDNGVLIVMSNLTTLELSDDHSVVSVGPAYRWAAVYDYLETYDLAVAGGRLGPVGVPGLLLAGGINFYGNQVGFGCDTVINYEVVLANGTIIEANATSHSDLFWALKGGSSNFGLVTRFDMETIESTQVWAGTYTVAAEYIDQFLEASATYAANISDPKTHIVPAVVPEGNTSVGSVILFYDSATESYPEIFKPFTDIPAESNTLGFKTLAEFAAETGAMVTPHINDIFVAGTIKATTYADLYRGISIINSTFAAQLPSLYAQIPTANISIIELDWQPIGASWLEASESRGGNALGLDKDQVYLCYAEVVEWIGSEYDEIVGEWVVETTYKINNATLEAGLYDSFNYMGDAAWFQDIFDGYGEENLAKLQTIAKKYDPNGVWQGLMPGGYKIF

SEQ ID NO: 4280 - protein, 1462 aa, Bacillus subtilis
  strain 168
MRIQKRRTHVENILRILLPPIMILSLILPTPPIHAEESAAPQVHLSILATTDIHANMMDYDYYSDKETADFGLARTAQLIQKHREQNPNTLLVDNGDLIQGNPLGEYAVKYQKDDIISGTKTHPIISVMNALKYDAGTLGNHEFNYGLDFLDGTIKGADFPIVNANVKTTSGENRYTPYVINEKTLIDENGNEQKVKVGYIGFVPPQIMTWDKKNLEGQVQVQDIVESANETIPKMKAEGADVIIALAHTGIEKQAQSSGAENAVFDLATKTKGIDAIISGHQHGLFPSAEYAGVAQFNVEKGTINGIPVVMPSSWGKYLGVIDLKLEKADGSWKVADSKGSIESIAGNVTSRNETVTNTIQQTHQNTLEYVRKPVGKTEADINSFFAQVKDDPSIQIVTDAQKWYAEKEMKDTEYKNLPILSAGAPFKAGGRNGANYYTNIPAGDLAIKNVGDLYLYDNTVQIVKLTGSEVKDWLEMSAGQFNQIDPAKGGDQALLNENFRSYNFDVIDGVTYQVDVTKPAKYNENGKVINADSSRIINLSYEGKPISPSQEFLVVTNNYRASGGGGFPHLTSDKIVHGSAVENRQVLMDYIIEQKTVNPKADNNWSIAPVSGTNLTFESSLLAKPFADKADDVAYVGKSANEGYGVYKLQFDDDSNPDPPKDGLWDLTVMHTNDTHAHLDDAARRMTKINEVRSETNHNILLDAGDVFSGDLYFTKWNGLADLKMMNMMGYDAMTFGNHEFDKGPTVLSDFLSGNSATVDPANRYHFEAPEFPIVSANVDVSNEPKLKSFVKKPQTFTAGEKKEAGIHPYILLDVDGEKVAVFGLTTEDTATTSSPGKSIVFNDAFETAQNTVKAIQEEEKVNKIIALTHIGHNRDLELAKKVKGIDLIIGGHTHTLVDKMEVVNNEEPTIVAQAKEYGQFLGRVDVAFDEKGVVQTDKSNLSVLPIDEHTEENPEAKQELDQFKNELEDVKNEKVGYTDVALDGQREHVRTKETNLGNFIADGMLAKAKEAAGARIAITNGGGIRAGIDKGDITLGEVLNVMPFGNTLYVADLTGKQIKEALEQGLSNVENGGGAFPQVAGIEYTFTLNNKPGHRVLEVKIESPNGDKVAINTDDTYRVATNNFVGAGGDGYSVFTEASHGEDLGYVDYEIFTEQLKKLGNKVSPKVEGRIKEVFLPTKQKDGSWTLDEDKFAIYAKNANTPFVYYGIHEGSQEKPINLKVKKDQVKLLKERESDPSLTMFNYWYSMKMPMANLKTADTAIGIKSTGELDVSLSDVYDFTVKQKGKEIKSFKEPVQLSLRMFDIEEAHNPAIYHVDRKKKAFTKTGHGSVDDDMVTGYTNHFSEYTILNSGSNNKPPAFPSDQPTGGDDGNHGGGSDKPGGKQPTDGNGGNDTPPGTQPTNGSGGNGSGGSGTDGPAGGLLPDTATSMYSILLAGFLISALGTAMYLHQRRKQNRANQA

SEQ ID NO: 4281 - protein, 416 aa, Aspergillus niger
  strain CBS 513.88 / FGSC A1513
MRISNLIVAASAASMVSALPSRQMKKRDSGFKWVGTSESGAEFGSALPGTLGTDYTWPETSKIQVLRNKGMNIFRIPFLMERLTPDGLTSSFASTYLSDLKSTVEFVTNSGAYAVLDPHNYGRFDGSIITSTSDFKTWWKNVATEFADNDKVIFDTNNEYHDMEQSLVLDLNQAAINGIRAAGATTQYIFVEGNAYTGAWDWTTYNDNLSGLTDSEDKIIYEMHQYLDSDSSGTSETCVSSTIGQERLEKATEWLKTNNKQGIVGEFAGGVNSVCEEAVEGMLAYMSENSDVWVGASWWSAGPWWGTYMYSLEPTDGTAYSTYLPILEKYFPSGDASASSSASVSVAAATSTASTTTAAFEQTTTPATQGPSATNSAGEVNQYYQCGGINWTGPTVCASPYTCKVQNDYYYQCVAE

SEQ ID NO: 4282 - protein, 635 aa, Paenibacillus polymyxa
  Bacillus polymyxa
MIRKCLVLFLSFALLLSVFPMLNVDAANRPLAKIPGNSNPLMDHKLGADPYSLVYDGRVYIFMSSDTYVYNKDGSIKENDFSALDRIQVISSTDMVNWTDHGTIPVAGANNKNSGRGIAKWASNSWAPAVAHKKINGRDKFFLYFANGGAGIGVLTADTPIGPWTDPLGKALVTHSTPGMAGVTWLFDPAVLVDDDGTGYLYSGGGIPNESDPASIANPKTARVIKLGADMTSVIGSATTIDAPYLFEDSGIHKYNGKYYYSYCINFAGTHPQQYPAGEIGYMVSDNPMGPFTYKGHFLKNPYTFFGVGGNNHHAVFNFKNEWYVVYHAQTVSKAQIGAGKGYRSPHINKLVHKEDGSISEVQGNMTGIAQLSNMNPYTRVEAETIAWQAGVTTEPTQASGGPISNLNVTNIHNGDWIAVGKADFGSAGAKTFKANVATNVGGNIEVRLDSETGPLVGSLKVPSTGGMQTWREVETTINNATGVHNIYLVFTGSGSGNLLNLDAWQFTPNTGGNTITKVEAENMKIGGTYAGKISAPFDGVALYANADYVSYSQYFANSTHNISVRGASSNAGTAKVDLVIGGVTVGSFNFTGKTPTVQTLSNITHATGDQEIKLALTSDDGTWDAYVDFIEFSL

SEQ ID NO: 4283 - protein, 228 aa, Bacillus subtilis
  strain 168
MRKKRVITCVMAASLTLGSLLPAGYASAKEDSKTTPSYEELALHYKMKSEKISSNGKLVEIEYVSGNETHKVQMNGNNHTVKVDGIEQKGLNFEYDENVAKRTNYENNNLKSNEFTTQAAKPKKGYHYVGTLSGHTKAAKNALSVTMSLVGIVPGLGWGSKAATILFSYWAKEQIPDAYYKYDLYEKGAMTDSWYQYATVQFFEDKAHKKKMGKPWTSTPAKVDLPNS

SEQ ID NO: 4284 - protein, 228 aa, Bacillus subtilis
  strain 168
MRKKRVITCVMAASLTLGSLLPAGYATAKEDSKTTPSYEELALHYKMKSEKISSNGKLVEIEYVSGNETHKVQMNGNDHTVKVDGIEQKGLNFEYDENAANRTNYENNNLKSNEFTTQAAKPKKGYHYVGTLSGHTKAAKNALSVTMSLVGIVPGLGWGSKAATILFSYWAKEQIPDAYYKYDLYEKGAMTDSWYQYATVQFFEDKAHKKKMGKPWTSTPAKVDLPNS

SEQ ID NO: 4285 - protein, 1433 aa, Bacillus subtilis
  strain 168
MRKKTKNRLISSVLSTVVISSLLFPGAAGASSKVTSPSVKKELQSAESIQNKISSSLKKSFKKKEKTTFLIKFKDLANPEKAAKAAVKKAKSKKLSAAKTEYQKRSAVVSSLKVTADESQQDVLKYLNTQKDKGNADQIHSYYVVNGIAVHASKEVMEKVVQFPEVEKVLPNEKRQLFKSSSPFNMKKAQKAIKATDGVEWNVDQIDAPKAWALGYDGTGTVVASIDTGVEWNHPALKEKYRGYNPENPNEPENEMNWYDAVAGEASPYDDLAHGTHVTGTMVGSEPDGTNQIGVAPGAKWIAVKAFSEDGGTDADILEAGEWVLAPKDAEGNPHPEMAPDVVNNSWGGGSGLDEWYRDMVNAWRAADIFPEFSAGNTDLFIPGGPGSIANPANYPESFATGATDINKKLADFSLQGPSPYDEIKPEISAPGVNIRSSVPGQTYEDGWDGTSMAGPHVSAVAALLKQANASLSVDEMEDILTSTAEPLTDSTFPDSPNNGYGHGLVNAFDAVSAVTDGLGKAEGQVSVEGDDQEPPVYQHEKVTEAYEGGSLPLTLTAEDNVSVTSVKLSYKLDQGEWTEITAKRISGDHLKGTYQAEIPDIKGTKLSYKWMIHDFGGHVVSSDVYDVTVKPSITAGYKQDFETAPGGWVASGTNNNWEWGVPSTGPNTAASGEKVYGTNLTGNYANSANMNLVMPPIKAPDSGSLFLQFKSWHNLEDDFDYGYVFVLPEGEKNWEQAGVYNGKTSSWTDEEIDLSAYKGQNIQVMFNLQSDESIAKEGWYIDDVVLSDKSAGKTVKKNKLGVEKPSGKQKKKPVNPKKAKPSANTAVKHQNKAIQPQVLPLKAQVSVVETGKSTYSDQSTGQYTLKHKAGDYTLMAEAYGYQSKTQKVSLKTDQTTQANFTLEEMKKGTLKGTVINKTTGEPVTGASVYVVEDAAVEPAMTNDKGEYMLEAYEGAYTIKVAAPGYYSDEFSVELKGDVTKETALKPFVGYPGEIAYDDGTAENANSYFAAGNGWAVKMTLADGKDKGMLTGGLFRFWDTEFPDPGGTEFKVEVYDATGKDGAPGKKIAGPFNAEALRNGEWTKVDLSSKGIMVDKDFYLVYIQSKPDPYSPGLAMDETGQNSGRNWQYIDGKWQPGDKADGNYMIRALVDYEAAVPEITSPTDKSYTNKDSVTVKGNASPGTTVHIYNGEKEAGETKAAADGTFHAGIILNKGENELTATASTDNGTTDASSPITVTLDQEKPELTLDNPKDGGKTNKETLTVKGAVSDDNLKDVKVNGKKATVADGSYSARILLENGRNEIKVIATDLAGNKTTKKTVIDVNFDKPVISGLIPGEDKNLKAGESVKIAFSSAEDLDATFTIRMPLTNARASVQNATELPLREISPGRYEGYWTATSSIKAKGAKVEVIVRDDYGNETRKTANGKLNMNTEN

SEQ ID NO: 4286 - protein, 293 aa, Bacillus subtilis
  strain 168
MRKNRILALFVLSLGLLSFMVTPVSAASKGNLLSPDRILTVAHRGASGYVPEHTILSYETAQKMKADFIELDLQMTKDGKLIVMHDEKLDRTTNGMGWVKDHTLADIKKLDAGSWFNEAYPEKAKPQYVGLKVPTLEEVLDRFGKHANYYIETKSPDTYPGMEEKLIASLQKHKLLGKHSKPGQVIIQSFSKESLVKVHQLQPNLPTVQLLEAKQMASMTDAALEEIKTYAVGAGPDYKALNQENVRMIRSHGLLLHPYTVNNEADMHRLLDWGVTGVFTNYPDLFHKVKKGY

SEQ ID NO: 4287 - protein, 534 aa, Aspergillus niger
  strain CBS 513.88 / FGSC A1513
MRLLHLAAGAALFASSALAVDPIEIKGSKFFYSSNDTQLSSSNMVPASSAVWRIRVESTTADPLSSKTTCERDIPYMKELRTNVIRTYDIDPTADHDDCMQLLADAGIYVIADLSNTSVAIDRSDPAWQLTLYNRYTSVIDAMAGYNNTLGFFAGNEIANSVGTTDAMPYVKAAIRDMKTYISNKGYRTIGVGYATADVSSIRADLADYINCQSESVGIDFFGYNIYSWCGDSTYAESGYKSRTEEFANYSVPVFFSEYGCNSVTPRTFTEVAALYGDTMSQVWSGGIVYEYFQDTNDYGLVSVIDSTSVSTMTDFSYYSKEIASATPSSTNKASYTPTNTALRSCPTENSSWKAKASPLPPTPDSDLCECMVDAATCTVKDSLDSDDIGDLMGEVCGMMSCSGITGNGTTGKYGAYSMCNSKQQLVFVLNEYYEKQKSAGNAASACSWGGSATTKSATSATGSCKTYMSEAGTAGTGLVTSEATATAGSSGSTASSTSVSSTSAGAKAVHVGYFQLAVYVAVAVVSGFAMIML

SEQ ID NO: 4288 - protein, 733 aa, Aspergillus niger
  strain CBS 513.88 / FGSC A1513
MRPLLQPYLLLHILPLLPLTHSTDPNTDILTHIDPLIGTTNGGNVFAGATLPYGMAKAVADVDGQNTAGFSSDNSNITGFSALHDSGTGGNPSLGNFPLFPQYCADDLLDNCPFPKSARAIYYQNDSVVARPGYFALTLTNGIHAEMTTTQHAALFRFQFPDTGQEKLSPMVLLDLTDLWESRQNASISVDEHTGQMKGNGTFLPSFGAGEYVSYVCADFAGASVRDTGVWVNDAGGVERKELFVTRGFNNFYLQAGGFVRFERPDNGTVSVRVGVSYISTEKACENARMEIPSPLEDFDAIRAAAEDAWREKLSPVAMKPGNASAALQTMFWTGTYRTMLDPQDLTGENPLWESDEPYFDSFYCIWDAFRAQHPLLTIIDPHTQSRIIRSLLDTYRHEGWLPDCRMSLCKGWTQGGSNADVVLADAFVKNLTGIDWDLAYEAMVNDAENEPLEWSYQGRGGLQSWKNLNYIPYHDFDYLGFGTNSRSISRTLEYAYNDFCVATVARGLNKTDDYLKYLTRSTNWKNLFKPDQRSFFPNGSDTGYVPHDLPTLITHYLSGPQAFTSRLTTFHSTALADYSNEPVFLTVYQYHYASRPALSSRLIHSLIPSQFNASRSGIPGNDDSGAMAAFTVFGLMGLFPNPGQSVYLISAPFVEEVSVKNALTGREAVVRVKNDAGVGVGGTVVRKAWLDGEVYARSWIGHEFFVKGGVLEVELGDEEEENRDGDVVCTGE

SEQ ID NO: 4289 - protein, 306 aa, Bacillus subtilis
  strain 168
MRQGLMAAVLFATFALTGCGTDSAGKSADQQLQVTATTSQIADAAENIGGKHVKVTSLMGPGVDPHLYKASQGDTKKLMSADVVLYSGLHLEGKMEDVLQKIGEQKQSAAVAEAIPKNKLIPAGEGKTFDPHVWFSIPLWIYAVDEIEAQFSKAMPQHADAFRKNAKEYKEDLQYLDKWSRKEIAHIPEKSRVLVTAHDAFAYFGNEYGFKVKGLQGLSTDSDYGLRDVQELVDLLTEKQIKAVFVESSVSEKSINAVVEGAKEKGHTVTIGGQLYSDAMGEKGTKEGTYEGMFRHNINTITKALK

SEQ ID NO: 4290 - protein, 236 aa, Bacillus subtilis
  strain 168
MRRILSILVFAIMLAGCSSNASTEKQHAGGEKTVKAEPQSTSSQKDSTDDYQPNSQVTDDRTLHKVGQTFSDDKGKAVLKDIKQVNKTYKIGDVELTVKEMKLIHLRPDYSMIDYFHELTHDEEFDFVKVFVDIKNTSTKKVNVAPIALMKTNTGETFDWNKDIYLEELNGELEGGAEKSGNLGFIVNASSGHAHDKAADAEKKTKEIKWIEITTSDVFDHNHKKISDAQKIKIKF

SEQ ID NO: 4291 - protein, 526 aa, Aspergillus niger
  strain CBS 513.88 / FGSC A1513
MRSFSVVAAASLALSWASLAQAARPRLVPKPISRPASSKSAATTGEAYFEQLLDHHNPEKGTFSQRYWWSTEYWGGPGSPVVLFNPGEVSADGYEGYLTNDTLTGVYAQEIQGAVILIEHRYWGDSSPYEVLNAETLQYLTLDQSILDMTYFAETVKLQFDNSSRSNAQNAPWVMVGGSYSGALTAWTESIAPGTFWAYHATSAPVEAIYDFWQYFYPIQQGMAQNCSKDVSLVAEYVDKIGKNGTAKEQQELKELFGLGAVEHYDDFAAVLPNGPYLWQDNDFVTGYSSFFQFCDAVEGVEAGAAVTPGPEGVGLEKALANYANWFNSTILPNYCASYGYWTDEWSVACFDSYNASSPIFTDTSVGNPVDRQWEWFLCNEPFFWWQDGAPEGTSTIVPRLVSASYWQRQCPLYFPEVNGYTYGSAKGKNSATVNSWTGGWDMTRNTTRLIWTNGQYDPWRDSGVSSTFRPGGPLVSTANEPVQIIPGGFHCSDLYMEDYYANEGVRKVVDNEVKQIKEWVEEYYA

SEQ ID NO: 4292 - protein, 278 aa, Bacillus amyloliquefaciens
  strain ATCC 23350 / DSM 7 / BCRC 11601 / NBRC 15535 / NRRL B-14393
MRSGLKKKAGFWKKTAVSSLIFTMFFTLMMSGTVLAAGLNKDQKRRAEQLTSIFENGKTEIQYGYVEELDDGRGYTCGRAGFTTATGDALEVVEVYTKAVPNNKLKKYLPELRRLAKDESDDTSNLKGFASAWRSLGNDKAFRAAQDEVNDRLYYQPAMKRSDQAGLKTALAKAVMYDTVIQHGDGDDPDSFYALIKRTNKKMGGSPKDGTDEKKWLNKFLDVRYDDLMNPSDEDTQDEWRESVARVDVFRDIVKAKNYNLDGPIHVRSSEYGNFTIQ

SEQ ID NO: 4293 - protein, 381 aa, Bacillus subtilis
  strain 168
MRSKKLWISLLFALTLIFTMAFSNMSAQAAGKSSTEKKYIVGFKQTMSAMSSAKKKDVISEKGGKVQKQFKYVNAAAATLDEKAVKELKKDPSVAYVEEDHIAHEYAQSVPYGISQIKAPALHSQGYTGSNVKVAVIDSGIDSSHPDLNVRGGASFVPSETNPYQDGSSHGTHVAGTIAALNNSIGVLGVAPSASLYAVKVLDSTGSGQYSWIINGIEWAISNNMDVINMSLGGPTGSTALKTVVDKAVSSGIVVAAAAGNEGSSGSTSTVGYPAKYPSTIAVGAVNSSNQRASFSSAGSELDVMAPGVSIQSTLPGGTYGAYNGTSMATPHVAGAAALILSKHPTWTNAQVRDRLESTATYLGNSFYYGKGLINVQAAAQ

SEQ ID NO: 4294 - protein, 536 aa, Aspergillus niger
  strain CBS 513.88 / FGSC A1513
MRSLSLAITLAAGLGARGAAGRDEPSILRRACPDYTSYASTGHAPYSGGPLNLPYQRPAAECRTFVSNAVEQVIDDVTSRMVDKDMAQLFRNAFPNTLDTTIRWHVNSTSTTSSSRKMRRDSSQWQGAQTFVVTGDINAEWLRDSTNQLTGYQTLAKKDPALYNLILGAIHTQAEFVIQSPYCNAFQPPPPSGIQATNNGQQDTVHPAYEPSVVYECKYELDSLANFLALGNEFYENTGSTEFLTSRWYLALDTLLNTTDAQSQPTFNSNRQYVQNQYTFQRQTTLGTETLNLAGIGNPLNGGTGLIRSAFRPSDDATILGFFIPANAMMSVQLKKTADLIRAAGGDSALASNLQTRGENLEQAVRQHGIFNHEKYGEVYAFEVDGYGSRIFMDDANIPSLLALPYLGFVDKSDQVYQNTRKMILDPNGNPYYLTGSDFHGIGGPHIGLENAWPMSLLVQALTTDNVTEITESLNIVRNSSLLGLVHESIDVNNIKSYTRPWFAWANSVFSQTILKVAAEQPEVLFGDGAEPYVIS

SEQ ID NO: 4295 - protein, 595 aa, Aspergillus niger
  strain CBS 513.88 / FGSC A1513
MRSSGLYTALLCSLAASTNAIVHEKLAAVPSGWHHVEDAGSDHQISLSIALARKNLDQLESKLKDLSTPGESQYGQWLDQEDVDTLFPVASDKAVINWLRSANITHISRQGSLVNFATTVDKVNKLLNATFAYYQSGSSQRLRTTEYSIPDDLVDSIDLISPTTFFGKEKTTAGLNQRAQKIDTHVAKRSNSSSCADVITLSCLKEMYNFGNYTPSASSGSKLGFGSFLNESASYSDLAKFEKLFNLPSQSFSVELVNGGVNDQNQSTASLTEADLDVELLVGVAHPLPVTEFITSGEPPFIPDPDEPSAADNENEPYLQYYEYLLSKPNSALPQVISNSYGDDEQTVPEYYAKRVCNLIGLVGLRGISVLESSGDEGIGSGCRTTDGTNRTQFNPIFPATCPYVTAVGGTMSYAPEIAWEASSGGFSNYFERAWFQKEAVQNYLAHHITNETKQYYSQFANFSGRGFPDVAAHSFEPSYEVIFYGARYGSGGTSAACPLFSALVGMLNDARLRAGKSTLGFLNPLLYSKGYRALTDVTGGQSIGCNGIDPQNDETVAGAGIIPWAHWNATVGWDPVTGLGLPDFEKLRQLVLSL

SEQ ID NO: 4296 - protein, 315 aa, Bacillus subtilis
  strain 168
MRTYSNKLIAIMSVLLLACLIVSGCSSSQNNNGSGKSESKDSRVIHDEEGKTTVSGTPKRVVVLELSFLDAVHNLGITPVGIADDNKKDMIKKLVGSSIDYTSVGTRSEPNLEVISSLKPDLIIADAERHKNIYKQLKKIAPTIELKSREATYDETIDSFTTIAKALNKEDEGKEKLAEHKKVINDLKAELPKDENRNIVLGVARADSFQLHTSSSYDGEIFKMLGFTHAVKSDNAYQEVSLEQLSKIDPDILFISANEGKTIVDEWKTNPLWKNLKAVKNGQVYDADRDTWTRFRGIKSSETSAKDVLKKVYNK

SEQ ID NO: 4297 - protein, 524 aa, Aspergillus niger
  strain CBS 513.88 / FGSC A1513
MRVTTAIASLLLVGSATSLQNPHRRAVPPPLSHRSVASRSVPVERRTTDFEYLTNKTARFLVNGTSIPEVDFDVGESYAGLLPNTPTGNSSLFFWFFPSQNPEASDEITIWLNGGPGCSSLDGLLQENGPFLWQPGTYKPVPNPYSWTNLTNVVYIDQPAGTGFSPGPSTVNNEEDVAAQFNSWFKHFVDTFDLHGRKVYITGESYAGMYVPYIADAMLNEEDTTYFNLKGIQINDPSINSDSVMMYSPAVRHLNHYNNIFQLNSTFLSYINAKADKCGYNAFLDKAITYPPPSPFPTAPEITEDCQVWDEVVMAAYDINPCFNYYHLIDFCPYLWDVLGFPSLASGPNNYFNRSDVQKILHVPPTDYSVCSETVIFANGDGSDPSSWGPLPSVIERTNNTIIGHGWLDYLLFLNGSLATIQNMTWNGKQGFQRPPVEPLFVPYHYGLAELYWGDEPDPYNLDAGAGYLGTAHTERGLTFSSVYLSGHEIPQYVPGALTASWSSCSVGLVVFRRRGTIPLDFSG

SEQ ID NO: 4298 - protein, 443 aa, Aspergillus niger
  strain CBS 513.88 / FGSC A1513
MRWLLTSSALLVPAAALVRPDGVGRTPALGWNSWNAYSCDIDADKIVTAANEVVNLGLKDLGYEYINIDDCWSVKSGRNTTTKRIIPDPDKFPNGISGVADQVHALGLKLGIYSSAGLTTCAGYPASLGYEEIDAQSFAEWGIDYLKYDNCGVPTNLTDQYTYCVPDSTDGSNYPNGTCVNLTDAAPQGYDWATSTTAKRYQRMRDALLSVNRTILYSLCDWGQADVNAWGNATGNSWRMSGDITATWSRIAEIANENSFLMNYANFWGYPDPDMLEVGNGNLTLPENRAHFALWAMMKAPLIIGTPLDSIDTSHLTILSNKPLLTFHQDAVIGRPAYPYKWGYNPDWTFDPEHPAEYWSGPTSSGEVFVLMLNSEGEVKTRSAVWEEVPELKDRGTKKNSKEKKGFKVTDAWTGKDLGCVKDKYEVKLQAHDVAVLVVGGQC

SEQ ID NO: 4299 - protein, 709 aa, Aspergillus niger
  strain CBS 513.88 / FGSC A1513
MRWRALGTLSLVLDFTICGFARLVTVPTIPFDDNNGTYALSQLTKIVVDTRHASTVDTQGQTLIPPTLREFAATFQEDLRSSLGINLPLVSSSTSSDNTIFLTLSNNTGFRDVAGRFTAEAYALHIDNKGITISGASPLGVWWGTRSLIQAAVVSKHDLPQGSAIDAPGWETRGVMLDAGRHYYPPDFLIEMCSYLSFFKQNVFHLHLSDNLYNNVDLYSTQESMDLYAAFRPWSDDPAVSGLNKRANESYTRSQFDHIQRQCARRGVTIIPEIEAPGHALAIVQWRPELGLTDLSMLNISHPDTIPTMKSIWKTFLPWFHSKTVHLGADEYSSSYVADYTDFVNDMHTYIAEQSDKDTRIWGTFTPSEGANVSKAVTIQHWEYFEDNPYFDYIKNNYSVLNSDDAFYIVGKWSGSYPQYLNKTRVFHGDPANNGPYAPNIFSTSNATDNPPRNNPYVLGHIAALWNDYGPNATTYLEAYYSWRDVLPALADKQWGGDILEEEYDDVFDALHAVIPGQNLDRHVPSKTDLILHYNFANATGTTVPDLSGNNYHATFNHTCPIDTSNSTIRFTGTCTLTTPIQSKGRDYTLSFSVYPSTTHPSPLFSGRDSTLLNGNGSISNITLVSGGNPYTLNYSLPVGKWSDVSLIGKGNKTFLSVDGGEKMEFLARLGVNGESLVWAPIAIEAPVQRIGEGFVGMMGDVKLWGSAK

SEQ ID NO: 4300 - protein, 263 aa, Aspergillus niger
  strain CBS 513.88 / FGSC A1513
MSFLPSVGMLALGAMQLSSGVLATIDTCSSDSPLSCQTDNEASCCFNSPGGSLLQTQFWDYDPSDGPTDSWTIHGLWPDNCDGTYQEYCDDSREYSNITSILEAQNRTELLSYMKEYWPDYEGADEDESFWEHEWNKHGTCINTIEPSCYTDYYPQEEVGDFFQQVVDLFKTLDSYTALSDAGITPSEDATYKLSDIEDALAAIHDGYPPYVGCEDGALSQLYYYFNVKGSAIGGTYVASERLEDSNCKDSGIKYPPKSSSSK

SEQ ID NO: 4301 - protein, 640 aa, Aspergillus niger
MSFRSLLALSGLVCTGLANVISKRATLDSWLSNEATVARTAILNNIGADGAWVSGADSGIVVASPSTDNPDYFYTWTRDSGLVLKTLVDLFRNGDTSLLSTIENYISAQAIVQGISNPSGDLSSGAGLGEPKFNVDETAYTGSWGRPQRDGPALRATAMIGFGQWLLDNGYTSTATDIVWPLVRNDLSYVAQYWNQTGYDLWEEVNGSSFFTIAVQHRALVEGSAFATAVGSSCSWCDSQAPEILCYLQSFWTGSFILANFDSSRSGKDANTLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDAATGTYSSSSSTYSSIVDAVKTFADGFVSIVETHAASNGSMSEQYDKSDGEQLSARDLTWSYAALLTANNRRNSVVPASWGETSASSVPGTCAATSAIGTYSSVTVTSWPSIVATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 4302 - protein, 305 aa, Aspergillus niger
  strain CBS 513.88 / FGSC A1513
MSIFFSIRFWPAAISAAILWLPQVLGRSNGTAPNYTVEELWKLETTFWDNFLYPANVEQMEAINSTLFTQDVQGRVDITRVFNGSELNTEYIFGLFSDPDHVSLVGVPVDYSITQFIAQGNIASATTVVTFNATSFGNLLVPVTIDTWIMWDADGRIMQYDATFRWFGFLLDTLVEALAESINGTTSQATASLTQLLATTICATHDQYCTGSNQQYDNNTACLDFLTSAIPLGKDYELGRNTLLCREVHEHMVQYDPALHCPHIGPTGGDYCVDDQTYAQKVLQKYFNQSWIVGVPSTGDIWLGD

SEQ ID NO: 4303 - protein, 536 aa, Aspergillus niger
  strain CBS 513.88 / FGSC A1513
MSSFQVYRAALLLSILATANAQQVGTYTTETHPSLTWQTCTSDGSCTTNDGEVVIDANWRWVHSTSSATNCYTGNEWDTSICTDDVTCAANCALDGATYEATYGVTTSGSELRLNFVTQGSSKNIGSRLYLMSDDSNYELFKLLGQEFTFDVDVSNLPCGLNGALYFVAMDADGGTSEYSGNKAGAKYGTGYCDSQCPRDLKFINGEANCDGWEPSSNNVNTGVGDHGSCCAEMDVWEANSISNAFTAHPCDSVSQTMCDGDSCGGTYSASGDRYSGTCDPDGCDYNPYRLGNTDFYGPGLTVDTNSPFTVVTQFITDDGTSSGTLTEIKRLYVQNGEVIANGASTYSSVNGSSITSAFCESEKTLFGDENVFDKHGGLEGMGEAMAKGMVLVLSLWDDYAADMLWLDSDYPVNSSASTPGVARGTCSTDSGVPATVEAESPNAYVTYSNIKFGPIGSTYSSGSSSGSGSSSSSSSTTTKATSTTLKTTSTTSSGSSSTSAAQAYGQCGGQGWTGPTTCVSGYTCTYENAYYSQCL

SEQ ID NO: 4304 - protein, 402 aa, Aspergillus niger
  strain CBS 513.88 / FGSC A1513
MSVAKIAGVVLGSAALVAGHGYVSGAVIDGEYYGGYIVSSYPYESDPPETIAWSTTATDLGFVDGSEYSDPDIICHKSAKPGAISADVKAGGTVELQWTDWPSSHHGPVLTYLANCNGDCSDVTKTDLEFFKIDESGLISDTEVPGTWATDNLISNNNSWTVTIPSTLEAGNYVLRHEIIALHSAENKDGAQNYPQCLNLKVTGSGSSTYSGTKGEALYKDTDPGILVNIYETLSSYDIPGPAMYNATSSSSSSGSSSGASSTSSAAAAAATTSSASTSSASTPTTSAAAATSSAVSATTTAAAAVVTDVETTVQTAVATAYQTSTDVVQVTVTGSAPQQTHIQVASSSAAASTPSSSSVAVSSDNLTSYFSSLSADQFLSVLKETFSWLVTEKKHARDLNA

SEQ ID NO: 4305 - protein, 488 aa, Aspergillus niger
  strain CBS 513.88 / FGSC A1513
MSWMLWYTIAGLASLGHASLEKRATDASAYCSDSSGTYKLSSITAPVQGSGSPGSASTWKLSIDDTSSGHKQAITGFGAAVTDATVTSFNTLSSSTLQQLLNELMTSDGANFSLMRHTIGASDLSGDPVYTYDDNGNEADPSLSGFGLGDRGTAMAEMLATMKSLQSDLKVLGSPWSAPGWMKLNGVIDGNATDNNLNDGYLTSGGTGSTGYSSAFAQYFVKYIQAYEALGATVDAITIQNEPLNSQSGYPTMYVYDYESAQLIQKYIGPALADAGLSTEIWAFDHNTGNPQTVLDEASQYVDTVAWHCYAKDVDWTVLSQFYSANPGVKQYMTECWTPASGSWHQAADFTMGPLQNYASGVMAWTLGTNTDDGPHLTSGGCDACQGLVTINDDDSYTLNTAYYMMAQFSKFMPPGATVLNGTGSYTYSGGDGVQSVASLNPDGTRTVIIENIFSNDIYLTLSTESGEEWSGNIPSESVTTWVLPALS

SEQ ID NO: 4306 - protein, 524 aa, Aspergillus niger
  strain CBS 513.88 / FGSC A1513
MTIFLFLAIFVATALAATPAEWRSQSIYFLLTDRFARTDNSTTASCDLSARQYCGGSWQGIINQLDYIQGMGFTAIWITPVTAQIPQDTGYGQAYHGYWQQDAYALNSHYGTADDLKALASALHSRGMYLMVDVVANHMGHNGTGSSVDYSVYRPFNSQKYFHNLCWISDYNNQTNVEDCWLGDNTVALPDLDTTSTEVKNMWYDWVESLVSNYSVDGLRVDTVKNVQKNFWPGYNNASGVYCIGEVFDGDASYTCPYQEDLDGVLNYPMYYPLLRAFESTNGSISDLYNMINTVKSTCRDSTLLGTFVENHDNPRFANYTSDMSLAKNAATFTILADGIPIIYAGQEQHYSGGNDPYNREATWLSGYKTTSELYTHIAASNKIRTHAIKQDTGYLTYKNYPIYQDTSTLAMRKGYNGTQTITVLSNLGASGSSYTLSLPGTGYTAGQKITEIYTCTNLTVNSNGSVPVPMKSGLPRILYPADKLVNGSSFCSSAITVFKDAGGGVLFFSYTVIFAQVLIAIMT

SEQ ID NO: 4307 - protein, 118 aa, Bacillus subtilis
  strain 168
MTKLKMLSMLTVMIASLFIFSSQALAVQYFTVSTSSGAPVNMRSGPGTNYPIMLSIPSGSRVPYYCYAYGTTVTGKYGTSNIWDQIQWKDSRGVVNIGYVSDTYVYTGSDGPVGYKCN

SEQ ID NO: 4308 - protein, 406 aa, Aspergillus niger
  strain CBS 513.88 / FGSC A1513
MTLYRNLLLLASLGLSYAAPSKVQRAPDSSLHARAVCTPTAGGDSSTDDVPAITEALSSCGNGGTIVFPEGSTYYLNSVLDLGNCSNCDIQVEGLLKFASDTDYWSGRTAMISVSDVDGLKLRSLTGSGVIDGNGQDAWDLFASDSSYSRPTLLYITGGSNLEISGLRQKNPPNVFNSVKGGATNVVFSNLKMDANSKSDNPPKNTDGFDIGESTYVTITEVTVVNDDDCVALKPSSNYVTVDTISCTGSHGISVGSLGKSSDDSVKNIYVTGATMINSTKAAGIKTYPSGGDHGTSTVSNVTFTDFTVDNSDYAFQIQSCYGEDDDYCEENPGNAKLTDIVVSSFSGTTSDKYDPVVANIDCGSDGTCGISISGFDVKAPSGKSEVLCANTPSDLGVTCTSGASG

SEQ ID NO: 4309 - protein, 1017 aa, Aspergillus niger
  strain CBS 513.88 / FGSC A1513
MTRITKLCVLLLSSIGLLAAAQNQTETGWPLHDDGLTTDVQWDHYSFKVHGERIFVFSGEFHYWRIPVPGLWRDILEKIKAAGFTTFAFYSSWAWHAPNNHTVDFSTGARDITPIFELAKELGMYIIVRPGPYINAEASAGGFPLWLTTGDYGTLRNNDSRYTEAWKPYFEKMTEITSRYQITNGHNTFCYQIENEYGDQWLSDPSERVPNETAIAYMELLESSARENGILVPFTANDPNMNAMAWSRDWSNAGGNVDVVGLDSYPSCWTCDVSQCTSTNGEYVAYQVVEYYDYFLDFSPTMPSFMPEFQGGSYNPWAGPEGGCGDDTGVDFVNLFYRWNIAQRVTAMSLYMLYGGTNWGAIAAPVTATSYDYSSPISEDRSISSKYYETKLLSLFTRSARDLTMTDLIGNGTQYTNNTAVKAYELRNPTTNAGFYVTLHEDSTVGTNEAFSLRVNTSAGNLIVPRLGGSIRLNGHQSKIIVTDFTFGSETLLYSTAEVLTYAVIDKKPTLVLWVPTDESGEFAVKGAKSGSVVSKCQSCPAINFHQQGGNLIVGFTQSQGMSVVQIDNDIRVVLLDRTAAYKFWAPALTEDPLVPEDEAVVLIQGPYLVRSASLEKSTLAIKGDSINETAVEIFAPENVKTITWNGKQLKTSKSSYGSLKATIAAPASIQLPAFTSWKVNDSLPERLPTYDASGPAWVDANHMTTANPSKPATLPVLYADEYGFHNGVRLWRGYFNGTASGVFLNVQGGSAFGFSAYLNGHFLGSYLGNASIEQANQTFLFPNNITHPTTQNTLLVIHDDTGHDETTGALNPRGILEARLLPSDTTNNSTSPEFTHWRIAGTAGGESNLDPVRGAWNEDGLYAERVGWHLPGFDDSTWSSVSSSSSLSFTGATVKFFRTTIPLDIPRGLDVSISFVLGTPDNAPNAYRAQLFVNGYQYGRFNPYIGNQVVFPVPVGVLDYTGENTIGVAVWAQTEDGAGITVDWKVNYVADSSLDVSGLETGELRPGWSAERLKFA

SEQ ID NO: 4310 - protein, 391 aa, Bacillus subtilis
  strain 168
MTSPTRRRTAKRRRRKLNKRGKLLFGLLAVMVCITIWNALHRNSEENEPSQETAAVSNTDQKKEVKKKTAKKSEEQIKTVDRNQKISNYLKEIGFSGTAMIVRNGEIVTNKGFGYADRKHYIQNNPLTSFYVGSSQKALIATAILQLEEKGKLQTSDPVSTYLPHFPNGQTITLKNLLTHTSGINGHIEGNGAITPDDLIKDIELQGIKRQPGVWDYKDSNYSVLAYIIAEVSGEPYEQYIKNHIFKPAGMTHAGFYKTYEKEPYPAVGYKMEGSKTVTPYIPDLSQLYGAGDIYMSAIDMYKFDQALIDGKLYSQKSYEKMFTPGSSSTYGMGFYVAPGSYSNHGVMPGFNILNSFSKSGQTIVILFSNIQNNAKLGQVNNKIYQLLNQE

SEQ ID NO: 4311 - protein, 507 aa, Bacillus subtilis
  strain 168
MTSTFMGLETARRALSAQQAALSTTANNVANANTDGYTRQRVSLEATDYFPAVSKNAEKTAGQMGTGVQGKSVERIRDIFLDYQYRLQNNSAGYYDTKAKALSQMEGVLNETDDSGLNSVLNSFWNSLQELSNNTNEESARSVVARKGQAVAETFNYISESLTNVQSNLKAELNTTVLDVNSLLSQLNSLNKQIAQVEPVGLLPNGLYDQRDLLIDKLSSMVDIKVSYNKSGGNALASAEGTVSIEILDKNKQSLGTVLDGKNYEVSELAANYDNETGLVSSISIGDTAVQAESFSSKGSLLGFIESYGYITADGQEKGVYPEMLSDLDNMALEFAKAFNEVHRNGVTKSGEQGGDFFDFTGGETEPAKGAAGKIKVADSIIDSKGANIAFSLTGAANDNANATKLANVLTGKITINGKETSVLDYYAGLIGELGIEAQEANRLASNTETQLNDADINRQQMSAVSLDEEMTNMIQFQHAYNAAARMVTLQDELLDKVINGMGVGGR

SEQ ID NO: 4312 - protein, 580 aa, Aspergillus niger
  strain CBS 513.88 / FGSC A1513
MVAFSRISAGFALAAPALASVVLETVKSVPSDWKLVEAADTSSTISLSVALARQNLDQLEEKLLAVSTPGKDTYGQFLDLDDINEQFPLADDAAVVAWLKKAGVTQIHKEGGLLNFATTVGTANQLLNTTFSVYKSGSTQKLRTTQYSVPDELTGSIDLISPTVFFGKSNAARSAAVRASQTTKETSRKKSSNVCEYITPDCLKEQYSIDYTPEASSGSRVGFGSFLNESALYSDLDLFTQYFDIPQQSFTVETINGGINNQENDPDGEADLDVQNIVGISHPLPVTEYITGGSPPFIPDVETTTDENEPYLQYYEYLLAKTNDELPLVISNSYGDDEDTVPIAYATRVCNLIGLMGTRGISILESSGDSGVGGACMSNDGTDKTEFTPMFPGTCPYITAVGGTQDVPEVAWVDSSGGFSNYFSQPSYQSDQVETYLDKYISASTKKYYEQYTNFSGRAFPDVSAFAGSPYYETYIDGQLGLVAGTSGASPVFAGIVALLNDARLRANKTSLGFLNPWLYSSGYKSLNDITSGEAVGCQGDVEGAGVIPWASWNATTGWDPATGLGTPNFAKLKEAVLAL

SEQ ID NO: 4313 - protein, 406 aa, Aspergillus niger
  strain CBS 513.88 / FGSC A1513
MVALKALSLGLLASQAWAVPTTSQTALSSPAASSAAVAAAAAKLEQLSSYALDQTLANLPSSSEDSEACTRETLRIRRDWRTFSKPEKEDYINSVLCLQELPSRTPSHLAPGAKTRYDDFLATHINQTLEIHYTGTFLAWHRYFIYEFEQALRDECHYTGDYPYWDWGYDAIHTMEASEVFDGSETSMSGNGYFIPNQGNISLYLGNYPAIVLPPGTGGGCVTSGPFKNYTVNMGPAALSLPGGSTASVSNPLNYNPRCLKRSLTTALLQRYNTYPQITSLILDNDDVWDFEMTMQGVPGSGSIGVHGSGHYSMGGDPGRDVYVSPGDPAFWHHHGMIDRVWWIWQNLDLKSREYAISGTGTFLNEPASKNTTLQTVVDLGYAKGVPRRMKELMSTTKGLFCYAYV

SEQ ID NO: 4314 - protein, 285 aa, Bacillus subtilis
  strain 168
MVKKWLIQFAVMLSVLSTFTYSASAVGVTAITGNNSFDTAMPIGYWKYKNIDTTILEAGQDEAYFTFTANKGEKVYMRSTYQSAYTGMKIEIYDKNRIPVSQGTEVINPNTFSSFIYANADAQNTTDTFYVKVSRGTYTGNMYFTLSIEDRIKSGSGTFQFSGVAENKGNTSLSPSGSDSSVIKVDLTNQSGIPRDAIVTRVQTTATQTPSQGNTRHLIMTSENNEWSRALVNSSTSGSYDISLSDQLSVAKVWSFKYNTLATARSTMSNVKAKIDYEYDVTKQF

SEQ ID NO: 4315 - protein, 985 aa, Aspergillus niger
MVKLTHLLARAWLVPLAYGASQSLLSTTAPSQPQFTIPASADVGAQLIANIDDPQAADAQSVCPGYKASKVQHNSRGFTASLQLAGRPCNVYGTDVESLTLSVEYQDSDRLNIQILPTHVDSTNASWYFLSENLVPRPKASLNASVSQSDLFVSWSNEPSFNFKVIRKATGDALFSTEGTVLVYENQFIEFVTALPEEYNLYGLGEHITQFRLQRNANLTIYPSDDGTPIDQNLYGQHPFYLDTRYYKGDRQNGSYIPVKSSEADASQDYISLSHGVFLRNSHGLEILLRSQKLIWRTLGGGIDLTFYSGPAPADVTRQYLTSTVGLPAMQQYNTLGFHQCRWGYNNWSDLADVVANFEKFEIPLEYIWTDIDYMHGYRNFDNDQHRFSYSEGDEFLSKLHESGRYYVPIVDAALYIPNPENASDAYATYDRGAADDVFLKNPDGSLYIGAVWPGYTVFPDWHHPKAVDFWANELVIWSKKVAFDGVWYDMSEVSSFCVGSCGTGNLTLNPAHPSFLLPGEPGDIIYDYPEAFNITNATEAASASAGASSQAAATATTTSTSVSYLRTTPTPGVRNVEHPPYVINHDQEGHDLSVHAVSPNATHVDGVEEYDVHGLYGHQGLNATYQGLLEVWSHKRRPFIIGRSTFAGSGKWAGHWGGDNYSKWWSMYYSISQALSFSLFGIPMFGADTCGFNGNSDEELCNRWMQLSAFFPFYRNHNELSTIPQEPYRWASVIEATKSAMRIRYAILPYFYTLFDLAHTTGSTVMRALSWEFPNDPTLAAVETQFMVGPAIMVVPVLEPLVNTVKGVFPGVGHGEVWYDWYTQAAVDAKPGVNTTISAPLGHIPVYVRGGNILPMQEPALTTREARQTPWALLAALGSNGTASGQLYLDDGESIYPNATLHVDFTASRSSLRSSAQGRWKERNPLANVTVLGVNKEPSAVTLNGQAVFPGSVTYNSTSQVLFVGGLQNLTKGGAWAENWVLEW

SEQ ID NO: 4316 - protein, 331 aa, Aspergillus niger
  strain CBS 513.88 / FGSC A1513
MVKSILASVFFAATALAASRMTAPSGAIVVAKSGGDYDTISAAVDALSTTSTETQTIFIEEGSYDEQVYIPALSGKLIVYGQTEDTTTYTSNLVNITHAIALADVDNDDETATLRNYAEGSAIYNLNIANTCGQACHQALAVSAYATEQGYYACQFTGYQDTLLAETGYQVYAGTYIEGAVDFIFGQHARAWFHECDIRVLEGPSSASITANGRSSESDDSYYVIHKSTVAAADGNDVSSGTYYLGRPWSQYARVCFQKTSMTDVINHLGWTEWSTSTPNTENVTFVEYGNTGAGSKGPRANFSSELTEPISISTLLGSDWEDWVDTSYIN

SEQ ID NO: 4317 - protein, 417 aa, Bacillus subtilis
  strain 168
MVLLKKGFAILAASFLAIGLAACSSSKNPASSDGKKVLTVSVEETYKEYIESIKTKFEKENDVTVKIVEKQMFEQLEALPLDGPAGNAPDVMLAAYDRIGGLGQQGHLLDIKPSNTKSFGDKEMQQVTVDGKVYGMPLVIETLILYYNKDLLKTAPKTFKDLEKLTEDPRFAFASEKGKSTGFLAKWTDFYMSYGLLAGYGGYVFGKNGTDSGDIGLNNKGAVEAVKYAEKWFETYWPKGMQDNSSADDFIQQMFLEGKAAAIIGGPWSAANYKEAKLNYGAAPIPTLPNGEEYAPFAGGKGWVASKYTKEPELAEKWLEYAANDANAYAFYEDTNEVPANTAARKKADEQKNELTSAVIKQYETATPTPNIPEMAEVWTGAESLIFDAASGKKSTQTSANDAVNVIKENIKEKYVK

SEQ ID NO: 4318 - protein, 327 aa, Aspergillus niger [sequence omitted]

SEQ ID NO: 4319 - protein, 424 aa, Aspergillus niger
  strain CBS 513.88 / FGSC A1513
MVRYTSSILLASLAATSVWATSSPPSCSTSSQCPEEYPCCSQYGQCGTGAYCLGGCDPISSYSLDSCVGEPVCESKTYKWDSLDSAALNTKYLGNASEYDWVYSGYPKLDDGNLLLTMPKNTVGTLFANNHYVWYGKISGKVKSSRGAGVVTAFILLSDVKDEIDFEWIGADLVNVQTNYYWQGVLNYNNGDKDAVNGSDTFDDWHEYEIDWKEDAITWSVDGEVKRTLTKESTWNETAKRYQYPQSPSRMQLSLWPAGQASNAPGTIEWAGGEIDWDSQDIKDKGYYYATFGEITVQCYDAPNGTVSNGNKSYMFTNKDGLQQSVQITNNDTVLASFGATGLDMDLGASDSSSSNGTNGTVPENQGGSGNVPGSSTSSGSSSTSSGFSQGSSTDTSGAPSQNERVMRGSFFAALVAVVVLVAF

SEQ ID NO: 4320 - protein, 394 aa, Aspergillus niger
  strain CBS 513.88 / FGSC A1513
MVVFSKTAALVLGLSSAVSAAPAPTRKGFTINQIARPANKTRTINLPGMYARSLAKFGGTVPQSVKEAASKGSAVTTPQNNDEEYLTPVTVGKSTLHLDFDTGSADLWVFSDELPSSEQTGHDLYTPSSSATKLSGYTWDISYGDGSSASGDVYRDTVTVGGVTTNKQAVEAASKISSEFVQNTANDGLLGLAFSSINTVQPKAQTTFFDTVKSQLDSPLFAVQLKHDAPGVYDFGYIDDSKYTGSITYTDADSSQGYWGFSTDGYSIGDGSSSSSGFSAIADTGTTLILLDDEIVSAYYEQVSGAQESEEAGGYVFSCSTNPPDFTVVIGDYKAVVPGKYINYAPISTGSSTCFGGIQSNSGLGLSILGDVFLKSQYVVFNSEGPKLGFAAQA

SEQ ID NO: 4321 - protein, 656 aa, Aspergillus niger
  strain CBS 513.88 / FGSC A1513
MWSSWLLSALLATEALAVPYEEYILAPSSRDLAPASVRQVNGSVTNAAALTGAGGQATFNGVSSVTYDFGINVAGIVSVDVASASSDSAFIGVTFTESSMWISSEACDATQDAGLDTPLWFAVGQGAGLYTVEKKYNRGAFRYMTVVSNTTATVSLNSVKINYTASPTQDLRAYTGYFHSNDELLNRIWYAGAYTLQLCSIDPTTGDALVGLGVITSSETISLPQTDKWWTNYTITNGSSTLTDGAKRDRLVWPGDMSIALESVAVSTEDLYSVRTALESLYALQKPDGRLPYAGKPFFDTVSFTYHLHSLVGAASYYQYTGDRAWLTRYWGQYKKGVQWALSSVDSTGLANITASADWLRFGMGAHNIEANAILYYVLNDAISLAQTLNDNAPIRNWTTTAARIKTVANELLWDDKNGLYTDNETTTLHPQDGNSWAVKANLTLSANQSAIVSESLAARWGPYGAPAPEAGATVSPFIGGFELQAHYQAGQPDRALDLLRLQWGFMLDDPRMTNSTFIEGYSTDGSLAYAPYTNTPRVSHAHGWATGPTSALTIYTAGLRVTGPAGATWLYKPQPGNLTQVEAGFSTRLGSFASSFSRSGGRYQELSFSTPNGTTGSVELGDVSGQLVSDRGVKVQLVGGKASGLQGGKWKLSNN

SEQ ID NO: 4322 - protein, 396 aa, Aspergillus niger
  strain CBS 513.88 / FGSC A1513
MYFSKTAVALAAVLPLATAQTYTDCDPLNKTCPADTALSSTTFTTDFTTGSFSGWIATANNVTFTDEGANFVISEKGEAPTIETDFYFFFGKAEVVMKAASGTGICSSVVLESDDLDEIDWEALGGDTTQIETNYFGKGDTSSYDRATWATVSTPQETFHTYTVEWTESATTWSIDGTVVRTLAYSDAQSGTRYPQTPMRLKLGIWAAGDSSEPEGTIEWAGGETDYSDGPFTMTVKSVSITNYNPGSSYTYSDKTGDYTSIVVNNGTSSSSVSSTTGSTSSSTSSSTSSSSSSTSSSDSTSSSGSTSSSGSSTSSGSSTSASSAAAAGSSSALIGSGSSTSSGSSAAGSGAASASGSASASSSASASASPVYTGAATHVGASTSVLFAGLLAALL

SEQ ID NO: 4323 - protein, 736 aa, Aspergillus niger
  strain CBS 513.88 / FGSC A1513
MYFSSFLALGALVQAAAATYFAPNSTGLRIQHGFETILIQPFGYDGFRVRAWPFRPPSGNEISFIYDPPIEGYEDTAHGMSYDTATTGTEPRTLRNGNIILRTTGWGGTTAGYRLSFYRVNDDGSETLLTNEYAPLKSLNPRYYYWPGPGAEFSAEFSFSATPDEQIYGTGTQQDHMINKKGSVIDMVNFNSYIPTPVFMSNKGYAFIWNMPAEGRMEFGTLRTRFTAASTTLVDYVIVAAQPGDYDTLQQRISALTGRAPAPPDFSLGYIQSKLRYENQTEVELLAQNFHDRNIPVSMIVIDYQSWAHQGDWALDPRLWPNVAQMSARVKNLTGAEMMASLWPSVADDSVNYAALQANGLLSATRDGPGTTDSWNGSYIRNYDSTNPSARKFLWSMLKKNYYDKGIKNFWIDQADGGALGEAYENNGQSTYIESIPFTLPNVNYAAGTQLSVGKLYPWAHQQAIEEGFRNATDTKEGSACDHVSLSRSGYIGSQRFCSMIWSGDTTSVWDTLAVQVASGLSAAATGWGWWTVDAGGFEVDSTVWWSGNIDTPEYRELYVRWLAWTTFLPFMRTHGSRTCYFQDAYTCANEPWSYGASNTPIIVSYIHLRYQLGAYLKSIFNQFHLTGRSIMRPLYMDFEKTDPKISQLVSSNSNYTTQQYMFGPRLLVSPVTLPNVTEWPVYLPQTGQNNTKPWTYWWTNETYAGGQVVKVPAPLQHIPVFHLGSREELLSGNVF

SEQ ID NO: 4324 - protein, 418 aa, Aspergillus niger
  strain CBS 513.88 / FGSC A1513
MYIPSVLLLAASLFHGATALPTPGSTPIPPSQDPWYSAPEGFEEADPGAILRVRPAPGNLTVVVGNASAAYNILYRTTDSQYKPSWAVTTLLVPPVAASAAVNQSVLLSHQIAYDSFDVNASPSYAMYTSPPSDIILALQRGWFVNVPDYEGPNASFTAGVQSGHATLDSVRSVLASGFGLNEDAQYALWGYSGGALASEWAAELQMQYAPELNIAGLAVGGLTPNVTSVMDTVTSTISAGLIPAAALGLSSQHPETYEFILSQLKTTGPYNRTGFLAAKDLTLSEAEVFYAFQNIFDYFVNGSATFQAEVVQKALNQDGYMGYHGFPQMPVLAYKAIHDEISPIQDTDRVIKRYCGLGLNILYERNTIGGHSAEQVNGNARAWNWLTSIFDGTYAQQYKTEGCTIRNVTLNTTSSVY

SEQ ID NO: 4325 - protein, 691 aa, Aspergillus niger
  strain CBS 513.88 / FGSC A1513
MYQFFISLLVTVLASSARATSVFSPARPPAIPLAVKSPYLSTWLSAGSDGGNGGYLAGEWPIFWSGQITGWAGMIRVDGSAYTWMGIPGPATVNQTSYEYTSTKSIFTMNVANKVEMNITFLSPITPNDYKRQSLVFSYVDVQVESLDGQPHDVQLYADISAEWVSGDRTTTATWDYGTTDNGVAYHKVSRQTQLAFSEVSDQGEWGDWYWATDNSENLTYQSGIADNVRAAFAANGTLGDSQDSDYRAISTDWPIFAFAHDLGSVESAVSVLYSIGLAQTDAIQYEGSSSGSTILPSLWTSYFSTGPEALDFFHNDYATSSSLSSDLDSQIAQDSIAAAGQDYLTITSLTVRQAFGACQLCGTPDNTYLFMKEISSDGNVNTVDVIFPAHPIFLYTNPELLNLLLKPLFEIQESGNYPNAYAMHDVGSHYPNATGHPKGDDEAMPLEECGNMVIMALAYAQKASDTDYLSQHYTLLNQWTAYLVEDAIYPANQISTDDFAGSLANQTNLALKGIIGIEAMAVISNETDHSANGANYTAIAHNYIDRWQILGIAHNANPPHATLAYGSNNSHGLLYNLYADRELGLNLVPQSVYDMQSTFYPTVQLEYGVPLDTRHEYTKADWEMFTAAIASTSTRDMFMQLLSKWINDTPTNYAMTDLYDAVGGGYPTNVFIDRPVVGGAFALLLLNQGN

SEQ ID NO: 4326 - protein, 566 aa, Aspergillus niger
  strain CBS 513.88 / FGSC A1513
MYYSLWVAALVAALPVSRAQFVAPPTDLIPTKGYLDIPVRYKQVPTGICETDPSVKSFSGYVDVAEHEHIFFWFFEARNQDPTEAPLTVWINGGPGSSSMIGLFQEHGPCGIDANGSVYNNPYSWNNASNMLYIDQPVQTGFSYSIPVPGYVDSSTDNVIALPSPACPDYAADMFCGTYSYPNVSLTANSTDNAAPNFYRALQGFMGAFPQYSRETFHFTTESYGGHYGPVFNEYIEEQNAHLQPGAKKIQLGSVMIGNGWYDPIIQYQAYYNFTVYPGNTYDYLPFNKSISSLMYNNLYGPGNCLDQLYDCAARGIDEICSTADDFCANEVENVYDIYSGRDEYDFRELTPDPFPYEFYVDYLNKASVQAAIGAYINYTESNNAVGLAFSSTGDDGRLMNTIQDVGKLLKQGVTVVMYAGDADYNCNWLGGEAVSLQVKAANFSSAGYTNIVTSDGVTHGQVRQAGQFAFVRVYESGHEVPFYQPLLALEMFERVIGGKDVATGKIPISSSLQTVGTPKSYYREGNSTIQWEVLDSLATYNTTTNAPNPVSRRLKRMGPALRFQM

SEQ ID NO: 4327 - protein, 457 aa, Acremonium cellulolyticus Y-94
MLRYLSIVAATAILTGVEAQQSVWGQCGGQGWSGATSCAAGSTCSTLNPYYAQCIPGTATSTTLVKTTSSTSVGTTSPPTTTTTKASTTATTTAAASGNPFSGYQLYANPYYSSEVHTLAIPSLTGSLAAAATKAAEIPSFVWLDTAAKVPTMGTYLANIEAANKAGASPPIAGIFVVYDLPDRDCAAAASNGEYTVANNGVANYKAYIDSIVAQLKAYPDVHTILIIEPDSLANMVTNLSTAKCAEAQSAYYECVNYALINLNLANVAMYIDAGHAGWLGWSANLSPAAQLFATVYKNASAPASLRGLATNVANYNAWSISSPPSYTSGDSNYDEKLYINALSPLLTSNGWPNAHFIMDTSRNGVQPTKQQAWGDWCNVIGTGFGVQPTTNTGDPLEDAFVWVKPGGESDGTSNSSATRYDFHCGYSDALQPAPEAGTWFQAYFVQLLTNANPALV

SEQ ID NO: 4328 - protein, 20 aa, Acremonium sp.
WLSGVDKIRGVNLGSAFIIE

SEQ ID NO: 4329 - protein, 523 aa, Acremonium thermophilum
MYTKFAALAALVATVRGQAACSLTAETHPSLQWQKCTAPGSCTTVSGQVTIDANWRWLHQTNSSTNCYTGNEWDTSICSSDTDCATKCCLDGADYTGTYGVTASGNSLNLKFVTQGPYSKNIGSRMYLMESESKYQGFTLLGQEFTFDVDVSNLGCGLNGALYFVSMDLDGGVSKYTTNKAGAKYGTGYCDSQCPRDLKFINGQANIDGWQPSSNDANAGLGNHGSCCSEMDIWEANKVSAAYTPHPCTTIGQTMCTGDDCGGTYSSDRYAGICDPDGCDFNSYRMGDTSFYGPGKTVDTGSKFTVVTQFLTGSDGNLSEIKRFYVQNGKVIPNSESKIAGVSGNSITTDFCTAQKTAFGDTNVFEERGGLAQMGKALAEPMVLVLSVWDDHAVNMLWLDSTYPTDSTKPGAARGDCPITSGVPADVESQAPNSNVIYSNIRFGPINSTYTGTPSGGNPPGGGTTTTTTTTTSKPSGPTTTTNPSGPQQTHWGQCGGQGWTGPTVCQSPYTCKYSNDWYSQCL

SEQ ID NO: 4330 - protein, 423 aa, Aphanocladium album
MLSFVKKSIALVAALQAVTALATPISSEAGVEKRGSGFANAVYFTNWGIYGRNFQPADLPASEITHVLYSFMNVRADGTIFSGDTYADYEKHYAGDSWNDVGTNAYGCVKQLYLLKKQNRNMKVMLSIGGWTWSTNFPAAASSAATRKTFAQSAVGFMKDWGFDGIDIDWEYPADATQAQNMVLLLQAVRSELDSYAAQYAKGHHFLLSIAAPAGPDNYNKLKFAELGKVLDYINLMAYDYAGSWSNYTGHDANIYANPQNPNATPYNTDDAVQAYINGGVPANKIVLGMPIYGRSFQQTEGIGKPYNGIGSGSWENGIWDYKALPKAGATVKCDDTAKGCYSYDPSTKELISFDTPAMISTKVSWLKGKGLGGTMFWEASASKKGSDSLISTSHQGLGSQDSTQNYLDYPNSKYDNIKKGMN

SEQ ID NO: 4331 - protein, 805 aa, Aspergillus aculeatus
MAVAALALLALLPQALGQHNSSYVDYNVEANPDLFPQCLDTISLSFPDCQSGPLSKNLVCDSTASPYDRAAALVSLFTLEELIANTGNTSPGVPRLGLPPYQVWSEALHGLGRANFTDNGALHAGRPSFPSPILSAAAFNRTLINQIASIISTQGRAFNNAGRFGLDVYSPNINTFRHPVWGRGQETPGEDAYTLTAAYAYEYITGIQGGVNPEHLKLAATAKHFAGYDIENWDNHSRLGNDVNITQQDLAEYYTPQFLVAARDAHVHSFMCSYNAVNGVPSCSNTFFLQTLLRDTFSFVDHGYVSGDCGAVYGVFNPHGYAANEPSAAADAILAGTDIDCGTSYQYHFNESITTGAVARDDIERGFIRLYANLVELGYFDGNSSSSNPYRSLGWPDVQKTDAWNISYEAAVEGIVLLKNDGTLPLASPSEGKNKSIALIGPWANATTQLQGNYYGDAPYLISPVDAFTAAGYTVHYAPGTEISTNSTANFSAALSAARAADTIVFLGGIDNTIEAEAQDRSSIAWPGNQLELISQLAAQKSDDQPLVVYQMGGGQVDSSSLKFNAKVNALLWGGYPGQSGGLALRDILTGARAPAGRLTTTQYPAAYAESFSALDMNLRPNETTQNPGQTYMWYTGEPVYAFGHGLFYTTFNASSAQAAKTKYTFNITDLTSAAHPDTTTVGQRTLFNFTASITNSGQRDSDYTALVYANTSTAGPSPYPNKWLVGFDRLAAVAKEGGTAELNVPVAVDRLARVDEAGNTVLFPGRYEVALNNEREVVVEVELVGEQVVLLKWPEEVQGVAGDE

SEQ ID NO: 4332 - protein, 540 aa, Aspergillus aculeatus
MVDSFSIYKTALLLSMLATSNAQQVGTYTAETHPSLTWQTCSGSGSCTTTSGSVVIDANWRWVHEVGGYTNCYSGNTWDSSICSTDTTCASECALEGATYESTYGVTTSGSSLRLNFVTTASQKNIGSRLYLLADDSTYETFKLFNREFTFDVDVSNLPCGLNGALYFVSMDADGGVSRFPTNKAGAKYGTGYCDSQCPRDLKFIDGQANIEGWEPSSTDVNAGTGNHGSCCPEMDIWEANSISSAFTAHPCDSVQQTMCTGDTCGGTYSDTTDRYSGTCDPDGCDFNPYRFGNTNFYGPGKTVDNSKPFTVVTQFITHDGTDTGTLTEIRRLYVQNGVVIGNGPSTYTAASGNSITESFCKAEKTLFGDTNVFETHGGLSAMGDALGDGMVLVLSLWDDHAADMLWLDSDYPTTSCASSPGVARGTCPTTTGNATYVEANYPNSYVTYSNIKFGTLNSTYSGTSSGGSSSSSTTLTTKASTSTTSSKTTTTTSKTSTTSSSSTNVAQLYGQCGGQGWTGPTTCASGTCTKQNDYYSQCL

SEQ ID NO: 4333 - protein, 327 aa, Aspergillus aculeatus
MVQIKAAALAVLFASNVLANPIEPRQASVSIDAKFKAHGKKYLGTIGDQYTLNKNAKTPAIIKADFGQLTPENSMKWDATEPNRGQFSFSGSDYLVNFAQSNGKLIRGHTLVWHSQLPSWVQSIYDKGTLIQVMQNHIATVMQRYKGKVYAWDVVNEIFNEDGSLRQSHFYNVIGEDYVRIAFETARAVDPNAKLYINDYNLDSASYPKLTGLVNHVKKWVAAGVPIDGIGSQTHLSAGAGAAVSGALNALAGAGTKEVAITELDIAGASSTDYVNVVKACLNQPKCVGITVWGVADPDSWRSSSSPLLFDSNYNPKAAYTAIANAL

SEQ ID NO: 4334 - protein, 937 aa, Aspergillus aculeatus
MRALPTTATTLLGVLFFPSASRSQYVRDLGTEQWTLSSATLNRTVPAQFPSQVHMDLLREGIIDEPYNDLNDFNLRWIADANWTYTSGKIEGLGEDYESTWLVFDGLDTFASISFCGQFVGATDNQFRQYMFDVSSILKACPEEPTLGIQFGSAPNIVDAIAQDPSSPTWPEGVQITYEYPNRWFMRKEQSDFGWDWGPAFAPAGPWKPGYVVQLKQAAPVYVRNTDLDIYRLGQINYLPPDQTQPWVVNASLDYLGSLPENPSMAIEVKDLQSGEILASRPLTNITVTEGSVTGVTVLEGVDPKLWWPQGLGDQNLYNVTISVTDGGNQSVAEVTKRTGFRTIFLNQRNITDAQLAQGIAPGANWHFEVNGHEFYAKGSNLIPPDCFWTRVTEDTMTRLFDAVVAGNQNMLRVWSSGAYLHDYIYDLADEKGILLCSEFQFSDALYPTDDAFLENVAAEVVYNVRRVNHHPSLALWAGGNEIESLMLLLVEAADPESYPFYVGEYEKMYISLFLPLVYENTRSISYSPSSTTEGYLDIDLSAPVPMAERYSNTTEGEYYGDTDHYNYDASIAFDYGTYPVGRFANEFGFHSMPSLQTWQQALTDPADLTFNSSVVMLRNHHYPAGGLMTDNYHNTVARHGRNDPGRAGLLPDAQHSVRPRGQLQRLVPRDPALPGGPLQVTNPVLPAGQRAARTPARVPVLAARGHLAGALVGGDRVRRPLEGPHYVARDIYKPVIVSPFWNYTTGALDIYVTSDLWTAAAGSVTLTWRDLSGKPIASNGGLPTKPLPFHVGALNSTRLYRMNMKQQPLPRHEDAILALELTATGSLPNTDEEVTFTHEQWFTPAFPKDLDLVNLRVRVEYDAPLGKFAVEATAGVALYTWLEHPEGVVGYFEENSFVVVPGQKKVVGFVVQADETDGEWVHDVTVRSLWDLNEGE

SEQ ID NO: 4335 - protein, 412 aa, Aspergillus aculeatus
MKFTVLALLLSQVWAAPQAKRSSNFLWLGSNESGAEFGQANIPGVLGTDYIWPDASKIQVLVNAGMNIFRVPFMMERLIPTSLTGAADATYLADLKATIESITSLGAYAVVDPHNFGRYYGNIITSTSDFAAFWTTYVSFCPSSHYWTHKDHADNEYHDEDQTLVFNLNQAAITAIRAAGATSQYIFVEGNSYSGAWTWTTYNTNLVNLTDPSDKIIYEMHQYLDSDGSGTSSDCVSTTIGAERVAAATTWLRQNGKRAVLGEFAGGANSQCLTAVTGMLDALSAASDVWLGALWWSAGPWWGTYIFNMEPTTGTAYTYYLSLLQSYVPGGSSGTTTTTAVATTTTSKASTTSTTTTKTTTTSTKTTTTATSTSTAVAPLYGQCGGIGWTGATTCASGSTCTKQNDYYSQCL

SEQ ID NO: 4336 - protein, 856 aa, Aspergillus aculeatus
MARSSLALLCAALLGKLADAAASQAYTWKNVVTGGGGGFTPGIVFNPSAKGVAYARTDIGGAYRLNSDDTWTPLMDWVGNDTWHDWGIDALATDPVDTDRVYVAVGMYTNEWDPNVGSILRSTDQGDTWTETKLPFKVGGNMPGRGMGERLAVDPNKNSILYFGARSGHGLWKSTDYGATWSNVTSFTWTGTYFQDSSSTYTSDPVGIAWVTFDSTSGSSGSATPRIFVGVADAGKSVFKSEDAGATWAWVSGEPQYGFLPHKGVLSPEEKTLYISYANGAGPYDGTNGTVHKYNITSGVWTDISPTSLASTYYGYGGLSVDLQVPGTLMVAALNCWWPDELIFRSTDSGATWSPIWEWNGYPSINYYYSYDISNAPWIQDTTSTDQFPVRVGWMVEALAIDPFDSNHWLYGTGLTVYGGHDLTNWDSKHNVTVKSLAVGIEEMAVLGLITPPGGPALLSAVGDDGGFYHSDLDAAPNQAYHTPTYGTTNGIDYAGNKPSNIVRSGASDDYPTLALSSNFGSTWYADYAASTSTGTGAVALSADGDTVLLMSSTSGALVSKSQGTLTAVSSLPSGAVIASDKSDNTVFYGGSAGAIYVSKNTATSFTKTVSLGSSTTVNAIRAHPSIAGDVWASTDKGLWHSTDYGSTFTQIGSGVTAGWSFGFGKASSTGSYVVIYGFFTIDGAAGLFKSEDAGTNWQVISDASHGFGSGSANVVNGDLQTYGRVFRGHERPGHLLRQSQREPAGRHGDGDGDTTTSKTSTTVSTTLKTTTSSASTTSSSTTVKTTTSSSSTTSKASSTTTTKTTTTSTTTSSGTTATASAYAQCGGNGWTGATVCFTGYTCTYSNAFYSQCVPS

SEQ ID NO: 4337 - protein, 378 aa, Aspergillus aculeatus
MHLNTTLLVSLALGAASVLASPAPPAITAPPTAEEIAKRATTCTFSGSNGASSASKSKTSCSTIVLSNVAVPSGTTLDLTKLNDGTHVIFSGETTFGYKEWSGPLISVSGSDLTITGASGHSINGDGSRWWDGEGGNGGKTKPKFFAAHSLTNSVISGLKIVNSPVQVFSVAGSDYLTLKDITIDNSDGDDNGGHNTDAFDIGTSTYVTISGATVYNQDDCVAVNSGENIYFSGGYCSGGHGLSIGSVGGRSDNTVKNVTFVDSTIINSDNGVRIKTNIDTTGSVSDVTYKDITLTSIAKYGIVVQQNYGDTSSTPTTGVPITDFVLDNVHGSVVSSGTNILISCGSGSCSDWTWTDVSVSGGKTSSKCTNVPSGASC

SEQ ID NO: 4338 - protein, 238 aa, Aspergillus aculeatus
MKLSLLSLATLASAASLQRRSDFCGQWDTATAGDFTLYNDLWGESAGTGSQCTGVDSYSGDTIAWHTSWSWSGGSSSVKSYVNAALTFTPTQLNCISSIPTTWKWSYSGSSIVADVAYDTFLAETASGSSKYEIMVWLAALGGAGPISSTGSTIATPTIAGVNWKLYSGPNGDTTVYSFVADSTTESFSGDLNDFFTYLVDNEGVSDELYLTTLEAGTEPFTGSNAKLTVSEYSISIE

SEQ ID NO: 4339 - protein, 237 aa, Aspergillus aculeatus
MKAFHLLAALAGAAVAQQAQLCDQYATYTGGVYTINNNLWGKDAGSGSQCTTVNSASSAGTSWSTKWNWSGGENSVKSYANSGLTFNKKLVSQISQIPTTARWSYDNTGIRADVAYDLFTAADINHVTWSGDYELMIWLARYGGVQPIGSQIATATVDGQTWELWYGANGSQKTYSFVAPTPITSFQGDVNDFFKYLTQNHGFPASSQYLITLQFGTEPFTGGPATLSVSNWSASVQ

SEQ ID NO: 4340 - protein, 440 aa, Aspergillus aculeatus
MRALFLLALGSIPALVSGQLSGSVGPLTSASTKGATKTCNILSYGAVADNSTDVGPAITSAWAACKSGGLVYIPSGNYALNTWVTLTGGSATAIQLDGIIYRTGTASGNMIAVTDTTDFELFSSTSKGAVQGFGYVYHAEGTYGARILRLTDVTHFSVHDVILVDAPAFHFTMDTCSDGEVYNMAIRGGNEGGLDGIDVWGSNIWVHDVEVTNKDECVTVKSPANNILVESIYCNWSGGCAMGSLGADTDVTDIVYRNVYTWSSNQMYMIKSNGGSGTVSNVLLENFIGHGNAYSLDIDGYWSSMTAVAGDGVQLNNITVKNWKGTEANGATRPPIRVVCSDTAPCTDLTLEDIAIWTESGSSELYLCRSAYGSGYCLKDSSSHTSYTTTSTVTAAPSGYSATTMAADLATAFGLTASIPIPTIPTSFYPGLTPYSALAG

SEQ ID NO: 4341 - protein, 377 aa, Aspergillus aculeatus
MKLSHMLLSLASLGVATALPRTPNHNAATTAFPSTSGLHFTIDGKTGYFAGTNSYWIGFLTNNDDVDLVMSQLAASDLKILRVWGFNDVNTKPTDGTVWYQLHANGTSTINTGADGLQRLDYVVTSAEKYGVKLIINFVNEWTDYGGMQAYVTAYGAAAQTDFYTNTAIQAAYKNYIKAVVSRYSSSAAIFAWELANEPRCQGCDTSVLYNWISDTSKYIKSLDSKHLVTIGDEGFGLDVDSDGSYPYTYGEGLNFTKNLGISTIDFGTLHLYPDSWGTSYDWGNGWITAHAAACKAVGKPCLLEEYGVTSNHCAVESPWQQTAGNATGISGDLYWQYGTTFSWGQSPNDGNTFYYNTSDFTCLVTDHVAAINAQSK

SEQ ID NO: 4342 - protein, 527 aa, Aspergillus aculeatus
MLKASLLSFVAFTAQVAHAAFGITTSSSAYVIDTNAPNQLKFTVSRSSCDITSIIHYGTELQYSSQGSHIGSGLGSATVTATQSGDYIKVTCVTDTLTQYMVVHNGDPIIHMATYITAEPSIGELRFIARLNSDLLPNEEPFGDVSTTADGTAIEGSDVFLVGSETRSKFYSSERFIDDQRHCIAGDAHRVCMILNQYESSSGGPFHRDINSNNGGSYNALYWYMNSGHVQTESYRMGLHGPYSMYFSRSGTPSTSIDTSFFADLDIKGYVAASGRGKVAGTASGADSSMDWVVHWYNDAAQYWTYTSSSGSFTSPAMKPGTYTMVYYQGEYAVATSSVTVSAGSTTTKNISGSVKTGTTIFKIGEWDGQPTGFRNAANQLRMHPSDSRMSSWGPLTYTVGSSALTDFPMAVFKSVNNPVTIKFTATSAQTGAATLRIGTTLSFAGGRPQATINSYTGSAPAAPTNLDSRGVTRGAYRGLGEVYDVSIPSGTIVAGTNTITINVISGSSGDTYLSPNFIFDCVELFQ

SEQ ID NO: 4343 - protein, 331 aa, Aspergillus aculeatus
MVKSVLASALFAVSALAASRTTAPSGAIVVAKSGGDYTTIGDAIDALSTSTTDTQTIFIEEGTYDEQVYLPAMTGKVIIYGQTENTDSYADNLVTITHAISYEDAGESDDLTATFRNKAVGSQVYNLNIANTCGQACHQALALSAWADQQGYYGCNFTGYQDTLLAQTGNQLYINSYIEGAVDFIFGQHARAWFQNVDIRVVEGPTSASITANGRSSETDTSYYVINKSTVAAKEGDDVAEGTYYLGRPWSEYARVVFQQTSMTNVINSLGWTEWSTSTPNTEYVTFGEYANTGAGSEGTRASFAEKLDAKLTITDILGSDYTSWVDTSYF

SEQ ID NO: 4344 - protein, 384 aa, Aspergillus aculeatus
MVRQLALACGLLAAVAVQAAPAEPAHPMVTEAPDASLLHKRATTCTFSGSEGASKVSKSKTACSTIYLSALAVPSGTTLDLKDLNDGTHVIFEGETTFGYEEWEGPLVSVSGTDITVEGASGAVLNGDGSRWWDGEGGNGGKTKPKFFAAHDLTSSTIKSIYIENSPVQVFSIDGATDLTLTDITIDNTDGDTDDLAANTDGFDIGESTDITITGAKVYNQDDCVAINSGENIYFSASVCSGGHGLSIGSVGGRDDNTVKNVTFYDVNVLKSQQAIRIKAIYGDTGSISDITYHEIAFSDATDYGIVIEQNYDDTSKTPTTGVPITDFTLENVIGTCADDDCTEVYIACGSGACSDWSWSSVSVTGGKVSSKCLNVPSGISCDL

SEQ ID NO: 4345 - protein, 369 aa, Aspergillus aculeatus
MHSFQLLGLAAVGSVVSAAPTASRVSDLVKKSSSTCTFTSASEASETSSSCSNVVLSNIEVPAGETLDLSDAADGATITFEGTTSFGYEEWDGPLIRFGGKQLTITQSDGAVIDGDGSRWWDSEGTNGGKTKPKFMYVHDVEDSTIKGLQIKNTPVQAISVQATNVYLTDITIDNSDGDDNGGHNTDGFDISESTGVYISGATVKNQDDCIAINSGENILFTGGTCSGGHGLSIGSVGGRDDNTVKNVTISDSTVTDSANGVRIKTIYGDTGDVSEITYSNIQLSGITDYGIVIEQDYENGSPTGTPSTGVPITDVTVDGVTGSIEDDAVQVYILCGDGSCSDWTWSGVDITGGETSSDCENVPSGASC

SEQ ID NO: 4346 - protein, 321 aa, Aspergillus aculeatus
MYSLLTALSVPLLAGLAHGYANPGSCSGSCNVHDPALIVRESDGKYFRFSTGNEISYASASSINGPWTAIGSVVPAGSKIDLSGNTDLWAPDLSYVDGTYYCLYSVSTFGSQDSAIGVASSTTMELNTWTDHGSVGVASSSSKNYNAIDGNLLVDGSSYYLQFGSFWGDIYQVKMASPLKTAGSASYNIAYNATGTHSEEGSYLFKYGSYYYLFFSSGTCCGYDTSRPAQGEEYKIMVCRSTSATGGFVDKNGNACTESGGTIVLASHGTVYGPGGQGVYDDPTYGPVLYYHYVDTTIGYADDQKLFGWNTIDFSSGWPVV

SEQ ID NO: 4347 - protein, 394 aa, Aspergillus awamori
MVVFSKTAALVLGLSSAVSAAPAPTRKGFTINQIARPANKTRTINLPGMYARSLAKFGGTVPQSVKEAASKGSAVTTPQNNDEEYLTPVTVGKSTLHLDFDTGSADLWVFSDELPSSEQTGHDLYTPSSSATKLSGYTWDISYGDGSSASGDVYRDTVTVGGVTTNKQAVEAASKISSEFVQNTANDGLLGLAFSSINTVQPKAQTTFFDTVKSQLDSPLFAVQLKHDAPGVYDFGYIDDSKYTGSITYTDADSSQGYWGFSTDGYSIGDGSSSSSGFSAIADTGTTLILLDDEIVSAYYEQVSGASGETEAGGYVFSCSTNPPDFTVVIGDYKAVVPGKYINYAPISTGSSTCFGGIQSNSGLGLSILGDVFLKSQYVVFNSEGPKLGFAAQA

SEQ ID NO: 4348 - protein, 467 aa, Aspergillus awamori
MGVSAVLLPLYLLAGVTSGLAVPASRNQSTCDTVDQGYQCFSETSHLWGQYAPFFSLANESAISPDVPAGCRVTFAQVLSRHGARYPTESKGKKYSALIEEIQQNVTTFDGKYAFLKTYNYSLGADDLTPFGEQELVNSGIKFYQRYESLTRNIIPFIRSSGSSRVIASGEKFIEGFQSTKLKDPRAQPGQSSPKIDVVISEASSSNNTLDPGTCTVFEDSELADTVEANFTATFAPSIRQRLENDLSGVTLTDTEVTYLMDMCSFDTISTSTVDTKLSPFCDLFTHDEWIHYDYLQSLKKYYGHGAGNPLGPTQGVGYANELIARLTHSPVHDDTSSNHTLDSNPATFPLNSTLYADFSHDNGIISILFALGLYNGTKPLSTTTVENITQTDGFSSAWTVPFASRLYVEMMQCQAEQEPLVRVLVNDRVVPLHGCPIDALGRCTRDSFVRGLSFARSGGDWAECSA

SEQ ID NO: 4349 - protein, 211 aa, Aspergillus awamori
MKVTAAFAGLLVTAFAAPVPEPVLVSRSAGINYVQNYNGNLGDFTYDESAGTFSMYWEDGVSSDFVVGLGWTTGSSNAITYSAEYSASGSSSYLAVYGWVNYPQAEYYIVEDYGDYNPCSSATSLGTVYSDGSTYQVCTDTRTNEPSITGTSTFTQYFSVRESTRTSGTVTVANHFNFWAQHGFGNSDFNYQVMAVEAWSGAGSASVTISS

SEQ ID NO: 4350 - protein, 804 aa, Aspergillus awamori
MAHSMSRPVAATAAALLALALPQALAQANTSYVDYNIEANPDLYPLCIETIPLSFPDCQNGPLRSHLICDETATPYDRAASLISLFTLDELIANTGNTGLGVSRLGLPAYQVWSEALHGLDRANFSDSGAYNWATSFPQPILTTAALNRTLIHQIASIISTQGRAFNNAGRYGLDVYAPNINTFRHPVWGRGQETPGEDVSLAAVYAYEYITGIQGPDPESNLKLAATAKHYAGYDIENWHNHSRLGNDMNITQQDLSEYYTPQFHVAARDAKVQSVMCAYNAVNGVPACADSYFLQTLLRDTFGFVDHGYVSSDCDAAYNIYNPHGYASSQAAAAAEAILAGTDIDCGTTYQWHLNESITAGDLSRDDIEQGVIRLYTTLVQAGYFDSNTTKANNPYRDLSWSDVLETDAWNISYQAATQGIVLLKNSNNVLPLTEKAYPPSNTTVALIGPWANATTQLLGNYYGNAPYMISPRAAFEEAGYKVNFAEGTGISSTSTSGFAAALSAAQSADVIIYAGGIDNTLEAEALDRESIAWPGNQLDLIQKLASAAGKKPLIVLQMGGGQVDSSSLKNNTKVSALLWGGYPGQSGGFALRDIITGKKNPAGRLVTTQYPASYAEEFPATDMNLRPEGDNPGQTYKWYTGEAVYEFGHGLFYTTFAESSSNTTTKEVKLNIQDILSRTHEELASITQLPVLNFTANIRNTGKLESDYTAMVFANTSDAGPAPYPKKWLVGWDRLGEVKVGETRELRVPVEVGSFARVNEDGDWVLFPGTFELALNLERKVRVKVVLEGEEEVVLKWPGKE

SEQ ID NO: 4351 - protein, 304 aa, Aspergillus awamori
MLLSTHLLFVITTLVTSLLHPIDGHAVKRSGSLQQVTDFGDNPTNVGMYIYVPNNLASNPGIVVAIHYCTGTGPGYYGDSPYATLSEQYGFIVIYPSSPYSGGCWDVSSQATLTHNGGGNSNSIANMVTWTISKYGADSSKVFVTGSSSGAMMTNVMAATYPELFAAATVYSGVSAGCFYSNTNQVDGWNSTCAQGDVITTPEHWASIAEAMYSGYSGSRPRMQIYHGSIDTTLYPQNYYETCKQWAGVFGYDYSAPEKTEANTPQTNYETTIWGDSLQGIFATGVGHTVPIHGDKDMEWFGFA

SEQ ID NO: 4352 - protein, 628 aa, Aspergillus awamori
MVAFSALSGVSALSLLLCLVQHAHGVSLKVSTQGGNSSSPILYGFMFEDINHSGDGGIYGQLLQNPGLQGTTPNLTAWAAVGDATIAIDGDSPLTSAIPSTIKLDVADDATGAVGLTNEGYWGIPVDGSEFQSSFWIKGDYSGDITVRLVGNYTGTEYGSATITHTSTADNFTQASVKFPTTKAPDGNVLYELTVDGSVAAGSSLNFGYLTLFGETYKSRENGLKPQLANVLADMKGSFLRFPGGNNLEGNSAENRWKWNETIGDLWDRPGREGTWTYYNTDGLGLHEYFYWCEDLGLVPVLGVWDGFALESGGNTPITGDALTPYIDDVLNELEYILGDTSTTYGAWRAANGQEEPWNLTMVEIGNEDMLGGGCESYAERFTAFYDAIHAAYPDLILIASTSEADCLPESMPEGSWVDYHDYSTPDGLVGQFNYFDNLYRSVPYFIGEYSRWEIDWPNMKGSVSEAVFMIGFERNSDVVKMAAYAPLLQLVNSTQWTPDLIGYTQSPDDIFLSTSYYVQEMFSRNRGDTIKEVTSDSDFGPLYWVASSAGDSYYVKLANYGSETQDLTVSIPGTSTGKLTVLADNDPDAYNSDTQTLVTPSESTVQASNGTFTFSLPAWAVAVLAAN

SEQ ID NO: 4353 - protein, 499 aa, Aspergillus awamori
MFSRRNLLALGLAATVSAGPCDIYEAGDTPCVAAHSTTRALYSSFSGALYQLQRGSDDTTTTISPLTAGGIADASAQDTFCANTTCLITIIYDQSGNGNHLTQAPPGGFDGPDTDGYDNLASAIGAPVTLNGQKAYGVFMSPGTGYRNNEATGTATGDEAEGMYAVLDGTHYNDACCFDYGNAETSSTDTGAGHMEAIYLGNSTTWGYGAGDGPWIMVDMENNLFSGADEGYNSGDPSISYRFVTAAVKGGADKWAIRGANAASGSLSTYYSGARPDYSGYNPMSKEGAIILGIGGYNSNGAQGTFYEGVMTSGYPSDDTENSVQENIVAAKYVVGSLVSGPSFTSGEVVSLRVTTPGYTTRYIAHTDTTVNTQVVDDDSSTTLKEEASWTVVTGLANSQCFSFESVDTPGSYIRHYNFELLLNANDGTKQFHEDATFCPQAALNGEGTSLRSWSYPTRYFRHYENVLYAASNGGVQTFDSKTSFNNDVSFEIETAFAS

SEQ ID NO: 4354 - protein, 370 aa, Aspergillus awamori
MPSAKPLFCLATLAGAALAAPAPSRATDFNKRSTCTFTDAATASESKTSCSDIVLKDITVPAGETLNLKDLNDGTTVTFEGTTTWEYEEWDGPLLRISGKDITVTQSSDAVLNGNGAKWWDGEGTNGGKTKPKFFYAHDLDDSKISGLYIKNTPVQAISVESDNLVIEDVTIDNSDGDSEGGHNTDGFDISESTYITITGATVKNQGDCVAINSGENIYFSGGTCSGGHGLSIGSVGGRDDNTVKNVTFIDSTVSDSENGVRIKTVYDATGTVEDITYSNIQLSGISDYGIVIEQDYENGDPTGTPSNGVTISDVTLEDITGSVDSDAVEIYILCGDGSCTDWTMSGIDITGGETSSDCENVPSGASCSQ

SEQ ID NO: 4355 - protein, 362 aa, Aspergillus awamori
MHSFASLLRYGLAAGATLASASPIEARDSCTFTTAAAAKAGKAKCSTITLDSIKVPAGTTLDLTGLTSGTKVIFEGTTTFDYEDWAGPLISMSGKDITVTGASGHLINCDGSRWWDGKGTSGKKKPKFFYAHGLDSSSITGLNIKNTPLMAFSVESDDITLTDITINNADGDSLGGHNTDAFDVGNSVGVNIIKPWVHNQDDCLAINSGENIWFTGGTCIGGHGLSIGSVGDRSNNVVKNVTIEHSTVSNSENAVRIKTISGATGSVSEITYSNIVMSGISDYGVVIQQDYEDGKPTGKPTNGVTITDVKLESVTGTVDSKATDIYLLCGSGSCSDWTWDDVKVTGGKKSSACKNLPSVASC

SEQ ID NO: 4356 - protein, 281 aa, Aspergillus awamori
MKQFSAKHALAVVVTAGHALAASTQGISEDLYTRLVEMATISQAAYADLCNIPSTIIKGEKIYNSQTDINGWILRDDSSKEIITVFRGTGSDTNLQLDTNYTLTPFDTLPQCNGCEVHGGYYIGWVSVQDQVESLVKQQVSQYPDYALTVTGHSLGASLAALTAAQLSATYDNIRLYTFGEPRSGNQAFASYMNDAFQASSPDTTQYFRVTHANDGIPNLPPVEQGYAHGGVEYWSVDPYSAQNTFVCTGDEVQCCEAQGGQGVNNAHTTYFGMTSGACTW

SEQ ID NO: 4357 - protein, 640 aa, Aspergillus awamori; identical to SEQ ID NO: 4301

SEQ ID NO: 4358 - protein, 177 aa, Aspergillus clavatus
MVAIKNLVLVALTAVTALAMPSPLEERAATWTCMNEQKNPKTNKYENKRLLYNQNNAESNAHHAPLSDGKTGSSYPHWFTNGYDGDGKILKGRTPIKWGNSDCDRPPKHSKNGDGKNDHYLLEFPTFPDGHQYNFDSKKPKEDPGPARVIYTYPNKVFCGIVAHTRENQGDLKLCSH

SEQ ID NO: 4359 - protein, 564 aa, Aspergillus clavatus
  strain ATCC 1007 / CBS 513.65 / DSM 816 / NCTC 3887 / NRRL 1
MRGAFLATAAAIAGTAMADIAHMRRHGHDSFHQRRAVEQPAPEADATCGCTTEVVTSWGPPTLIPIATSSPSSTVTSEVVTTLHSTSYSTVTLVVTPSGASPNRESAPATPAVTLPTPGVTSFSTTGTYTIPATTLTVTHSTTVCGATTTELPSGTHTYGGVTTVVDRHTTVVCPYATVEPSGSTVTSVIRTTTYVCPSAGTYTIAPTTTYVPTSTVIVYPTPATITPGTYTQPAQTITVTRDNYIYVCPFTGQQLPTTAPVAPATTAVPATTTAVPATTTAVPATSSVAPSSSPSKPAAPSGAVSGQMGMTYSPYTNEGGCKDKASIISEVALLKSKGFTHVRVYSTDCGSLEFIGEAARTSGLRMIIGVFIKQSGVAGAQDQVTAISKWAQWDLVSLIVVGNESIQNHFCDASTLAGFIVSAKQSFKAAGYSGQVTTTEPINVWQANGDALCGAVDIIGANIHPFFNADVSAAEAGKFVAQEFKTLKGICPGKDVINLETGWPHSGEANGKAIPSREEQAIAIKAIADEVGSMSVFFSYFDDLWKQPGAFGVERYWGCIENF

SEQ ID NO: 4360 - protein, 254 aa, Aspergillus clavatus
  strain ATCC 1007 / CBS 513.65 / DSM 816 / NCTC 3887 / NRRL 1
MLQSLLLLPLFLTSAFATPHDPTAHQALEKRATFPIPSSKGSVTLRSTQYVKGTFDGGMKTYGRGVECTGQKEGGEKDAVFVVEEGGILKNVIIGADQIKGVYCKGSCTIQNVWWKDVCEDALSLKGSGSGTYKIIGGGAQNADDKVIQHNSGGTVMIQGFTVSNFGKLYRSCGNCSKQYKRSVQISGVKAYNGKTLVGINSNYGDTASIDACASSVKDICVEYEGTNNNGKEPKKKSSGPSKACEYNQPLKKC

SEQ ID NO: 4361 - protein, 353 aa, Aspergillus clavatus
  strain ATCC 1007 / CBS 513.65 / DSM 816 / NCTC 3887 / NRRL 1
MKSTFGLLALAAAAKMAHAHATVQAIWINGVDQGAGNSASGYIRSPPNNSPLVDVTSADMTCNVNGKNPVAKTLPVKAGDKITFEWHHTDRSPSDDIIASSHRGPIMVYMAPTAKGAAGNGWVKIAEEGYSNGKWAVDNLIANRGKHSIVVPDVPAGDYLFRPEIIALHEGNRLGGAQFYMECVQVKVTSNGANALPAGVSIPGAYKATDPGVHFDIYNSFSSYPMPGPAVWNGASAAGSAPAPTAAPTQKPVVTAAPTTLATLVKPTTTTAAAPAETDSCDGDDDDYETETPAPQASATQAPAPQRPAPQTPSGSVKEWYQCGGINYTGAKNCESGLVCKEWNPYYHQCIKA

SEQ ID NO: 4362 - protein, 634 aa, Aspergillus clavatus
  strain ATCC 1007 / CBS 513.65 / DSM 816 / NCTC 3887 / NRRL 1
MRGLLLAGLVALPASVLAHPSPAGHGIQRRAVDLNAFRLKTSATYADATETANDPALSFTSLEKQSYVDTATQFVKAIAPGLTFRVVDDHYVGDNEIAHVNFRQTANGLDIDNADFNVNVGKDGKIFSHGNSFFKGKIPDASSLTKRDFSDPTVALKGTMETLKLSLGIEKASIKPTDGEKESYVFNGVSGTVSDPKAKLVYFAKPDGTLALTWRVETDVDHDWLLTYVDAQSGKEVHGVVNYVAEADYKVYPWGLNDPTEGSRVMIKDPWDTVASEFTWNSDGTKKYPTTRGNNGIAQSNPSGEDDYINNHRPRSSNLSFNYPYSPSSSPPSSYIDASIVQLFYTANMYHDLLYTLGFTEKTGNFEFNNNGQGGRGNDYVILNSQDGSGTNNANFATPPDGQPGRMRMYTWTKSQPYRDGSFEAGIVIHEYTHGVSNRLTGGPANSNCLSTIEAGGMGEGWGDFMATAIRLKAADTRAKDYTMGAWAANDPKGIREYPYSTSLTTNPLAYSNVDGDDSVHSIGTVWATMLYELMWNLIDKHGKNVSAKPTMKGGVPTDGKYLAMKLVVDGMALQPCNPNFVQARDAILDADKALTKGANRCEIWKAFAKRGLGYGAKYNENKRVTSNKLPSGC

SEQ ID NO: 4363 - protein, 448 aa, Aspergillus clavatus
  strain ATCC 1007 / CBS 513.65 / DSM 816 / NCTC 3887 / NRRL 1
MSRFHLPLAAAVVLVSCLWSANALVRPDGVGKLPALGWNSWNAFGCDIDDAKIMTAAKEIVNLGLKDLGYEYINIDDCWSVKSGRDKTTKRIVPDPAKFPDGIAGVADRIHDLGLKVGIYSSAGLTTCAGYPASLGYEEIDAQTFAEWGIDYLKYDNCGVPSNWTDAYTFCVPDPGSASTNGTCPDNENPAPQGYDWSTSLTAQRHQRMRDALLGVEHTIFYSLCEWGQADVSAWGNATGNSWRMSGDITPSWDRIAAIANENSFLLNHVDFWGHSDPDMLEVGNGDLTLAENRAHFALWAAMKSPLIIGTALDGIDPAHLEILLNKYLIAFHQDPVIGRPAYPYKWGYSPDWTFDPAHPAEYWSGPSSTLDGTLVLMLNSEGSRQTRTAVWKEIPELKDALGRKGRRQTGFRVTDVWTGKDLGCVRDHYTVTLESHDVAALLVGKGC

SEQ ID NO: 4364 - protein, 127 aa, Aspergillus clavatus
  strain ATCC 1007 / CBS 513.65 / DSM 816 / NCTC 3887 / NRRL 1
MQFTYKALSALAVSFFFSTASAVAHCKPGQAWPDVHDCHNFFECASGGVPVLKTCGPGTAYCPKTGICDYEFKNPACRLHGAGPEGHAGPGGHDGKGPEGHGGPGGIEEFAGHGRPDGPAGPGAINH

SEQ ID NO: 4365 - protein, 511 aa, Aspergillus clavatus
  strain ATCC 1007 / CBS 513.65 / DSM 816 / NCTC 3887 / NRRL 1
MTLLILLAGLATAASALTATVNTAQTYQTMDGFGFSQAFGRAYDLYNIPSDQRDYALDLLFSPTKGAGMTILRNRIGSSSGDSILPNSPGSPNSIPHYKALGTDSVQVWVTQQAVKYGVKTIYADAWSAPAFMKTNGEEKSGGYLCGVTGKTCPSGDWKQAYANYLVQYIKDYAELGLDISHVGFLNEPDYTVSYSSMLSDGTQAADFIKVLHPTLQKAGLSHVGITCCDATGWSAQKTRTAELIAANAEGLLSRITSHSYSSDPTSPMGANIPVWQTETADLSGAWETTWHSSGGKGEGLTWAEKIHTAITQGGVSAYLYWEGFERATTNACLVITDGKRVIPSGRLWAFGHWSRYVRPGAVRVAISGSTSTLKMTAFKNKDGTVSVQIINTGPSASEVTVAGFAAASAKAYLTDNNHAQISETTVSVNGGKASVNVPGHAFVTVVLSGNGSRVPPSLSPATKPETKPETGNAVVTGRWSQCGGQGWTGPTACAAPYTCKAQNPWYSQCL

SEQ ID NO: 4366 - protein, 309 aa, Aspergillus clavatus
  strain ATCC 1007 / CBS 513.65 / DSM 816 / NCTC 3887 / NRRL 1
MSALSSENVNGVYIPSALLVFGTFLVKKEFVPYAVALTAVLAGFKLFTGDSKARKVLNPTEFQEFVLKEKTDISHNVSIYRFALPRPTDILGLPIGQHISLAATIEGQPKEVVRSYTPISSDNEAGYFDLLVKAYPQGNISKHLTTLKVGDVMKVRGPKGAMVYTPNMCRHIGMIAGGTGITPMLQVIKAIIRNRPRNGGTDITKVDLIFANVNPEDILLKEELDKLAAEDEDFNIYYVLNNPPQGWTGGVGFVTPEMIKERLPAPASDVKVLLCGPPPMISAMKKATESLGFTKARPVSKLEDQVFCF

SEQ ID NO: 4367 - protein, 860 aa, Aspergillus clavatus
  strain ATCC 1007 / CBS 513.65 / DSM 816 / NCTC 3887 / NRRL 1
MRTAEAILLAAGLLVEAAYAAASQQYTWKSVMTGGGGGFVPGIVFNPSEKGLAYARTDIGGAYRLNADDSWTPLQDYAANSDWHDWGVDALATDPVDPARVYLAVGLYTNEWDPENGSILRSKDRGNTWAEAKLPFKVGGNMPGRGLGERLAIDPNDNSILYFGARSGHGLWKSTDYGVTWSNVTSFTWTGTYVQDPTSSYTADRVGIAWITFDSTSGLKGSGSSRIFVGIADTGKSVFVSEDAGATWSWVTGEPMYGFLPHKGVLSPAEKTLYISYANGAGPYDGTNGTLHKYDIANKKWTDISPTPAASVSYGYGGLAVDLKVPGTIMVAALNSWWPDGIVWRSVNSGATWSAIWDWNGYPNMNKYYSYDISNAPWLLDGSTGKEFPQKVGWMMEALVIDPFDSDHWLYGTGATIYGGHDLTKWDTVHNVTLKSLAVGIEEMAILGLIAPPGGPQLLSAVGDVGGYYHSDLSKAPQHSFQTPMYSTTQGIDYAGNKPSNIVRSGSSDNLPTVALSSDFGKTWSGNYAASSSTPTGPVAFSADADTILLMNSNGAMVSKSSSTFTAVSSLPSGAAIASDKANNTVFYSGSAGSIYVSANGAASFTKTATLGSSTSVNTIRAHPSIAGDVWATTDKGLWHSTDYGKTFTQIGSGCAAGWSFGLGKGSSTGSYAVLYGFFTVDGVTGLFKTEDKGANWQMISDASHGFGSASTNVVNADMLNYGRVFVGTNGRGIFYGEPGGSVPSSTATATSATQTSISTASSSTTVKTSSITASTSTTMTTTTKPSTTGTTTSSGPNGTATSSPWEQCGGIGYTGPTLCPSGWKCTVQNDYYSQCELSIILQTAIFLRRTRTDCNLGMQ

SEQ ID NO: 4368 - protein, 436 aa, Aspergillus clavatus
  strain ATCC 1007 / CBS 513.65 / DSM 816 / NCTC 3887 / NRRL 1
MRSLSSVALLSAIGAASAQAGPWGQCAGISHTGPTTCESGWSCVYLNDWYSQCQPGAATSSSTTVSSTKQPSSTVAAPSSTTSAHTLPTGSGSFAKTDGLKFNIDGKTKYFAGTNAYWLPFLTNNADVDAVFDHLQQTGLKILRTWGFNDVNTIPGSGTVYFQLHDKATGTSTINTGANGLQRLDYVISAAEKHGIKLIIPFVNNWDDYGGMNAYINAYGGSKTEWYTNEKIQSVYQAYIKAIVSRYRDSPAIFAWELGNEPRCKGCSTDVIYNWVAKTSAYIKSLDPNHMVTTGEEGMGLTVDSDGSYPYSKDEGSDFARNLAAPDIDFGVYHLYVADWGVSDNAWGNRWIKSHAKVCEAAGKPCLFEEYGIKDDHCGDSLKWQKTSLTTTANSADLFWQYGQQLSTGASPNDHYTIYYGTDDWKCAVIDHISQI

SEQ ID NO: 4369 - protein, 388 aa, Aspergillus clavatus
  strain ATCC 1007 / CBS 513.65 / DSM 816 / NCTC 3887 / NRRL 1
MRVLAAIALGATGLRGALAAVVPQEVLGTNPHIHHEQEKYLIELAPYQTRWVTEEEKWALKLDGVNFIDITEEHNTGFYPTLNSASYVKYPLKMQYADEVVALNKNLSTANMKANLEHFTSFHTRYYKSQTGIESATWLASQVEKVITESGAANHGATVERFAHPWGQFSIIARIPGQTNKTVVLGAHQDSINLFLPSILAAPGADDDGSGTVTILEALRGLLQSGSVAQGNATNTIEFHWYSAEEGGMLGSQAVFSSYKKNRREVKAMLQQDMTGYTKGALDAGAKEAVGIMIDYVDQGLTRFVKEIVTTYCSLGYVETKCGYACSDHTSASKYGYPAAMATESEMENTNRKIHTTDDQIKYLSFDHMLEHAKLTLGFAYELAFAPF

SEQ ID NO: 4370 - protein, 528 aa, Aspergillus clavatus
  strain ATCC 1007 / CBS 513.65 / DSM 816 / NCTC 3887 / NRRL 1
MFFQTGLLLSLSLWTKVAYAAFGITTSSSSYVIDAGSANPLKFTVSRSSCDITSINYSGTELQYASKGSHISSGLGRATVSATQDGDYIKVTCATSTLTHYMVVHHGDSTIHMATHITAEPSIGELRFIARLKSDVLPNEEPFGDVSTTAGGTAIEGSDVFLVNGKTRSKFYSSQRFIDDQRHCISGSAHRVCMILNQYESSSGGPFHRDIDANNGGGFNALYWYMNSGHVQTEPYRMGLHGPYSMVFSRSGMPGTNIDTSFFANLNIKGYVPASGRGTVTGKASGADSRMKWVVHWHNTAAQYWTYTASDGSFTSPAMKPGTYTMVYYQGEYKVAETSVTVRAGSKITKNISGSVKTGKTIFKIGEWDGQPTGFRNADKQLRMHPSDSRMAAWGPLTYTVGRSAPSDFPMAVFKSVNNPVTIKFTASAAQTAAATLRIGTTLSFAGGRPQAKINSYTAAAPPAPKNLDSRGVTRGAYRGLGEVYDVAIPAGTIVAGVNTITISVVSGNSGEKFLSPNFVFDCVELFQ

SEQ ID NO: 4371 - protein, 272 aa, Aspergillus clavatus
  strain ATCC 1007 / CBS 513.65 / DSM 816 / NCTC 3887 / NRRL 1
MLPTILYSAILALSALTPSALAETRSSGCGKHPSLANGVIHLNGREYILKLPDRYDNNHAYHLVFGLHWRGGNMQNVANGESIQPWYGLETRAQGSTIFIAPNGKNAGWANNGGEDVAFIDAIIKQVEADLCVDQSSRFATGFSWGGGMSYSLACSRAKQFKAVSVLSGGVISGCDGGHDPIAYLGIHGINDGVLPFNGGVGLAQKFVQNNGCQQANIGAPPSGSKSSVRTDFKGCSKPVSFIAYDGGHDSAPLGVGSSLAPDATWKFFMAA

SEQ ID NO: 4372 - protein, 215 aa, Aspergillus clavatus
  strain ATCC 1007 / CBS 513.65 / DSM 816 / NCTC 3887 / NRRL 1
MHFRALLVSALATLAMAAPAPTLEARQSLSSNELENGPCRDVTFIFARGSTEQGNMGFIVGPPTCTALKLKLGSDKVACQGVGGAYTANLLPNFLSQNTDPKSIAAATDMFQLARTKCPNTKIVTGGYSQGSAVIDNSVKALDDDLKSRVKAAVLFGFTRNVVDRGQIPNYPKDQVKVYCAVGDMVCYNTLIITAAHLTYGIYANDAANFLVSKL

SEQ ID NO: 4373 - protein, 838 aa, Aspergillus clavatus
  strain ATCC 1007 / CBS 513.65 / DSM 816 / NCTC 3887 / NRRL 1
MVQFDVEKTLEELTLGEKVALTAGTDFWHTAAVPRLNIPSLRMSDGPNGVRGTRFFNGTRAACFPCSTALGATWDTELLYEVGRLMAEESIAKGSHIILGPTINTQRSPLGGRGFESFAEDGVLSGLLAGNYCKGLQDKGVAATLKHFVCNDQEHERLAVDSIVTMRAMREIYLMPFHLAMRLCKTACVMTAYNKINGTHVSENKQIITDILRKEWGWDGLVMSDWFGTYSTSDAINAGLDLEMPGPTRWRGTALAHAVSSNKAFEYVLDERVRNVLNLHNFVEPLGIPENAPEEALNRPEDQALLRRAAAESVVLMKNEDNILPLKKEKSILVIGPNAKTAAYCGGGSASLDAYYTVAPFDGVKAKSEGEVSFSQGVYSYNELPVLGPLLKTEEGEKGFKFRVYNEPSSNPNRELLDELRLENSLGFLMDYKHPKVTSFLFYADMEGYFTPEEDGIYDFGVTVQGTGKLYIDGELVVDNSKNQRQGTAFFGNATVEEKGSKELKAGQTYKVVVEFGSAPTSDLDMRGVVVFGPGGFRFGAARRVGQEELISKAAELASQADQVVIFAGLTSEWETEGHDRDHMDLPAGSDEMISRVLDANPNAVVVIQSGTPVTMPWAHKTKALLQAWFGGNECGNGIADVLYGDVNPSAKLPLSFPVRLQDNPSYLNFRSERGRVLYGEDVYVGYRYYEKVDLAPLFPFGHGLSYTTFSRSDLSLATVPEKRQLEDGEPITATVTVTNTGDVAGAEVVQLWIVPPPTGVNRPVRELKGFAKVFLNPGESKTVEIVVEKKLATSWWDEQREKWASEKGTYKVLVTGTGDEVLKSSFEVEKTRFWLGL

SEQ ID NO: 4374 - protein, 415 aa, Aspergillus clavatus
  strain ATCC 1007 / CBS 513.65 / DSM 816 / NCTC 3887 / NRRL 1
MKFPWLLLVKGAASVAAQKPLATSGSGQVLGTFNLEDIINASPLLSFHRDIVKIPSTTDNEYEVGQFIGDFLEQKHFTVEKQSISDSRFNVYAYQGNNSLPDILVTSHIDTVPPFLPYNLDYPILGGGHEFDRQSVLIAGRGTVDAKGSVAAQIFAVLEILEEKPDASIGLLFVVGEEKGGIGMETFSKNPSPSSFHTVIFGEPTGLNLVSGHKGVIGFNIKATGRAAHSGYPWLGKNAISALLPVASFTERLGEIPFQDGGLPSSLKYGNSTVNLGVIQGGVAVNVVPDSAEAIFSVRVAAGTPDESKSIITREVNKFTKNDPNIEVAFYPGGLSPTDLDTDVEGFDIITVNYGTDVPKLAIHGGGDRVVKRYLYGPGSILVAHGEDEALTVGDLEGAVQGYRVLIEKALSRDV

SEQ ID NO: 4375 - protein, 655 aa, Aspergillus clavatus
  strain ATCC 1007 / CBS 513.65 / DSM 816 / NCTC 3887 / NRRL 1
MAKQRRDESPSGLSDIVEPDGLLGTGLTSRHIEAFGRKVTSTAGHLMGPTTESSNGGHYHTAMVDIHRELRRPTTQRKVFSLTQTTPTDLVRSKLSTTEIQSRAISSLPDELLANIPEDSSSYSLFEGFKATQDDHEYRKSHRRRSSKAKKLLKDGQAKEALPSAPTDLKKDRDLLSRRLDLMGVRKNMCSSEIHDIDNKIANLHNMRKIVLERLAGLEMEEAELEHELTEIDNKLEDIQEDTPGTPVAVSTPKSSEAADDSVLSEDSAMDASFMSESIYQKLPSPKSLKKRSIRKRSMPILHEHFSPGSQIKEMQAHTDMVTAIDFDYPFGTMVSAALDDTVRVWDLNTGRCMGFLEGHNASVRCLQVEDNIVATGSMDASVKLWDLSRARTVPRDNRVGRPDEEDEEDDGTDAFSILSATTLEDCYVFSLDAHVDEVTALHFRGDTLISGSADKTLRQWDLVKGRCVQTLDVLWAAAQASTIGADTQWRPSGRLPDASADFVGAVQCFDAALACGTADGMVRLWDLRSGQVHRSLVGHTGPITCLQFDEVHLVTGSQDRSIRIWDLRMGSIFDAFAYEKPITSMMFDTKRIVAAAGENVVKVYDKADSNHWDCGAGLGADEVGPAPATVERVRLKDGYLLEGRKDGIVAAWTC

SEQ ID NO: 4376 - protein, 394 aa, Aspergillus clavatus
  strain ATCC 1007 / CBS 513.65 / DSM 816 / NCTC 3887 / NRRL 1
MVVFSKVTAAVFGLATIASAAPAPPTRKGFTVQQQARPAQKKQVNLPAMYAHALTKFGGSVPESVKVAASKGSAVTTPEAGDVEYLTPVNVGGTVMNLDFDTGSADLWVFSGELPASETSGHSVYKPGRTASKLPGGSWQISYGDGSSASGDVYKDTVVVGGVTAHGQAVEAAAQISSQFLQDKNNDGLLGLAFSSLNTVQPQPQTTFFDTVKSSLDRPLFAVTLKHNAPGSFDFGYIDHSKYTGEIAYTDVDNSQGFWSFTADGYSIGGGQSSGSSISGIADTGTTLLLLDDNVVSDFYQHVEGAQNSDEYGGYVFPCSAKVPSFTTIIGGYKAVTPGKLINYGPVTDGSSTCYGGIQSSGGVGQNIFGDIFLKSQFVVFDSEGPRLGFAAQA

SEQ ID NO: 4377 - protein, 465 aa, Aspergillus clavatus
  strain ATCC 1007 / CBS 513.65 / DSM 816 / NCTC 3887 / NRRL 1
MLDFMDYIQLAFAEATSWNRDNSYSSLTATAQSLLDFSTPERLRVHISSLATPHFATSYTLGTVGLIDGSVSYLYSTVPLDNTPSRSALIPLRKLARGYRQVQPPVAPVEDWGWNSLLDGLGSFQSTHAGDGNTHVSLSQKATLLHATLHLPPPTTLNALFLRRISPTMQLSLAVCSTRGPPLSKSAPQASLLGQLCHDTGKYSNEYLFSTDNSLFGWRGLWNFGPDPRHPRDPSSPPVSLLSAGAEAYYSPVSSLIGMSTGLRFSTLPAATETPSSTTTTTPISTFPYTLTLILTPLTGSLSTTYSLRASPNLAFSSRFGFNVYSWESEMVAGCELWRRRRKPQHQQDDPADHDGLEWARRKMRMHDPDYAPPTAPAPAPVAAESDEGNESVLKIRVDQSWNVRLLWEGRVKELLVSAGVGLGPSSFSPSSWSVPASGSAQAGGGGGHAKSYWHGVGVSVSYSS

SEQ ID NO: 4378 - protein, 525 aa, Aspergillus clavatus
  strain ATCC 1007 / CBS 513.65 / DSM 816 / NCTC 3887 / NRRL 1
MHPSMTLLAILPPLVRASIGNPHLLPTPPMGFNNWARFMCNLNESLFLDTAAAMLDTGLHAAGYTRLNLDDCWMASHRAPNGSLPWDPTKFPHSLPWLSAQLRSLGFSLGIYQDAGNVTCGGYPGSYGFEELDAHTFAEWGVDYLKLDGCNVSPAGAVSLADEYRARYARWHSVLGAMPHPLVFSESAPAYFVDPQNATAWYGVMDWVPAYGELARHSTDILVYEGEGSAWQSIMVNYRYNTLLARYQRPGYFNDPDFLIADHPGLSLVEKRSHFALWASFGAPLIISADVPGLSKEVIAVLTNADLIRVDQDALGLQATLASRSEHLDVLTRSLDGGDRLVTILNRGDGGLAVKVPVGWMGLQRCAYQAKNLWDGEIQEIEEDIEVQLDSHATEVFRVSLPPDCPMVIPTGIVFNTASGNCLTDGEALAFEPCRGQDLQVWQVEESGILRPLSRTSHCLTAIGDNVVVKPCTGRPGQRWTYHITGNLQNQHTGACLTEGTGIDVCGFELDSQVFGLPSGVDIEA

SEQ ID NO: 4379 - protein, 840 aa, Aspergillus clavatus
  strain ATCC 1007 / CBS 513.65 / DSM 816 / NCTC 3887 / NRRL 1
MRSVITTLTLVASVGLAVAENGFDGWLRYAPVSCHGACQKSLPSHIVTLDPTESSPISVAGQEIQDGLQRMFKMHATVEPKGCSTRSSVIIGTLDAYNHACKDADPVPELEEDGFWLNTKDGKVQIIGQSERGALYGAYEYLSMLSQGNFAPVSYTTSPHAPIRWVNQWDNMDGSMEHGYGGLSIFFKDGVIPQDLSRVKQYARLLASIRINGIIVNNVNANASLLKPENMDGLARIADIFRPYGVKVGISLNFASPSTLGGLNTYDPLDESVISWWGGITDELYKRVPDMAGYLVKANSEGQPGPTTYNRTLAEGANLFARALKPHGGIVMFRAFVYDHHISEENWYNDRANAAVDFFKPLDGKFEENVVVQIKYGPIDFQVREPVSPLFANLYKTNTAIELQVTQEYLGQQSHLVYLPPLWQTILGFDLRVDGKPSPTRDIISGQRFNRPLGGWAAVVNVGTNTTWLGSHLALSNLYAYGRLAWEPTLDSQDILQDWIRMTFGLDRRVLDTITKMSMESWPAYENYSGNLGIQTLTDILYTHYGPNPASQDGNGWGQWTRADHEAIGMDRTIKNGTKFTGQYPAEVAQVYENIETTPDDLLLWFHHVPYTQRLQSGKTVIQHFYDAHYAGADTAQTFVSQWESLRGKIDPERYEHVLTRLIYQAGHSIVWRDAINEFYHNLSGIADEKQRVGHHPWRIEAEDMKLDGYVPYDVNPFETASNTKAIVTATNSTTGTASTQLDFKTGKYDLGINYYDFYGGKSQWTAYLNDRLVGQWQGNNEDVLSHELSVYLDGHSATRITFRDVKIHKGDRLKIVGKPDGMEPAPLDYVVLLPQGIVD

SEQ ID NO: 4380 - protein, 272 aa, Aspergillus clavatus
  strain ATCC 1007 / CBS 513.65 / DSM 816 / NCTC 3887 / NRRL 1
MVHSILLYTFLALSVFLSPVFAEARSPGCGKLPNLSNGVHKINGREYTLKVPSNYDKNKAYHLVFGLHWRGGNMGAVVKGEGVQPWYGLEKRAHGSAIFVAPNGKSAGWANTGGQDIAFLDAIIKEVESNYCVDQSSRFATGFSWGGGMSYALACSRAKQFKAVSVLSGGLISGCSGGNDPIAYLAIHGIKDNVLPFNGGISLANRFVKNNRCHQSEIHTPKSGSRSSVRTDFRGCSKPVSFIAYDGGHDAAPLGVGSSLAPDATWKFFMAA

SEQ ID NO: 4381 - protein, 355 aa, Aspergillus clavatus
  strain ATCC 1007 / CBS 513.65 / DSM 816 / NCTC 3887 / NRRL 1
MRQAQTFKLLAALLSASQVAGHGHVTNIVINGVSYRGWNIDSDPYNSNPPIVVAWQTPNTSNGFVAPNDVGTDDIICHLDAKNARGHAVIAAGDKISFQWTSWPESHWGPVITYLANCGESCETVDKTTLEFFKIDAVGLVDGSNPPGFWGDDQLIENNNSWMVEIPKSIAPGYYVIRHELIALHAAGSPNGAQLYPQCFNLQITGSGTAKPSGVKGTKLYTPTDPGILVNIYSSLDYIIPGPTLIPDAVSLVQSTSAITASGTPITGSGSVPPATDGPSTTKATPTSSTTLSTTTKATITQAPTSSTTSAGSTATQTAYGQCGGSGWTGPTACGSGATCTSYSEWYSQCIPKSG

SEQ ID NO: 4382 - protein, 403 aa, Aspergillus clavatus
  strain ATCC 1007 / CBS 513.65 / DSM 816 / NCTC 3887 / NRRL 1
MILSAKMLGAILLELALTAAAQQTLYGQCGGNGWTGPTQCVSGACCQIQNPWYSQCLPGSCSPSTTLTRVTTTATSTASTATSGTGGSLPSSFKWSSSGPLVDPKNDGRGIAALKDPSIVEVDGTYHVFASTATSAGYNMVYFNFTDFNQANNAPFFYLDKSPIGSGYRAAPQVFFFKPQNLWYLVYQNGNAAYSTNKDISNPAGWSAPKTFYSSQPSIITENIGNGYWVDMWVICDSANCHLFSSDDNGHLYRSQTTLANFPNGMTNTVIAMQDSNPNNLFEASNVYHVGGGKYLLIVEAIGSGGDRYFRSWTSTSLTGTWTALAASESNPFAGAKNVAFSGNVWTKSISHGEMIRDQVDQTLTISPCKLRYLYQGVDPAATGNYNSLPWKLALLTQTNSAC

SEQ ID NO: 4383 - protein, 339 aa, Aspergillus clavatus
  strain ATCC 1007 / CBS 513.65 / DSM 816 / NCTC 3887 / NRRL 1
MKSIANTKGVVLLALALPVLGQQSLYGQCGGNGWSGPTECTAGACCQVQNPWYSQCLPGDCKPSSPTTTLVTSTTASTTTVTAPGGHSTGCGKTPSMNSGTYTMTVNGIQRQYTLTLPQNYDRSKPYKLIFGYHWLGGTMQNVAGGAYYGVQPLSGNSAIFVAPQGLDNGWANKNGDDITFNDQLVAKLTTEFCIDDSQIYSMGWSYGGSMSYALACARPDVFRGVAVMSGANLSGCSPGTKPVGYYGQHGGSDDVLSISLGRQIRDTFVKDNQCTPQNPSEPAKGSGKHIKTVYSGCSTDHPVWWIAFDGPHEPLATDAGSSSSWTPGELWSFISQFN

SEQ ID NO: 4384 - protein, 771 aa, Aspergillus clavatus
  strain ATCC 1007 / CBS 513.65 / DSM 816 / NCTC 3887 / NRRL 1
MVGLTPQHYGNAIALMTYLASTALADNKFPDCTSGPLSKLAVCDTSRDVTTRAQSLVDAMSFAEKVNNTQYEAPGVPRLGLPAYNWWSEALHGVAGAPGVHFADSGPFSYATSFAQPILLGASFDDELVKQVATVVGTEGRAFGNAGRAGLDYWTPNINPFRDPRWGRGQETPGEDPLHVSRYVYHLVDGLQGGIGPARPQIAATCKHFAAYDMEDWNGVSRHEFDARVSTQDLAEFYLPSFKSCVRDAQVDAVMCSYNALNGVPTCADPYLLQTLLREHWDWDQPGHWVVSDCGAIDDIYIGHNYTKTGAEAAAVALNAGTDLDCGTVFPKHLGEAAEQGLYTNQTLDRALVRLYSSLVKLGYFDPAEKQPYGSIGWKDVDTPAAEQLAHKAAVEGIVLLKNDQTLPLKAKGTLALIGPYANATKQMQGNYQGPPKYIRTLEWAATQHGYQVQYSPGTAINNSSTAGFAAALAAAKDADVVLYAGGIDNTIESETLDRTTITWPGNQLSLISELSNLHKPLIVIQFGGGQVDDTPLLTNPHVNALLWAGYPSQEGGAAIFDILTGKAAPAGRLPITQYPAAYTAQVPMTEMGLRAGGDNPGRTYRWYDKAVVPFGFGLHYTSFEVSWDRGRLGPYNTAALVNRAPGGSHVDRALFDTFRVQVQNTGTVTSDYVALLFVKTEDAGPEPYPLKTLVGYTRVQQVKPGERRSVEIEVTLGAMARTAANGDLVLYPGKYTLQVDVGERGYPTARVSVHGKEVVLDHFPQPPEGR

SEQ ID NO: 4385 - protein, 464 aa, Aspergillus clavatus
  strain ATCC 1007 / CBS 513.65 / DSM 816 / NCTC 3887 / NRRL 1
MKNFAPSLALSLLLPTVQAQQTMWGQCGGAGWSGATDCVAGGVCSTQNAYYAQCLPGATTATTLSTTSKGTTTTTTSSTTSTGGGSSSTTTKTSTSAGPTVTGSPSGNPFSGYQQYANPYYSSEVHTLAIPSMTGALAVKASAVADVPSFVWLDVAAKVPTMGTYLENIRAKNKAGANPPVAGIFVVYDLPDRDCAALASNGEYAIADGGIAKYKAYIDAIRAQLLKYPDVHTILVIEPDSLANLITNINVAKCSGAKDAYLECINYALKQLNLPNVAMYIDAGHGGWLGWDANIGPAAEMYAKVYKDADAPAALRGLAVNVANYNAWTIDTCPSYTQGNKNCDEKRYIHALYPLLKAAGWDARFIMDTGRNGVQPTKQQAQGDWCNVIGTGFGIRPSSETGDDLLDAFVWVKPGAESDGTSDTTAARYDAHCGYTDALKPAPEAGQWFQAYFEQLLTNANPAF

SEQ ID NO: 4386 - protein, 229 aa, Aspergillus clavatus
  strain ATCC 1007 / CBS 513.65 / DSM 816 / NCTC 3887 / NRRL 1
MVSFKYLFLAASALGALAAPVEVEESSWFNETALHEFAERAGTPSSTGWNNGYYYSFWTDNGGTVNYQNGNGGSYSVQWKDTGNFVGGKGWNPGSARTINYSGSFNPSGNAYLTVYGWTTNPLVEYYIVENYGTYNPGNGGTYRGSVYSDGANYNIYTATRYNAPSIEGDKTFTQYWSVRQSKRTGGTVTTANHFNAWAQLGMSLGTHNYQIVATEGYQSSGSSSITVY

SEQ ID NO: 4387 - protein, 453 aa, Aspergillus clavatus
  strain ATCC 1007 / CBS 513.65 / DSM 816 / NCTC 3887 / NRRL 1
MQTRQLLALALAVAATEAAHQGFNYGNTKSDGSAKSQSDFAAEFSTAKNLVGTSGFTSARLYTMIQGGTSATPISAIPAAIAEDTSLLLGIWASGGNVANEIAALKAAIAQYGADFGKHVVGISVGSEDLYRNSVDGVKSKAGLGANPDDLVSYIHQVREAIAGTSLSGAPIGHVDTWTAWVNGSNSAVIDACDWLGFDGYPYFQNTMPNSISDAKALFDESVAKTQAVAKGKEVWITETGWPVSGKTENLAVANTANAKAYWDQVGCPLFGNTNTWWYILQDADPVTPNPSFGIVGSTLSTTPLFDLSCSAVSSSSAVPSATAAATAASGAGASGSQTSGFATAAAGSSSAAKPTFSVGKGPNGSYNGTYPGSWNSTRPGANGGSSGSSGSSGSSGSSGSSGSSGSGASGHSSSTGSSSFPSSTNLLSNSASGLSGSLFGAVAAVFVALAAL

SEQ ID NO: 4388 - protein, 286 aa, Aspergillus clavatus
  strain ATCC 1007 / CBS 513.65 / DSM 816 / NCTC 3887 / NRRL 1
MLFTAVTLALLGQALASALDLEERQSSCPNIHVFGARETTAPAGYGSSSTVVNLILNAYPGSTSEAISYPACGGQSSCGGVSYANSVVAGINAVASAVNTFNQKCPQTQLVLVGYSQGGQIMDNALCGGGDPNQGYTNTAVALSASAVNMVKAAIFMGDPRFIAGLSYEVGTCKVAGFDPRPPGFNCPSGSKIQSYCDAADPYCCNGNDANTHQGYGSVYGQAALTFVKSKLSSSSSGGGSGGGSVGTGGTIARYGQCGGQGWTGATSCQSQYTCTAVSQWYSQCL

SEQ ID NO: 4389 - protein, 985 aa, Aspergillus clavatus
  strain ATCC 1007 / CBS 513.65 / DSM 816 / NCTC 3887 / NRRL 1
MRILSLLFLLLLGFLAGNRVVSATDHGKTTDVTWDRYSLSVKGERLFVFSGEFHYQRLPVPEMWLDVFQKLRANGFNAISVYFFWGYHSASEGEFDFETGAHNIQRLFDYAKEAGIYVIARAGPYCNAETTAGGYALWAANGQMGNERTSDDAYYAKWRPWILEVGKIIAANQITNGGPVILNQHENELQETSYEADNTLVVYMKQIARVFQEAGIVVPSSHNEKGMRAVSWSTDHHDVGGAVNIYGLDSYPGGLSCTNPSSGFNLVRTYYQWFQNSSYTQPEYLPEFEGGWFQPWGGHDYDTCATELSPEFADVYYKNNIGSRVTLQNIYMVFGGTNWGHSAAPVVYTSYDYSAPLRETREIRDKLKQTKLIGLFTRVSSDLLKTHMEGNGTGYTSDSSIYTWALHNPDTNAGFYVLAHKTSSSRSVTEFSLNVTTSAGAISIPDIQLDGRQSKIIVTDYQFGKSSALLYSSAEVLTYANLDVDVLVLYLNVGQKGLFVFKDERSKLSFQTYGNTNVTASVSSHGTQYIYTQAEGVTAVKFSNGVLAYLLDKESAWNFFAPPTTSNPQVAPDEHILVQGPYLVRGVTINHDTVEIIGDNANTTSLEVYAGNLRVKVVKWNGKAIKSRRTAYGSLVGRAPGAEDARISPPSLDSWSAQDTLPDIQPDYDDSRWTVCNKTASVNAVPLLSLPVLYSGDYGYHAGTKVYRGRFDGRNVTGANVTVQNGVASGWAAWLNGQFVGGVAGAIDLAVTSAVLSFNSSLLHDRDNVLTVVTDYTGHDQNSVRPKGTQNPRGILGATLIGGGKFTSWRIQGNAGGEKNIDPVRGPINEGGLYGERMGWHLPGYKAPRSAAKSSPLDGISGAEGRFYTTTFTLKLDRDLDVPIGLQLGAPAGTQAVVQVFMNGYQFGHYLPHIGPQSLFPFPPGVINNRGENTLAISMWALTDAGAKLDQVELVAYGKYRSGFDFNQDWGYLQPQWKDNRRQYA

SEQ ID NO: 4390 - protein, 452 aa, Aspergillus clavatus
  strain ATCC 1007 / CBS 513.65 / DSM 816 / NCTC 3887 / NRRL 1
MRSLTLLLSLSTALRSVAAPHPASPQGQIPLGGIPSASTSEVGIGIGIGIEEDPFPPAAGSGHNDLEDVINASPLLSFHRDLVSIESISGHEARAAAFVADFLEAHNFTVVKQPVAGDRVNIFASPRAHAHSRPEILLTSHLDTVPPFIPYSLHRNDSRPTDRQLIRIAGRGAVDAKASVAAQIFAALDILHADPSAPLGLLFVVGEEVGGDGMKAFSHDPRLNPAPSRFHTVIFGEPTDFALVAGHKGMLGFEVLASGRPAHSGYPWLGRSAVSAILPALRRVDALGHIPVHHGGLPASHKYGRTTLNIGVLEGGVATNVVPAAARADVAVRLAAGSVDDARAIIAAAVADATHRDPAVVVDFSRHLEAYPPQDLDVDVPGFEITTVNYGTDVPNLHLHPRPDGPVKRYLYGPGSIFVAHGENEGLTVGALEEAVGGYKKLVQAALERTRA

SEQ ID NO: 4391 - protein, 453 aa, Aspergillus clavatus
  strain ATCC 1007 / CBS 513.65 / DSM 816 / NCTC 3887 / NRRL 1
MYQRALLFSALATAVSAQQVGTQKAEVHPALTWQKCTAAGSCTDQKGSVVIDANWRWLHSTEDTTNCYTGNEWNAELCPDNEACAKNCALDGADYSGTYGVTADGSSLKLNFVTSANVGSRLYLMEDDETYQMFNLLNNEFTFDVDVSNLPCGLNGALYFVSMDADGGLSKYPGNKAGAKYGTGYCDSQCPRDLKFINGEANVEGWKPSDNDKNAGVGGYGSCCPEMDIWEANSISTAYTPHPCDGMEQTRCDGNDCGGTYSSTRYAGTCDPDGCDFNSFRMGNESFYGPGGLVDTKSPITVVTQFVTAGGTDSGALKEIRRVYVQGGKVIGNSASNVAGVEGDSITSDFCTAQKKAFGDEDIFSKHGGLEGMGKALNKMALIVSIWDDHASSMMWLDSTYPVDADASTPGVARGTCEHGLGDPETVESQHPDASVTFSNIKFGPIGSTYKSV

SEQ ID NO: 4392 - protein, 212 aa, Aspergillus clavatus
  strain ATCC 1007 / CBS 513.65 / DSM 816 / NCTC 3887 / NRRL 1
MSRSFIASCAVAIALSIGAHAQAPLYAQCGGQGYSGPTSCVSGAVCTAWNDWYHQCVPGTSTMQSSTATAAPVSTTSAAPSPSPSATGLRYFITFGDSYSQTGFDVSGTKPSESNPLGNPTLPGWTSSGGLNWIGALISKYNTSTVLSYNFAYGGATTNASIVKPYAPTVRSFIDQVAEFSSSIATKPSYAPWTAENSLVGVWMGVNDVGNT

SEQ ID NO: 4393 - protein, 378 aa, Aspergillus clavatus
  strain ATCC 1007 / CBS 513.65 / DSM 816 / NCTC 3887 / NRRL 1
MKYASFLALVGFITSTSAIGVSGAAEGFAKGVTGGGSATPVYPSTTAELVSYLTDSQPRVIVLTKTFDFTNTEGSTTATGCAPWGTAPGCQLAINQNDWCKNYQSSAPSVSVTYDNAGVLGMTVASDKTLLGSGSSGVIKGKGLRVVSGAKNIIIQNVAITDINPKYVWGGDAITIDNADMVWIDHVTTARIGRQHLVLGTSASNRVTISNSYFNGVSSYSATCDGYHYWGIYLTGSNDLVTMKGNYIHHFSGRSPKIQGNTLLHAVNNYWYDSTGHAFEIGSGGYVLAEGNVFQNIKTIVEPPVGGQLFTSPNSNTNQACSAYLGHVCQVNGFGSSGPFSQADTGLLSKFSGKNVASASAYTVAQSRVPSSAGQGKL

SEQ ID NO: 4394 - protein, 418 aa, Aspergillus clavatus
  strain ATCC 1007 / CBS 513.65 / DSM 816 / NCTC 3887 / NRRL 1
MVRTFAVTALALLPLVAAQQIGSTKEVHPQLTTYKCTSQGGCVKQNTSIVLDSGSHWIHAKGGEVSCTTSSGLDPALCPDKETCAENCVVEGITDYSQYGVQTRGDAMLLREYIKQNNQTKAPSPRVYLLDEDGENYSMLRLLNQEFTFDVDVSKLPCGMNGALYFSEMSASGGRSALNPAGAAYGTGYCDAQCYTNAWINGEANTAKAGLCCQEMDIWEANARANAFTPHPCNSTGLLGCAGDECNSVCDKAGCGFNPYALGARDYYGTAMTVDTTKPFTVVTQFLTADNSTTGALREIRRLYVQAGQVIQNAVVKVDGRTVNSITEPYCASQGVFEGLGGLRRMGEALGRGMVLSMSIWNDAGGFMHWLDSGNSGPCSSTEGDPSLIENKYPDTAVTFSKIRWGDLGTTFATRRLH

SEQ ID NO: 4395 - protein, 845 aa, Aspergillus clavatus
  strain ATCC 1007 / CBS 513.65 / DSM 816 / NCTC 3887 / NRRL 1
MAALQRFPLSKGWSFKDSEDKSEDAWMPVPVVPSVVQQDLQANNKLKDPYIGFNELETRWVNEKSWTYKTTFQKPAVPAGSAIFLAFDGLDTFATVKLDGNVILESDNMFLAHRLDVTKALEAEGDHSLEIDFDCAFLRAKELRKQDSKHNWASFNGDPSRLSVRKSQYHWGWDWGPVLMTAGIWREVRLEVYTARVADLWTDVQLASDHQNAQITAFAEVESVNSDAHKARFTLSLHGQELGREEVSVSEDGSAKVSFDVKSPSLWWPHGYGDATLYEVSVSLVKDQDEVHQVSKKFGIRTAEVVQQPDKHGKSFFFRVNGVDIFCGGSCWIPADNYLPSVTADRYRKWIELMVHGRQVMIRVWGGGNYEDDSFYDACDELGVLVWQDFMFGCGNYPTWPNLLESIRKESVYNVRRLRHHPSIVVWVGNNEDYQVQESAGLTYDFEDKNPENWLKTDFPARYIYEKILPEVVEEYSPSTFYHPGSPWGDGKTTSDPTVGDMHQWNVWHGTQEKYQIFDTLGGRFNSEFGMEAFPHMSTIDYFVENEADKFPQSHVLDFHNKADGHERRIATYLVENLRTATDLETHVYLTQVVQAETMMFGYRGWRRQWGDERHCGGALLWQLNDCWPTISWAIVDYFLRPKPAFYAVARVLNPIAVGVRREHHDWSVTHAQPPKTSKFELWVASSLQKEVQGTVELRFLSINTGLEVRERIVHENVSIVPNGTTNLIVDGLIDYKVHPEPHVLAVRIWVNGELVARDVDWPQPFKYLDLSNRGLEVKLVSESENEQTLLLSAQKPVKCLVFEEREGVRISDSAIDIVPGDEQRVTIKGMKPGDAPLKYKFLGQ

SEQ ID NO: 4396 - protein, 360 aa, Aspergillus clavatus
  strain ATCC 1007 / CBS 513.65 / DSM 816 / NCTC 3887 / NRRL 1
MKLSQILTFASLLSGALAAPGKPHGKPGFASTSGLQFSIDGQTGYFAGSNSYWIGFLTNKADVDIGFNDVNTVPGEGTVYYQLHANGKSTINTGANGLQRMDYVVKSAEKHGIKLIINFVNNWDDYGGMNAYVKGYGAADHNDFYSNAKIQKAYRQYIRAVVSRYTKSDAVFAWELANEPRCKGCDTDVLYDWIKSTSEYIKSLDAKHMVCIGDEGFGLETLSDGSYPFTYVEGSDFARNLAIPTIDFGTFHLYPDSWGTSHEWGNLWTQAHGAACQAAGKPCLFEEYGVTSDHCALETPWQKTSLNTTGVSADLYWQYGDTLSSGPSPNDGHTVYYGTDDFKCMVTDHVAAIKAKQGWV

SEQ ID NO: 4397 - protein, 506 aa, Aspergillus clavatus
  strain ATCC 1007 / CBS 513.65 / DSM 816 / NCTC 3887 / NRRL 1
MLSQPSRERAFVLALGLVVSSSLAAAAPCDIYSSGGTPCVAAHSTTRALYSAYSGPLYQVKRGSDGATTNIAPRSAGGVANAAAQDTFCASMTCLITVIYDQSGRGNHLTQAPPGGFKGPEANGYDNLASAIGAPVTLNGQKAYGVFISPGTGYRNNAASGTAIGDAAEGMYAVLDGTHYNGGCCFDYGNAETSSLDTGNGHMEAIYFGTNTVWGSGSGSGPWIMADLENGLFSGSSPANNAGDPSVSYRFLTAAIKGGPNRWAIRGANAASGSLATYYSGARPNASGYNPMSKEGAIILGIGGDNSNGAQGTFYEGVMTSGYPSDATENAVQADIVAANYAVTSLTSGPALTVGSAISLRATTSCCTTRYLAHTGSTINTQVVSSASATTLKQQATWTVRTGLANSGCFSFESKDTPGSFIRHSNFALVLNGNDGTKQFKEDATFCPQAGLNGQGSSIRSWSFPTRYFRHYSNVLYAASNGGVHTFDAAGSFNDDVSWVISSGFA

SEQ ID NO: 4398 - protein, 88 aa, Aspergillus clavatus
  strain ATCC 1007 / CBS 513.65 / DSM 816 / NCTC 3887 / NRRL 1
MASQSSQADQQQQQQQQSSQSQQPNAWEKAERKFANKNASEYYDPCQDFADRSLKCMKRNAFDKEMCGDYFQAYRDCKKQWLTQKKFS

SEQ ID NO: 4399 - protein, 768 aa, Aspergillus clavatus
  strain ATCC 1007 / CBS 513.65 / DSM 816 / NCTC 3887 / NRRL 1
MKLGKWSVLLLVGCTAAIDIPRKPFPPTGSGHKRLTFNETVVKPVIAPSSTAVEWISTAEDGDYVFQDSDGSLKIQSIVTNHTQTLVPADKVPDDAYSYWIHPNLSSVLWATNYTKQYRYSYFASYYIQDLQSFKLAPLASNQAGDIQYANWSPTGDAIAFVRANNVYVWTAKSTTQITTDGSADLFNGVPDWIYEEEILGDRHALWFSPDAEYLAFLRFNETGVPTFRVPYYMDNEEVAPPYPRELELRYPKVSQTNPTVEVRLLSRATGEVSSVSIKAFNATDLVIGEVAWLTETHSQVAVKAFNRVQDQQKVVTVDVLSLKTKTISERDGTDGWLDNALSITYIGQIGDSKAEYYIDISDESGWAHLWLFPVAGGRPMALTKGEWEVTAILSIDKQRQLVYYLSTQHHSTERHVYSVSWKTFTATPLVDDTVAAVWSASFSSQGGYYILSYRGPDVPYQELYAINSTKPLCTITSNAAVYDVLKQYTLPKISYFELRLPSGETLNVMQRLPVSFSPRKKYPILFTPYGGPGAQEVSKAWQSQTFKSYIASDPELEFVTWTVDNRGTGYKGRRFRGQVAKQLGRLEAQDQVWAAQQAAKLPFIDAEHIAIWGWSYGGYLTGKVIETDSGVFSLGVLTAPVSDWRFYDSMYTERYMKTLQENANGYNASAIWDVAGYKNVRGGVLIQHGTGDDNVHFQNAAALVDRLVGEGVSPDKLQVQWFTDSDHGIRYHGGSVFLYRQLAKRLYEEKHRKKSEGHQWSKRSLEF

SEQ ID NO: 4400 - protein, 317 aa, Aspergillus clavatus
  strain ATCC 1007 / CBS 513.65 / DSM 816 / NCTC 3887 / NRRL 1
MVVLSKIFSCALFLSLGSAAAIDIRQTSSINNAFKSHGKKYFGTCGDQNTLSIPQNSAIIKADFGALTPENSMKWDATEPSRGKFNFAGADHLVNYAKQNGKLVRGHTLVWYSQLPAWVKAISDKQTLTSVLKNHITTVMSRYKGQVYAWDVVNEIFEENGSLRNSVFYRVLGEDFVRIAFETARAVDPHAKLYINDYNLDSANYGKTQAMVKHVKKWLAAGIPIDGIGSQSHLSQALSALASTGVSEIAITELDIKGANPSEYVAVTKACLEVKKCIGITVWGVSDKNSWRKDNSPLLFDRNYNPKPAYNAIIAAL

SEQ ID NO: 4401 - protein, 572 aa, Aspergillus clavatus
  strain ATCC 1007 / CBS 513.65 / DSM 816 / NCTC 3887 / NRRL 1
MAFNFNWSPLMADASFYTRAQDLLTAALNKSPKPPIIVDDIIVTELNLGSIPPELEILEIGDLAEDRFRGIFKMSYSGDAFLTLKTRVQANPLNTYLLTRPSFATPLPLAAATPLTIPLQITLSDIKLSGFVILVFSKQKGITVVFRNDPLESLKVSSTFDSIPFVRDFLQKEIEAQLRILFMDELPAIIHRLSLRLWVPEYRAGEDFETQAEKAETANGEGPGQDPLASPPQDPVDALGHALDESDIASLSLDSSVEAHSLFSQKNLLRLAALTDSQRTLSLFTPSIREVVYRAWTSPTDQTDAAGSVTSPVLSRTHSQVGSMSSFQDSASIASMQTRSSTPSHTFSGYGLSLGAGRHSKAHSRKRKKRVVDLRRPKTTDDAPSVSDESAFTESTSAPSVCSAPLPILNEQSDDPVTPPLSPDNDLHLPIIPDRHRMSISRPAPRRDIAAEMMRDMGGPSSTSDPATQATQSEDTSATPRATMRAQIPSIYLNEKQDAGSSTGVPRQLPSAILPFLNDNPMNRVVDQALVERLAGEIARRMRDEKFMATNACGSFWDRHSQEESPPPAYGH

SEQ ID NO: 4402 - protein, 403 aa, Aspergillus clavatus
  strain ATCC 1007 / CBS 513.65 / DSM 816 / NCTC 3887 / NRRL 1
MQSIKRTLLLLGALLPAALAAPAREPHPSSNIIPGKYIITFKSGIDTAAIESHTAWASNIHKRNLERRGLVGGEFPAGIERKFKIKDFAAYAGSFDPATIEEIRNSEDVAHVEEDQIWYLDALTTQSGAPWGLGSISHKGQASTNYVYDTSAGAGTYAYVVDSGINVDHIEFQGRATKAYNAVGGDHVDTLGHGTHVAGTIGGKTYGVAKQTNLLSVKVFEGRTGSTSVILDGFNWAANDIVSKGRKGKAAINMSLGGGYSYAFNNAVESAYEQGVLSVVAAGNEGVDASNSSPASAPNALTVGATNKSNARASFSNYGKVLDIFAPGQDILSAWIGSTTATNTISGTSMATPHVVGLAVYLMGLEGVSGPAAVTQRILQLATSGVISDVKGSPNKLAYNGAA

SEQ ID NO: 4403 - protein, 349 aa, Aspergillus clavatus
  strain ATCC 1007 / CBS 513.65 / DSM 816 / NCTC 3887 / NRRL 1
MQLTVLASAILALAQGALAIPAKAPALDVTLSQIDNTRVKAVVKNTGAEEVTFVHLNFFRDAAPVKKVSLFRNATEVPFNGIKLRFRNKGLTDDVLTTLAAGATFEDEFDIASTADLTEGGVVTVRSQGVVPLTKDNKVSGYIPFTSNEIELEVDGAKAAAVPAAINLLDRRTKVASCSGSRATALQTALRNTVSLANAAASAAESGSSSRFSEYFKTTSSATRSTVAARLRAVAREAGSTSSGKTTYYCGDPYGYCDPNVLAYTLPSKNIVANCDIYYSDLPALARSCHAQDQATTTLHEFTHAPGVYSPGTDDLGYGYQAATALSTSDALNNADTYALFANAVNLNC

SEQ ID NO: 4404 - protein, 368 aa, Aspergillus clavatus
  strain ATCC 1007 / CBS 513.65 / DSM 816 / NCTC 3887 / NRRL 1
MRSVEILGLAALGSLVAAAPSPSRVSNSAKKASSCTFTSAAQASKSASGCSEITLDNIAVPAGETLDLSHVDDGTTIIFEGTTSFGYKEWKGPLIQFAGTGITVKQNTGAVIDGDGSRWWDGKGTNGGKTKPKFMYAHKLRDSTITGLSIKNTPVQAISVQATNLQLTDITIDNSDGDENGGHNTDAFDIGESNGVYIRGAVVKNQDDCIAINSGENIEFSGGSCSGGHGLSIGSVGGRDNNIVKNVTITDSTISDSDNGVRIKTIYDATGSVGDVTYSNIKLSNIAKYGIVIEQDYENGSPTGTPTTGVPITGLTIDGITGSVASNAVQVYILCGDGSCSDWTWKGVDLTGGKKSSKCENVPSGASC

SEQ ID NO: 4405 - protein, 145 aa, Aspergillus clavatus
  strain ATCC 1007 / CBS 513.65 / DSM 816 / NCTC 3887 / NRRL 1
MHTSSLIHGLVIAFSLATSSSALGINCRGSANCNTFGDNQVAAQLKHAIDGIDSNRWYQNGQHIACIGTVAPITGKGGFCAFLQKTGGTNGAVIKNLAHYIPEHGCKVCGSVPYYYPQGNNNVDDGELTFNYVDNSCSQDDAKLC

SEQ ID NO: 4406 - protein, 139 aa, Aspergillus clavatus
  strain ATCC 1007 / CBS 513.65 / DSM 816 / NCTC 3887 / NRRL 1
MLATTLIMVASALSANALGINCRGSAKCSALWGPSDAAKQLTNVIQGIDTNRWYLNGEHIACVGNDAGNGGGYCAFLQKTGGTNGGVIKNLAHYINDHGCKQCGSVPYYYPQGNNNVDDGELTYNYVDNPCVPAGAKLC

SEQ ID NO: 4407 - protein, 321 aa, Aspergillus clavatus
  strain ATCC 1007 / CBS 513.65 / DSM 816 / NCTC 3887 / NRRL 1
MHPSTFVTTIACLAGLAHGYANPGSCSGACNIHDPALIRRQSDGKYFRFSTGNKISYASSSSIKGPWTVLGSVLPRGSSINLPGKTDLWAPDISLVNGAYHLYYSVSAFGSQDSAIGLATSATMDPNSWTDHGSTGIRSSSSKPYNAIDANLFHDGGNYYMTFGSFWHDIYQAPMNSAATAVSSGPYNIAYNPSGTHAVEGAFMYKFGKYYYLFFSSGICCGYDTSRPAAGKEYKIRVCRSTSATGHFVDKHGVSCTNGGGTVVLESHGHVYGPGGQGVFTDPALGPVLYYHYVDTRIGYADGQKRFGWNKIDFSSGWPVV

SEQ ID NO: 4408 - protein, 459 aa, Aspergillus clavatus
  strain ATCC 1007 / CBS 513.65 / DSM 816 / NCTC 3887 / NRRL 1
MASRRSLVAAALALLPLVHAQNPGAADAGNPKLTTYKCTTAGGCVKQDTSVVIDWNYHWIHTANGYDSCTTSSGVDSSLCPDAATCARNCVIEPANYTSAGVATSGDTLTMHQYIKSDGEYVNASPRLYLLGSDGDYVMMKLLGQELTFEVDLSTLPCGENGALYLSEMSATGGRNEYNKGGAEYGSGYCDAQCPVQTWKNGTLNTNGSGFCCNEMDILEGNSRANSFTPHPCSSTDCDKGGCGFNPYALGQQNYWGPGGTVDTFKPFTVTTQFITSDGTQTGTLKEIRRQYIQNGKEWCTSGASFGGLTTMGQALGRGMVLAFSIWNDNSQFMNWLDSGSNGPCSSTEGNPDLIKAQNPTTHVVFSNIRWGDIGSTFSNPGGSSSSSTTRIVTITKPTTVFPTSTKTTTIQAPTTTTTASGATQTQWGQCGGQGWSSPTACATPYTCQAQNAWYSQCV

SEQ ID NO: 4409 - protein, 319 aa, Aspergillus clavatus
  strain ATCC 1007 / CBS 513.65 / DSM 816 / NCTC 3887 / NRRL 1
MFVYTLIFLFLAAANAYSNPGPCSGNCWTHDPGLYQRKSDGKYFLFATGGGIHISSADDLAGPWTDDGFVLPDGSSIDLDGQNNLWAPDLHYRDGTYYLYYSVSALGSQNSAIGVATSETLEAGSWTDHGSTGVTSTPNSPYNTIDGNWIAVGDKQYLNFGSYWQNLFQVELADGLKVKEGATPHQLSYNASGIHRQEAAFMFERNSYFYLTFSGGVALGYNATWPAQGEEYHINVCRSTSATGGFVDKNGVSCLNSGGSLLLASHGFVYGPGGQGILEDRNKELVLYYHYADTRIGKAVEDYQFGWNQLKWENDWPSV

SEQ ID NO: 4410 - protein, 792 aa, Aspergillus clavatus
  strain ATCC 1007 / CBS 513.65 / DSM 816 / NCTC 3887 / NRRL 1
MSAIKSIATVLAAILPSVLAQANTSYADYNTEANPDLTPQSVATIDLSFPDCDNGPLSKTIVCDTLTSPYDRAAALISLFTLEELVNATGNTSPGVPRLGLPPYQVWNEALHGLDRAYFTDEGQFSWSTSFPMPILTMSALNRTLINQVASIISTQGRAFSNAGRYGLDVYSPNINSFRHPVWGRGQETPGEDAYCLSSAYAYEYITGIQGGVDPKSLKLVATAKHYAGYDIENWDGHSRLGNDMNITQQDLSEYYTPQFLVAARDAKVRSVMCSYNAVNGVPSCANSFFLQTLLRDTFGFVEDGYISSDCDSAYNVFNPHEYAANVSSAAADSIRAGTDIDCGTTYQYYFDEAVDQNLLSRADIERGVIRLYSNLMRLGYFDGNSSAYRNLTWNDVVTTNSWNISYEVEGTVLLKNDGTLPLSESIRSIALVGPWMNVSTQLQGNYFGPAPYLISPLDAFRDSHLDVNYAFGTNISSNSTDGFSKALSAAKKSDAIIFAGGIDNSLEAETLDRMNITWPGKQLELIDQLSQLGKPLIVLQMGGGQVDSSLLKSNKNVNSLIWGGYPGQSGGQALLDIITGKRAPAGRLVVTQYPAEYATQFPATDMSLRPHGNNPGQTYMWYTGTPVYEFGHGLFYTTFRVSHARAVKIKPTYNIQDLLAQPHPGYIHVEQMPFLNFTVDITNTGKASSDYTAMLFANTTAGPAPYPKKWLVGFDRLPTLGPSTSKLMTIPVTINSMARTDELGNRVLYPGKYELALNNERSVVLPLSLTGKPAVLSKWPLEEQLIPLAKS

SEQ ID NO: 4411 - protein, 887 aa, Aspergillus clavatus
  strain ATCC 1007 / CBS 513.65 / DSM 816 / NCTC 3887 / NRRL 1
MLRSLLLLAPMVGAAVAATEPNSPACPGYRATNVREGHNSLTADLTLAGKPCNTYGTDLKNLKLLVEYQTDERLHVKIYDANEQVYQVPESVVPRVDGKGGSRKKSVLKFNFKANPFSFQVKRGREVLFDTSGSNLVFQDQYLNLRTSLPRDPNLYGLGEHTDPLRLTTTNYTRTLWNRDSYGIPENSNLYGSHPVYYDHRGEDGTHGVFLLNSNGMDIKIDKTKDGKQFLEYNALGGIFDFYFFNGDTPKDASIEYAKVAGLPAMQSYWSFGFHQCRYGYRDAFEVAEVVQNYTQAKIPLETMWTDIDYMDRRRVFTLDPDRFPLEKVRELVSYLHKHDQKYIVMVDPAVSVSDNKGFNDGMEQGVFMKHQNGSLYKGAVWPGVTAYPDWFHPDIQKYWDGQFNDFFSPEKGVDIDGLWIDMNEAANFCTYPCLDPEGYSIENNLPPAAPPVRPNPRPLPGFPDDFQPPAASKRSVAKGSKVGLPGRDLLNPRYQIRNDAGLISSKTINTDLIHAGEGYAEYDTHNLYGTMMSSASRQSMAQRRPAVRPLIITRSTFAGAGTHVGHWLGDNLADWKHYRISIAQMLSFASMFQVPMVGSDICGFGGDTNEELCARWARLGAFYPFFRNHNEITSIPQEFYRWESVAESARKAIEVRYKLLDYVYTAFHRQTQTGEPFLQPMFYMYPEDKNTFSNDMQFFYGDSILVSPVHDVSQTSVEAYFPKDIFYDWNTGDVLRGRGAKVTLSNISVTDIPIHIRGGSIVPIRSESAMTTVELRKKGFELLIAPGQDGTASGTLYLDDGDSLKQSASLELEFKYRKGNLQIKGKFGMHTDLKINAITLLGQTSVPRQVTLSRAGKADSKFDPARQSVTIKTDLSLNESSEIDIN

SEQ ID NO: 4412 - protein, 437 aa, Aspergillus clavatus
  strain ATCC 1007 / CBS 513.65 / DSM 816 / NCTC 3887 / NRRL 1
MSIDINWRTATSGPDGEALAERIRSFIHDRFQQVALPRFIRSVQVHSFDFGTIPPELEIKDFCEPFADFYEEDDDADTSDVSEDLLSEHSSQWDRTHSELNEPPYREESAMNHGLRDPFHEGFPPSPLRSPLGEHLNPHFLPRAGTPGIPGGTSNLGYHLMSLGGLSGTQTPLAAVAGGNPFASGWSDSGMGFGNRGRSERQGPIPQHRPEPEIDTSNSTSRPSTANTLPSHLSESNNLNADGATGRNERGSLHNGDPLADHTCSGHLPLPPRMRERRPEDFQVLCHAKYAGDVRLSLTAEILLDYPMPSFVGLPLKLNVTGITFDGVAVVAYIRKRVHFCFLSAEDADALIGSEQQQESGGDDHRPRSGADSSAHTSQKRQGGLLQEIRVESEIGRKENGKQVLKNVGKVERFVLAQVRRIFEEELVYPSFWTFLI

SEQ ID NO: 4413 - protein, 300 aa, Aspergillus clavatus
  strain ATCC 1007 / CBS 513.65 / DSM 816 / NCTC 3887 / NRRL 1
MRYSWLIGAACAAGALAKPLDKRSYITDWTIITVTETITLAPQAAPTAPVSKVDPFPVPVPVPVPAPVEPEPPVVVTTAAPAPVPTTTAGTVEELPDTSSEWTSTWTSSAASRVVEPTTLVTAAPTAAPTAPANPGNAYQAAILYNHNIHRSNHSVSSLTWNATLESSAQALAAQCIYRHDTDISGGGYGQNIGYGVSSEEIGAMITNLMYNDEFGYYQNLYGQANPDMTYFEKWGHFSQILWKGSVSVGCATVVCPLLGNVDSSAPSPFTVCNYYPPGNYAGEYAENVLPPIGRAFYAA

SEQ ID NO: 4414 - protein, 721 aa, Aspergillus clavatus
  strain ATCC 1007 / CBS 513.65 / DSM 816 / NCTC 3887 / NRRL 1
MFRVGSWLYGKKPANASTQSLDSLVELRDPATLILNDDVDGAEDGLAEGTSSFHNLGRGVVAFIRATLGFEQDIMRQASERLNEAETTASVDQHRAQHNSQAPNTYHSAMYTPGTEFALCQAMAQLMGAVVGVLNESLTESIKGFYRLRKAYITLDAILKMEQKYLQESRMATPIESAAPGSIPLSMKRQGSSNLQSSSSSISSAKIKKAASSATTLAAPVENTDLSERLTGLNLSSETLAPGDVKEASTLGPADMLNHDPDSDIFHNQIDIFVHSGSNFCFGILLLLISMVPPAFSKLLSIIGFHGDKERGLRMLWQASKFHNLIGAIAAFSVLGYYNGFVRYCDIMPDSIPGQDEDVQGYPQERLELLLAKMRKQFPKSQLWVLEESRMCGANKNLDRALELLCGGESSPLKQVEALRLFERSLNAMYLHKYELCAASFLECFELNTWSRSLYYYITGSCHLSLYRNALDKDPAKAAEHAELAEKYFRLAPPLAGKKRFMARQLPFDVFVARKVAKWEARAKDWKVPLVDAVGVDPIEEMIFFWNGHSRMTDEHLLESLQKLAWCESSANKTWSREGPEEKAILKLLRAAVFRSLRKHSQAKDLLEDILSQDRNLFKGHLKDDWICPVAHFEMAANMWMERPTYIAIHGGSKEFTDPEATEPADSSKSLEYEREKVHKCKEYLEKAAKWESYELDARIGLKVTAAMEAVQKWENTHPPA

SEQ ID NO: 4415 - protein, 505 aa, Aspergillus clavatus
  strain ATCC 1007 / CBS 513.65 / DSM 816 / NCTC 3887 / NRRL 1
MTTFTKLSEQETPSIAVHASRRISKINPNIYAGFTEHMGRCIYGGIYDPGNPLSDENGFRKDVLEALKELNIPVVRYPGGNFMATYHWIDGVGPKDQRPSRPELAWLGTETNQFGTDEFMKWCELLGTEPYFCLNFGTGTLDEALAWVEYCNGTRDTYYANLRRKNGREEPYNIKYWALGNEVWGPWQVAQTTKEEYAHKAYQWAKALKLLDPTLKLILCGQDGTASWDYYTLKHCILPVNSPLSTSAVPLIDMHSIHLYTSSSSHLPNVTAPLAAERAIEITSSLIDLAMIENGVPNTQLRPTICFDEWNVWDPIRAEGSKGAEESYTLSDALAVAVWLNVFVRKSKDVGMACIAQTVNVISPLMTTKDGIIKQTTWWPLYLFSKYMRGWTINTHVSCGTYEGETAPSWVRTVKDTPWLDVSATLGEDGYVNVAVVNISEDKDIESKFEGAAGEVAVFTVNGDSVSACNMNGKQEVGVTESTWDGKGAYAFPKHSLTLLRWKAE

SEQ ID NO: 4416 - protein, 310 aa, Aspergillus clavatus
  strain ATCC 1007 / CBS 513.65 / DSM 816 / NCTC 3887 / NRRL 1
MSGRTLLLSPPSLSSQPERLNGILQSYDRKTTDLQMLDRLILGVVNLPDAAYSRIIILAGEEDSISESSKLTTRETFSHIARSLQKGGYICSQHEQQGQAFDHNEAVLVGLIPTDNGKFVKPDIEDMRAVPLRLGRKKHDKTISSNLAEPVRNHQASPTVAQDQAEDGFRYSSGRNIVTASAHETSDNEIIDEEDLLDGSELAAPIIQPPECRPKAGRRRRACKDCTCGLAQKLEEEDAMRRHAADKQLGAMKLSHGDLAEVDFTVQGKVGSCGNCSLGDAFRCEGCPFIGLPAFQPGEEIRLLNDDIQL

SEQ ID NO: 4417 - protein, 257 aa, Aspergillus clavatus
  strain ATCC 1007 / CBS 513.65 / DSM 816 / NCTC 3887 / NRRL 1
MAPITDEAVNGLKDMIGKLEARVQELEGRLVGDLKPKSTAEQMRIILMGPPGAGKGTQAPRLKEKYCVCHLATGDMLRSQVAKKTELGKEAKKIMDQGGLVSDEIMVNMIKSELETNSECKNGFILDGFPRTVAQAERLDDMLEARKQKLQHAVELQIDDALLVARITGRLVHPASGRSYHKIFNPPKNEMLDDITGEPLIQRSDDNAETLKKRLSTYHAQTAPVVDYYKKTGIWRGIDASQEPGQVWKSLLGVFQK

SEQ ID NO: 4418 - protein, 867 aa, Aspergillus clavatus
  strain ATCC 1007 / CBS 513.65 / DSM 816 / NCTC 3887 / NRRL 1
MRFSWLEVAVTAASLANANVCIPLFPWYVSSPPFYPSPWANGQGEWAEAHQRAVEIVSQMTLTEKVNLTTGTGWMMEECVGQTGSVPRLGINWGLCGQDSPLGIRFSDLNSAFPAGINVAATWDKTLAYLRGKAMGEEFNDKGIDIQLGPAAGPLGKYPDGGRIWEGFSPDPALTGVLFAETIKGIQDAGVIATAKHYILNEQEQFRQVAEAQGYGYNITETLSSNVDDKTMHELYLWPFADAVRAGVGAIMCSYNQINNSYGCQNSQTLNKLLKAELGFQGFVMSDWSAHHSGVGAALAGLDMSMPGDISFDDGLSFWGANMTVGVLNGTIPAWRVDDMAVRIMTAYYKVGRDRLRVPPNFSSWTRDEYGYEHAAVSEGAWKKVNDFVNVQRDHAQLIREVGSASTVLLKNVGALPLTGKERKVGIFGEDAGSNPWGPNGCENRGCDNGTLAMAWGSGTAEFPYLVTPEQAIQSEVIKNGGNVFPVTHNGALTQMANIASQSSVSLVFVNADAGEGFISVDGNIGDRKNLTLWKNGEEVIKTVASHSNNTVVVIHSVGPILVDEWHDNPNITAILWAGLPGQESGNSIADVLYGRVNPSAKTPFTWGKTRESYGAPLVTKPNNGNGAPQDDFSEGVFIDYRYFDKRNETPVYEFGFGLSYTSFGYSHLRVQPLNGSTYVPATGTTGPAPAYGSIGSAADYLFPEGLKRITKFIYPWLNSTDLKASSADPNYGWEDSEYIPEAATDGSPQPILKAGGAPGGNPTLYHDLVKVSATITNTGNVAGYEVPQLYVSLGGPNEPRVVLRKFDRIHLAPGEQKVWTTTLTRRDLANWDVEAQDWVITKYPKRVYVGSSSRKLPLRAPLPRVQ

SEQ ID NO: 4419 - protein, 241 aa, Aspergillus clavatus
  strain ATCC 1007 / CBS 513.65 / DSM 816 / NCTC 3887 / NRRL 1
MKFNLALALSLTVATAEAATELCKQWDSIIEGNFIVYNNLWGQGNADDGGHQCTTVKSISGDTVVWSTEWAWSGGPGQVKSYANAALQFTPTTLSSVSSIDSTWKWRDSYTGSDIVANVAYDMFLSSSATGSEEYEIMVWLAALGGAGPISSTGSPIATPTINGVQWDLYLGPNGAMQVYSFVAPSSTENFAGDMKGFIDYLTSEQGLSKDLYLLDVQAGTEPFSGSDAVLTVSEYSVNLA

SEQ ID NO: 4420 - protein, 322 aa, Aspergillus clavatus
  strain ATCC 1007 / CBS 513.65 / DSM 816 / NCTC 3887 / NRRL 1
MFARQPLRFAQPLKQGFRKYSTEAPAKGKSSLAPIYISVGLAGLGVGLYRYSTASAETPVVDRPKVFTGGEQGWVDLKLSEIENLSHNTKRLRFEFADKEAVSGLQVASALLTKFKPAEGKPVIRPYTPVSDEDQPGYLDLVVKVYPNGPMSEHLHSMNVDQRLEFKGPIPKYPWETNKHKHICLIAGGTGITPMYQLARQIFKNPEDQTKVTLVFGNVSEEDILLKKELQELENTHPRRFKAFYVLDNPPKEWTGGKGYVTKELLKTVLPEPKEEDIKIFVCGPPGMYKAISGPKVSPKDQGELTGLLAELGYNKDQVYKF

SEQ ID NO: 4421 - protein, 415 aa, Aspergillus clavatus
  strain ATCC 1007 / CBS 513.65 / DSM 816 / NCTC 3887 / NRRL 1
MLSRLSQTALVALSLMTVLTEAVPSRMRIQTRDSVNYQSEIVRGVNLGGWLVLEPWITPSIFENGGGAAVDEWTLAEVLGKDKARAILSQHWSSFITQDDFNQIAQAGMNHVRIPVGYWAVSAPDEPYVDGQLEFLDNAISWARAAGLKVMIDLHGAPGSQNGFDNSGRKGPIAWQQGDTVARTVDAFKALAERYLPESDVVTAIEAVNEPNIPGGVNEGQLKEYYNQVLEVVHSINPDAGVFLSDGFLATASWNGYANGENVVMDTHHYHMFDNTLISLDINAHVRAACEFGNQIKGSDKPVVVGEWTGALTDCTKHLNGKDIPTRYEGQWANSPRYGDCGNKRQGSSSGLSEQERSDTRRFIEAQLDAYEGKNGWLFWTWKTEGAPGWDMQDLLANGLFPNPPTERQYGNQCA

SEQ ID NO: 4422 - protein, 253 aa, Aspergillus clavatus
  strain ATCC 1007 / CBS 513.65 / DSM 816 / NCTC 3887 / NRRL 1
MHTHTSSRLLELLLWFQFCLASHASITTLSAAVTPTIPHPPSYTSPELFKDTILSASNTYRRNHNASELTWNETLTKYARDWAEGCKWRHSDGPYGENLAFGYADPITAVSAWGDEGQKYNFKLPTGFTEETGHFTQLVWRATKEVGCAAVDCGYSDGSDAKDKHGQYTRAQGWYVVCEYSPAGNVIGNNNAFFRVNVQSTSTYSGPTATGAETGAVATSTGTSGVGGMYDNRYLGAETRNVLVGLMLFVNMV

SEQ ID NO: 4423 - protein, 257 aa, Aspergillus clavatus
  strain ATCC 1007 / CBS 513.65 / DSM 816 / NCTC 3887 / NRRL 1
MKLVQSLSFILSLLPATLAEVQFTVPAFGTSFKSGDVVTAHWKELGTSPRISELTHYDLYLYAGGETADTQMEIASLIRDGMFARGNSVSFKIDPHFGGSQTNAYFLKMVSFGPEAFAINFSERFTLNNMTGSFPPQLVEDIRSLPDSEDYPVKEDLRKRVIQTAHTVPYALQTGPTRYAPMAKKPGSTIPAKAKTPTPQFSASLYTIATTWLPVATVHMTLSTSMTFSVVSIENTASPAPHPHDMAARKLLERWKD

SEQ ID NO: 4424 - protein, 724 aa, Aspergillus clavatus
  strain ATCC 1007 / CBS 513.65 / DSM 816 / NCTC 3887 / NRRL 1
MGALTWLSVVAAAASTALAMTPEKMISAPRRSEVIPNPSGEIGVFSTSQYSFEKHKRSSWWSLLDLKTGQSKILTNDSSVSEILWLGTDDSTLLYVNGTNADVPGGVELWVTQVSSFTNGYKAASLPAAFSGFKTVTTKSGDIRFVAYAQSYANGTAYNEELVEKPLSSARIYDSIYVRHWDSYLTTTFNAVFSGTLKKGNNKKGYTLDGAVKNLVSPVRNAESPYPPFGGASDYDLSPNGKWVAFKSKAPELPKANFTTAYIYLVPHDGSEKAFAINGPDSPGTPKGIKGDANSPVFSPNSEKLAYLQMKDETYEADRRVLYVYSIGSKKTIPSVAGNWDRSPDSIKWTPDGKTLIVGSEDKGRSRLFAIPATARDDFKPKNFTDGGAVSAYYFLPDRSLLVTGTAIWTNWNVYTASPAKGVIKTLASANEIDPELKGLGPSDVSEIYFKGNWTDIHAWVVYPENFDKSKKYPLAFLIHGGPQGSWADSWSSRWNPKTFADQGYVVVAPNPTGSTGFGQKLTDEIQNNWGGAPYDDLVKCWEYVNKNLPFVDTEHGIAAGASYGGFMVNWIQGNDLGRRFKALVSHDGTFVADAKISTDELWFMQREFNGTFWDARDNYRRFDPSAPEHIRQFGTPQLVIHNDKDYRLAVAEGLSLFNVLQERGVPSRFLNFPDENHWVVNPENSLVWHQQVLGWINKYSGIEKSNPGAVSLDDTIVPVVNYN

SEQ ID NO: 4425 - protein, 211 aa, Aspergillus clavatus
  strain ATCC 1007 / CBS 513.65 / DSM 816 / NCTC 3887 / NRRL 1
MKFALLALAAVALASPVTLDERQIAIPENELRTGPCEPITFIFARASTEPGLLGISTGPGVCNGLKLARPFKVACQGVGPAYTADLASNFLPQGTTQVAIDEATDLFKLAASKCPDTQIVAGGYSQGTAVMHGAIRNLPDNVKNLIRGVVLFGDTRNKQDGGRIPNFPTDRTKIYCALGDLVCEGTLVITAAHFTYTVNVPGAVAFLLSKL

SEQ ID NO: 4426 - protein, 308 aa, Aspergillus clavatus
  strain ATCC 1007 / CBS 513.65 / DSM 816 / NCTC 3887 / NRRL 1
MAPFSFLLTLLLYTLSAGASVLESRSSALLPRAGSLQQVTNFGDNPTNVGMYIYVPNNLASNPGIIVAIHYCTGTAEAYYNGSPYAKLAEKHGFIVIYPESPYQGKCWDVSSRASLTHNGGGNSNSIANMVKWTIKKYKTNTSKVFVTGSSSGAMMTNVMAATYPDMFAAGVVYSGVAAGCFMSNTNQQAAWNSTCAHGKSIATPEAWAHVAKAMYPGYDGPRPRMQIYHGSADTTLYPQNYQETCKEWAGVFGYDYNAPRSVENNKPQANYKTTTWGKELQGIYATGVGHTVPINGDRDMAWFGFAK

SEQ ID NO: 4427 - protein, 446 aa, Aspergillus clavatus
  strain ATCC 1007 / CBS 513.65 / DSM 816 / NCTC 3887 / NRRL 1
MRIANLIMAASAAGLVSAYPTREMAKKRASGFSWVGVNVSGGEFGSNIPGKLGTDYTWPDISKIQTLRETGMNIFRVPFLMERLVPGSMTGSPDATYLGDLKKVVQSITDSGAYAILDPHNYGRYSGSIISPSDFKVFWKTIASEFASNDKVIFDTNNEYHDIDQTVVLNLNQAAIDGIRAAGATAQYIFVEGNHWTGAWTWTDNNDNLKGLKDPQGKIVYEMHQYLDADGSGTSESCASPTIGKERMQSATQWLKKNGLKGFLGEFAGGVNSQCETAVDGLLSYMSDNSDVWLGAEWWAAGPWWGSYMYSLEPGSGPAYSTYLPILEKYFVKGSGSGSGSGSSSSSSSSSSSSTTTSSSTTNVAPSKPTTTAAPTTSAPTQPPAVEPSPSAPKAPSSAPPKGAPTAPEVAAKHWYQCGGINWTGPTSCESGYTCTEMNPYYYQCV

SEQ ID NO: 4428 - protein, 632 aa, Aspergillus clavatus
  strain ATCC 1007 / CBS 513.65 / DSM 816 / NCTC 3887 / NRRL 1
MATVRICVCGDEGTGKSSLITSLVKGVFVTNKIQPVLPQITIPPTIGTPENVTTTTVVDTSALPQERNNLAREIRKSNVILLVYSDHYSYERVALFWLPYFRSLGVNVPVVLCANKSDLAAEHSEAQVIEEEMLPVMAEFKEIDSCIRTSAREHRNVNEAFFLCQKAVTHPIAPLFDTKESALKPAAVAALQRIFYLSDKDRDGYLSDKEIGDFQMRCFDKPLSTEDLVHIKEIIQKTHPGSVTPFGIDCRGFIHLNKMYAEKGRHETVWIILRAFQYTDNLSLQESFLHPRFEVPPYASAELSPEGYRFFVNLFLLSDKDNDGGLNDAELASLFAPTPGLPASWADGSFPSSTVRNEAGHVTLQGWLAQWSMTTFQSPKTTLEYLAYLGFESSDRSNPSTTAALKVTRPRKRRKRPGRVGRNVVLGHVLGAPGSGKSALLDAFLSRGFNSTYRPTIQPRTTVNTVELPGGKQCYLILDELGELEPAILENQAKLLDQCDVIVYTYDSSDPDSFAYIPQLRANHPHLEELPSVFVALKADLDRTTQRAEHQPHEYTAMLNMPSPPLHVSATWSSIQEVFVHIAEAAMEPSTAFPRSEEDVEGKWMAWGIALGAVVCAGAAAVMIWRRVSGGG

SEQ ID NO: 4429 - protein, 71 aa, Aspergillus clavatus
  strain ATCC 1007 / CBS 513.65 / DSM 816 / NCTC 3887 / NRRL 1
MKFLNILTLAFITGMASAAAVPGGTTTNDAASTLDNLNNKRSVCGQLCFNNKDCGGPCPKCNTKEGVCVKK

SEQ ID NO: 4430 - protein, 526 aa, Aspergillus clavatus
  strain ATCC 1007 / CBS 513.65 / DSM 816 / NCTC 3887 / NRRL 1
MARLSLLTLLALGSAALAKKDTFQTKCAALQHKVKLPNVHVNFVEYVPGGTNLDLPDNAPSCGASSQAVSTDMCRIAMAVDTSDSSQITLEAWFPRDYTGRFLSTGNGGLSGCIQYYDLAYAAGLGFATVGANNGHNGTSGEPFYQHPEVVEDFAHRSVHTGVVVGKQLTKLFYDKGFKKSYYLGCSTGGRQGFKSVQKYPKDFDGIVAGAPAFNFVNLISWSAYFYSLTGSNTSESYLSPAMWKIAHDEIVRQCDELDGAKDGIIEDTDLCHPRLETIICKPGAKDTANCLTGAQAKTVRDVLSPMYGVNGTLLYPRMQPGSEVYAAGIMYNGEPFQYSTDWYRYVVYNNPDWDDTKWSVEDAAAALAQNPYDIQTFDADISSFRGAGGKVLTYHGLQDQMISSDNSKLYYARVAETMKLPPSELDEFYRFFPVSGMTHCAGGDGAYGIGNGLGSYNGVDPENNVLMAMVQWVEKGIAPEFIRGAKFAEGPGSAVEYTRKHCRYPRRNVYKGPGNYTDENAWECV

SEQ ID NO: 4431 - protein, 234 aa, Aspergillus clavatus
  strain ATCC 1007 / CBS 513.65 / DSM 816 / NCTC 3887 / NRRL 1
MANVALIGATGMVGGHILSTLLESPAVARVDTISRKTPPAAASAPQAKLTTFVSDDTSRWASQLSALTPTPSIFMSAFGTTRAAAGGFDNQYKVEHGLNVEMARAARDAGTKVYVLISSSGASKTSSFAYPRMKGEIEDDVKALGFERTVILRPGLISGQREESRPAEAAVRFIAGFAGKIYSGLKDGWAQDADVIARAAVNAGLKALEGDVPAGSEKVWVLTGSDIIRFGGKN

SEQ ID NO: 4432 - protein, 932 aa, Aspergillus clavatus
  strain ATCC 1007 / CBS 513.65 / DSM 816 / NCTC 3887 / NRRL 1
MRIREQTILALLSPGLPPVTGQHVLDLSEPGWTVSSKALNRTVPGRLPSQVHLDLFEAGVIATMGSMILTFAGLRMPTGRTPATLLLGCELTDHESTWLVFDGLDTFTTITFCDQIIGSTYNQFRQYHFDVSQVLKECKQEGPVLSINFGSAPNIANAIANGPSAEEWPAGVQITNEYPNRWYIRKEQSDFGWDWGPAFAPAGPWKPAYIVQNKNPDRLYVLNTDLDIYRRGQINHLPPDQSQSWVVNASIDVLGSVPQWPSMSVEIKDAYSGVVLSSGLLENVTVSGNSVTGVTVVDGRTPKLWWPNGMGDQSLYNVTIAVHNHRNQVVAEVMKRTGFRTIFLNQRNITEEQLAQGVAPGANWHFEINGREFYAKGSNIIPPDAFWPRVTPSRMERLFDAVTAGNQNMLRVWASGAYLHDFIYDLADEKGILLWSEFQFSDALYPVDDAFLENVAAEVVYNVRRVNHHPSLALWAGGNEIESLMLPMVRRADHKGYAKYVGEYEKLYISLILPLVYENTRSITYSPSSTTEGYLHVNLSAPVPMTERYSNTTPGSYYGDTDYYNYDTSVSFNYHKYPVGRFANEFGFHSMPSLQTWQQAVDPKDLYFNSSVVVLRNHHYTAGGLFTDNYQNSSRGMGEMTMGVESYYPIPSKSDPVANFSAWCHATQLFQADMYKAQIQFYRRGSGMPERQLGSLYWQLEDTWQAPTWAGIEYDGRWKMLHYVARDIYEPIIVSPFWNYTTGDLEVYVTSDLWEPAQGTVNLTWVDLSGKSIAGNAGTPESIPFSVGALNATDVYSANVADLSPPDLTDSILILSLAGEGYLPNARTRSEFRHENQFTPVFPKDLALRDPKLELAYNPDTRTFTVEATAGVSLYTWLDYPAGVVGYFEQNGFVLLPGMKKEIGFVVQEGSVDEDWMRSVTVTSLWDQKVRE

SEQ ID NO: 4433 - protein, 394 aa, Aspergillus clavatus
  strain ATCC 1007 / CBS 513.65 / DSM 816 / NCTC 3887 / NRRL 1
MKTTTLVAALLPLVLAAPNTKRSSGFVWFGANESGAEFGESNLPGILGKDYIWPSASTIRTLHDGGMNVFRVAFRMERLIPNKMTGSPDGTYMNDLRSTVEAITSLGAYAVIDPHNYGRYYGNIITSTDDFAAFWKTLASEFASNDHVIFDTNNEYNTMDQTLVLNLNQAAINAIRASGATSQYIFVEGNSWSGAWTWTDINDNMKALTDPQDKIVYEMHQYLDSDGSGTSPSCVSSTIGKERMVAATQWLKDNNKKGFLGEFAGGPNDVCKSAVTGMLDYMSLNTDVWMGAEWWAAGPWWADYMFSMEPPSGTGYQNYFNLLKPYFSTSSSSPSPSTTTTTKATTTTTTAAGPTGTGVAQPWAQCGGSGYSGPTQCAAPYTCTKQNDWYSQCL

SEQ ID NO: 4434 - protein, 539 aa, Aspergillus clavatus
  strain ATCC 1007 / CBS 513.65 / DSM 816 / NCTC 3887 / NRRL 1
MLPSTISYRIYKNALFFAALFGAVQAQKVGTSKAEVHPSMAWQTCAADGTCTTKNGKVVIDANWRWVHDVKGYTNCYTGNTWNAELCPDNESCAENCALEGADYAATYGATTSGNALSLKFVTQSQQKNIGSRLYMMKDDNTYETFKLLNQEFTFDVDVSNLPCGLNGALYFVSMDADGGLSRYTGNEAGAKYGTGYCDSQCPRDLKFINGLANVEGWTPSSSDANAGNGGHGSCCAEMDIWEANSISTAYTPHPCDTPGQAMCNGDSCGGTYSSDRYGGTCDPDGCDFNSYRQGNKSFYGPGMTVDTKKKMTVVTQFLTNDGTATGTLSEIKRFYVQDGKVIANSESTWPNLGGNSLTNDFCKAQKTVFGDMDTFSKHGGMEGMGAALAEGMVLVMSLWDDHNSNMLWLDSNSPTTGTSTTPGVARGSCDISSGDPKDLEANHPDASVVYSNIKVGPIGSTFNSGGSNPGGSTTTTKPATSTTTTKATTTATTNTTGPTGTGVAQPWAQCGGIGYSGPTQCAAPYTCTKQNDYYSQCL

SEQ ID NO: 4435 - protein, 221 aa, Aspergillus clavatus
  strain ATCC 1007 / CBS 513.65 / DSM 816 / NCTC 3887 / NRRL 1
MVSFSSLALALSTVVGVLAAPGSEKYVELAKHQLTHSQTGTKNGYYYSFWTDNRGQVSYTNGKGGQYSVNWKDCGNFVAGKGWNPASAKTVTYSGNWKPSGNSYVSVYGWTQNPLIEFYIVESFGSYNPSTGATELGTVESDGGTYKIYKTKRVDAPSIEGKKTFDQFWSVRTSHRVGGTVTTKNHFNAWAKSGLKLGTFNYMILATEGYHSSGSATMTVS

SEQ ID NO: 4436 - protein, 402 aa, Aspergillus clavatus
  strain ATCC 1007 / CBS 513.65 / DSM 816 / NCTC 3887 / NRRL 1
MVHLPSIAAALAALPLVYGAGLNTAAKAKGLKYLGSATDNGELSDAPYVAQLSNTEDFGQLTPGNSMKWDATEPSQNSFSYAGGDAIVNLAQANGQLMRCHTLVWHSQLPNWVSSGTWTNATLIAAMKNHITNVMTHYKGKCYAWDVVNEALNEDGTYRDSVFYRVIGEAFLPIAFATAAAADPNVKLYYNDYNIENPGNKATGAQRIVKLVQSYGAKIDGVGLQAHFIVGSTPSQSDLTTTLKGYTSLGVEVAYTELDIRMQMPSSSAKLAQQSADYQSVAAACVTTPGCIGITIWDWTDKYSWVPSVFSGYGDACPWDSNYVKKPAYNGILAGLGAGSSTGTTSSSTLTTTTKTSTTTGATTTGVSQKWGQCGGSGWNGPTTCVSGTTCQKQNDWYSQCL

SEQ ID NO: 4437 - protein, 829 aa, Aspergillus clavatus
  strain ATCC 1007 / CBS 513.65 / DSM 816 / NCTC 3887 / NRRL 1
MTAKFDVDHVLNSISEDDKIALLSGTDFWHTYSIPEHNVPPIRTTDGPNGVRGTKFFAGVPAACLPCGTALGATWDRDLLHKAGVLLGQECLAKGAHCWLGPTINMQRSPLGGRGFESFAEDPHLSGTMAKSIILGCESTGVISAVKHYVGNDQEHERRAVDVMVTPRALREIYLRPFQIVARDAHSGALMTSYNKINGKHVVENPAMYDIIRKEWKWDPLIMSDWLGTYTTIDSLNAGLDLEMPGPSRYRGKYIESAVQARLVKQSTIDQRARKVLEFAARASQAPASAVESGRDYPEDRALNREICGNSIVLLKNEDTLLPLPKKIKKIALIGSHVKTPAISGGGSASLQPYYAVSLYDAIIEVLPDTEIIYETGAYAHKMLPVIDRMLSNAVIRFYNEPADKERTLLSTEPVNNTAFQLMDYNTPGLNRTLFWATLDGEFTPDVSGLWDFGLTVFGTATLYIDDEMVIDNTTQQTRGTAFFGKGTIQEVGAKELTAGRTYKIRIEFGSANTSPIKAIGVVHFGGGAAHLGAFLHMDPEQMVRDAVKAASEADYTILCTGLNRDWESEGFDRPDMDLPPRIDALISAVLDVAGDKTIIVNQSGTPVMMPWSDRARAIIQAWYGGNETGHGIADVLFGDVNPCAKLPLSWPADVRHNPAYLNSLSVGGRMLYGEDIYVGYRFYEKIGQVTLFPFGHGLSYTLFEVSPKVTVSPTAFTVETPLSATVRIKNTGPVAGAQILQLYVAAPTSATPRPVKELQGFSKVFLQSGEEKTVVISVDKYATSFWDGIEDMWKSEAGVYQVLIGTSSQDIVARGEFTVDETTFWTGV

SEQ ID NO: 4438 - protein, 132 aa, Aspergillus clavatus
  strain ATCC 1007 / CBS 513.65 / DSM 816 / NCTC 3887 / NRRL 1
MLYNKLITIAALLVPALAAPQGLDVRDCDYTCGSHCYSASAVSDAQSAGYQLYSAGQSVGRSRYPHQYRNYEGFNFPVSGNYYEWPILSSGSTYNGGSPGADRVVFNDNDELAGLITHTGASGNGFVACSGW

SEQ ID NO: 4439 - protein, 177 aa, Aspergillus clavatus; identical to SEQ ID NO: 4358
  strain ATCC 1007 / CBS 513.65 / DSM 816 / NCTC 3887 / NRRL 1

SEQ ID NO: 4440 - protein, 516 aa, Aspergillus ficuum
MLNPKVAYMVWMTCLGLTLPSQAQSNDYRPSYHFTPDQYWMNEPNGLIKIGSTWHLFFQHNPTANVWGNICWGHATSTDLMHWAHKPTAIADENGVEAFTGTAYYDPNNTSGLGDSANPPYLAWFTGYTTSSQTQDQRLAFSVDNGATWTKFQGNPIISTSQEAPHDITGGLESRDPKVFFHRQSGNWIMVLAHGGQDKLSFWTSADTINWTWQSDLKSTSINGLSSDITGWEVPDMFELPVEGTEETTWVVMMTPAEGSPAGGNGVLAITGSFDGKSFTADPVDASTMWLDNGRDFDGALSWVNVPASDGRRIIAAVMNSYGSNPPTTTWKGMLSFPRTLSLKKVGTQQHFVQQPITELDTISTSLQILANQTITPGQTLLSSIRGTALDVRVAFYPDAGSVLSLAVRKGASEQTVIKYTQSDATLSVDRTESGDISYDPAAGGVHTAKLEEDGTGLVSIRVLVDTCSVEVFGGQGEAVISDLIFPSDSSDGLALEVTGGNAVLQSVDVRSVSLE

SEQ ID NO: 4441 - protein, 614 aa, Aspergillus ficuum
MKGTAASALLVALSATAAQARPVVDERFPYTGPAVPIGDWVDPTINGNGKGFPRLVEPPAVKPATANPRNNVNVISLSYIPKGMHIHYQTPFGLGQLPAVRWGKDPRNLNSTAQGYSHTYDRTPSCSQVKAVTQCSQFFHEVSIDGLEPDTTYYYQIPAANGTTQSEVLSFKTSRPAGHPGSFSVAVLNDMGYTNAHGTHKQLVKAATEGTAFAWHGGDLSYADDWYSGILACADDWPVCYNGTSSTLPGGGPLPEEYKKPLPAGEIPDQGGPQGGDMSVLYESNWDLWQQWLNNVTLKIPYMVLPGNHEASCAEFDGPHNILTAYLNDDIANGTAPTDNLTYYSCPPSQRNFTAYQHRFRMPGPETGGVGNFWYSFDYGLAHFVSIDGETDFANSPEWNFAEDVTGNETLPSESETFITDSGPFGNVNGSVHETKSYEQWHWLQQDLAKVDRSKTPWVIVMSHRPMYSSAYSSYQLHVREAFEGLLLKYGVDAYLSGHIHWYERLYPLGANGTIDTAAIVNNNTYYAHNGKSITHIINGMAGNIESHSEFSDGEGLTNITALLDKVHYGFSKLTIFNETALKWELIRGDDGTVGDSLTLLKPSHVAGGKKLHS

SEQ ID NO: 4442 - protein, 303 aa, Aspergillus ficuum
MLSTHLLFLATTLLTSLFHPIAAHVAKRSGSLQQITDFGDNPTGVGMYIYVPNNLASNPGIVVAIHYCTGTGPGYYSNSPYATLSEQYGFIVIYPSSPYSGGCWDVSSQATLTHNGGGNSNSIANMVTWTISEYGADSKKVYVTGSSSGAMMTNVMAATYPELFAAGTVYSGVSAGCFYSDTNQVDGWNSTCAQGDVITTPEHWASIAEAMYPGYSGSRPKMQIYHGSVDTTLYPQNYYETCKQWAGVFGYDYSAPESTEANTPQTNYETTIWGDNLQGIFATGVGHTVPIHGDKDMEWFGFA

SEQ ID NO: 4443 - protein, 307 aa, Aspergillus flavus
MILLSYLLTYLLCALTCSARAIHNGRSLIPRAGSLEQVTDFGDNPSNVKMYIYVPTNLASNPGIIVAIHYCTGTAQAYYQGSPYAQLAETHGFIVIYPESPYEGTCWDVSSQATLTHNGGGNSNSIANMVTWTTKQYNADSSKVFVTGTSSGAMMTNVMAATYPNLFAAGVAYAGVPAGCFLSTADQPDAWNSTCAQGQSITTPEHWASIAEAMYPDYSGSRPKMQIYHGNVDTTLYPQNYEETCKQWAGVFGYNYDAPESTESNTPEANWSRTTWGPNLQGILAGGVGHNIQIHGDEDMKWFGFTN

SEQ ID NO: 4444 - protein, 461 aa, Aspergillus flavus
MRSLSSIALLSVVGAASAQAGPWAQCGGKSFSGSSACPSGWTCEELNEWFSQCVPGAASTTAAVSSIPTPSVTPSVSITASVSTGINKSISTVSKSTPLPSSSSASPTPRPTGSGSFAKADGAQFSIDGETKYFAGTNAYWLPFQMNDADIDAVFDHLEQTGLKILRVWGFNDVNTAPSPGTVYFQLHDKAKGTSTINTGKDGLQRLDYVVAAAEKHGVKLIIPFVNSWDDYGGFNAYVTAYGGSKTEWFTNEKIQSVYQAYIKAVVSRYRNSPAIFAWELGNEPRCNGCSPDVIHGWATKTSAYIKSLDPNHMVALGDEGMGLTIGSDQSYPYSTTEGNDFEKNLAIPDIDFGTLHLYTTDWGIKDNAWGNGWVENHAKACKAAGKPCLFEEYGMKGNHCTDELKWQKTSLSSGTAADLFWQYGQKLSTGESPNDQYTIYYGTDDWKCAVMDHMENVNKN

SEQ ID NO: 4445 - protein, 403 aa, Aspergillus flavus
MQSIKRTLLLLGAVLPAVLAGPIFPHRRAPTTIPGKYIVTFKSDVDQAAIDKHTAWATDIHKRNLQRRDSSEEDLPIGIERNFKINKFAAYSGSFDEDTIAQIRQSDEVAAVEEDQVWHLFDLTTQSDAPWGLGSISHKGQPSTDYIYDTNGGEGTYAYVVDIGINVDHEEFEGRASLAYHAAGGQHVDGVGHGTHVSGTIGGKTYGVAKKANLLSVKVFVGESSSTSIILDGFNWAANDIVSKKRTGKAAINMSLGGGYSKAFNDAVENAFNEGVLSIVAAGNENTDASRTSPASAPDAFTVAAINVNNTRAYFSNYGSVVDIFAPGQNILSAWIGSNTATNTISGTSMATPHIVGLSIYLMSLEVLSSPKAVSDRIKELATRGVVSNVAGSPNLLAYNGNA

SEQ ID NO: 4446 - protein, 363 aa, Aspergillus flavus
MQLLQSSVIAATVGAALVAAVPVELEARDSCTFTSAADAKSGKTSCSTITLSNIEVPAGETLDLTGLNDGTTVIFSGETTFGYKEWEGPLISVSGTNIKVQQASGAKIDGDGSRWWDGKGGNGGKTKPKFCYVHKLDSSSITGLQIYNTPVQGFSIQSDNLNITDVTIDNSAGTAEGHNTDAFDVGSSTYINIDGATVYNQDDCLAINSGSHITFTNGYCDGGHGLSIGSVGGRSDNTVEDVTISNSKVVNSQNGVRIKTVYDATGTVSNVKFEDITLSGITKYGLIVEQDYENGSPTGTPTNGIKVSDITFDKVTGTVESDATDIYILCGSGSCTDWTWSGVSITGGKTSSKCENVPTGASC

SEQ ID NO: 4447 - protein, 366 aa, Aspergillus flavus
MHFQLLVLAPLALSSAAAPAPSRTSELVERGSSCTFTSAAQASASAKSCSNIVLKNIAVPAGETLDLSKAKDGATITFEGTTTFGYKEWKGPLIRFGGNKITVTQAAAVIDVQGSRWWDGKGPNGGKTKPKFIQYPQLESPTITGLHVKNSPVQVFSVQGNDVHLTDITIDNSDGDNNGGHNTDAFDVSESNGVYITGANVKNQDDCLAINSGENIEFTGATCSGGHGISIGSIGNRDTNTVKNVKVADSTVVDSDNGIRIKTISGATGSVSGVTYENITLKNIKKNGIVIELDYKNGGPTGKPTTGVPITDLTVNGVTGSVASKATPVYILCGKGSCSDWTWKGVSISGGKKSDKCQNIPSGASC

SEQ ID NO: 4448 - protein, 68 aa, Aspergillus flavus
DPATCEKEAQFVKQELIGQPYTDAVANALQSNPIRVLHPGDMITMEYIASRLNIQVNENNEIISAHCA

SEQ ID NO: 4449 - protein, 213 aa, Aspergillus flavus
  strain ATCC 200026 / FGSC A1120 / NRRL 3357 / JCM 12722 / SRRC 167
MHLRNIVIALAATAVASPVDLQDRQLTGGDELRDGPCKPITFIFARASTEPGLLGISTGPAVCNRLKLARSGDVACQGVGPRYTADLPSNALPEGTSQAAIAEAQGLFEQAVSKCPDTQIVAGGYSQGTAVMNGAIKRLSADVQDKIKGVVLFGYTRNAQERGQIANFPKDKVKVYCAVGDLVCLGTLIVAPPHFSYLSDTGDASDFLLSQLG

SEQ ID NO: 4450 - protein, 492 aa, Aspergillus flavus
  strain ATCC 200026 / FGSC A1120 / NRRL 3357 / JCM 12722 / SRRC 167
MKRSALILSFLPLVFGCDNPKSPGHSCASVYSVSSAAASSFCATFTASTVTATTGVPEALLSNCDYKTKHLSSACSCLGTAAVPTVATPSSVSSVYITSATATPTSFTFKTSTAHIVKVAKAATSSTAVVTTPVSVPTASSSFTGNGGTTCTVTEYAAISSAVASCSNILLSDIYAPPSSTIDLQGLQTGAAVIFAGKTTFGDTADSDFDPIVVSGTSVTITGVEGHVIDGNGAAYWDGQGSNGGSDKPDHFFVVKDMYNSRIENLYIQNWPVHCFEIESTEHLTVSGLTLNNSAGDAANSKSDGDPAAHNSDGFDIKESSYFTLENTWVHNQDDCVAVTSGTDIVVDGMYCYGGHGLSIGSIGGKSDNTVNGVTFSNSQVISSQNGCRIKTNSGETGEVYNIRYENITLSDISDYGIDVQQDYLNGGPTGEPTNGVTIANVTFVDVTGTMSDGKDYYILCGDDSCSNFVFDGVSITGGSGDNCNYPSTGCP

SEQ ID NO: 4451 - protein, 333 aa, Aspergillus flavus
  strain ATCC 200026 / FGSC A1120 / NRRL 3357 / JCM 12722 / SRRC 167
MKFRNLFFAAVAGSAVAAPLAKEQKKRDSVFQWIGANESGAEFGENNLPGVWGTDYIFPDVSAITTLIDKGMNIFRIQFKMERLVPDSMTGAYDEAYLQNLTTVVNAVTDAGVHAILDPHNYGRFNGEIMSTPSDFQTFWKNLAGQFQSNSLVIFDTNNEYHDMDQELVLNLNQAAIDGIREAGATEQYIFVEGNSYTGAWTWTDVNDNMKNLEDPQDKIVYQMHQYLDSDGSGTSETCVSGTIGQERVTSATQWLKDNKKVGIIGEFAGGNNDQCKTAVKGMLDYLAENTDVWKGALWWAAGPWWGDYMYSLEPPNGVAFTGMLDVLQAYLG

SEQ ID NO: 4452 - protein, 534 aa, Aspergillus flavus
  strain ATCC 200026 / FGSC A1120 / NRRL 3357 / JCM 12722 / SRRC 167
MRLITRWIPLANALASTMPVQVVASIENPSLLPTPPMGFNNWARFMCDLNETLFVETTDAMASNGLLEAGYNRINLDDCWMNYDRAENGSLEWNVTKFPRGLPWLGQYVKSKGFNFGIYEDSGNLTCGGYPGSEGYEEIDAETFAAWGIDYLKLDGCNVYPKEGRTLQEEYKYLYGNWHEILSKMQQPLIFSESAPAYFSMTDNLTDWHTVMDWVPEYGELARHSVDILVYSGEGSAWDSIMTNYKFNTLVARYQRPGYYNDPDFLIADHPGLSLDEKRSQFALWASFSAPLIISAHIPDLSSEDLEYLTNQALIAVDQDPLAQQATLASRDGSLDVLTRNLADGSRLVTILNHGSESIETDISLDILGLSTDCTYKAQDLWGGSTQTIKDAIRIKLNTHATAVYKIDTDEKCSQVIPTGLIFNTASGKCLTGTSSSVGSESCNGSKSQIWQIDASGVIRTLSEQSKCLTADGKAISLQECSENNGQKWSYAITGNLKNADTGYCLTNGGGVSACGFETNSQVFGLPAGVHVAL

SEQ ID NO: 4453 - protein, 242 aa, Aspergillus flavus
  strain ATCC 200026 / FGSC A1120 / NRRL 3357 / JCM 12722 / SRRC 167
MLPKAVLLSLLASMALGASEFPIPESAGTETFSEPQEIAAGETFDGGLKTYGRGVECTGQDEGGDSDAVFILQEGATLKNAIIGADQIEGVHCEGACTIENVWWEKVCEDALSLKKGSGPYKVIGGGAQGAEDKVIQHNAEGEVSIDGFVVSDFGKLFRSCGNCDSQSQRSVTITNVKAYNGKKLAGVNENYGDVATITDTCATSVEDICTTYEATEGSGEPSEIGSGPSDSCVYTDPLPAC

SEQ ID NO: 4454 - protein, 367 aa, Aspergillus flavus
  strain ATCC 200026 / FGSC A1120 / NRRL 3357 / JCM 12722 / SRRC 167
MKSSTFGMLALAAAAKLVSAHATVHAVWINDVDQGEGNSESGYIRSPPSNSPITDVTSKDMTCNVNNKATAKTLEVKAGDKITFEWHHDSRSDSDDIIASSHKGPIMVYMAPTEKGTAGNGWVKIAEDGYTDGTWAVDTLIKNRGKHSVTVPDVAAGEYLFRPEIIALHEGNRQGGAQFYMECVQVKVTSSGSKTLPEGVSIPGAYTATDKGILFDIYNSFDSYPFPGPAVWDGASGSSSSPSASASASAPAATSAAPAPSSFTTIAKQPATSSTEAPSTENTSTTSTIVSTTAAASATAPATPSSTSAIASSAASTNSVPQPSSNAGGAVKEWYQCGGLNYKGSTQCEEGLTCKKWNPYYYQCISA

SEQ ID NO: 4455 - protein, 602 aa, Aspergillus flavus
  strain ATCC 200026 / FGSC A1120 / NRRL 3357 / JCM 12722 / SRRC 167
MRGAFLAAAAAVAGTAMADVAHMRRHGHDSFHHNRAYQPEVPAEGDENCECTTKVITITGPPTLVPINTPAPEPSSSSSSEVPSVPSSESSVVTSEAVTTLHSTSTATVTVVTTPGVDATGAQTPTGGVPGTPEASSPAGTPEASTPAVPATSESPLPTPGVTSFSSTGIYTIPATTVTVRDTTTVCGATTTELPSGTHTFGGVTTVVSTATTVTCPVATVEPSGSTVTSKIYTTTYVCPSAGTYTIAPTTTYVPTSTVVVYPTPATITPGTYTQDEQTVTVTRTDFTYVCPFTGNDQPTSAPVASTSAVPVTTTAAPSTTSAVASSSASASSTATAVPTGVSGQQMGMTYSPYTNEGGCQSKDQVLKDVALIKQKGFTHVRVYSTDCNGLEYIGEAARENGLKMIIGVFISSTGISGAQEQVTAITKWAQWDLVTLVVVGNEAIQNGYTDASSLAGFISSCKSSFQASGYSGQVTTTEPINVWQQSGSALCGAVDILGANLHPFFNADVTPDQAGSFVRAQIKDLEAVCNKDVINLETGWPSAGNANGKAVPGTAQQAAAIKALVEEVGSQSVFFSYSNDLWKDAGEFDVERYWGCIDQFK

SEQ ID NO: 4456 - protein, 279 aa, Aspergillus flavus
  strain ATCC 200026 / FGSC A1120 / NRRL 3357 / JCM 12722 / SRRC 167
MFIIPSFKHTNPIRCSTPCLQLMLILILANLANTQQTIQTTILVTATPTSPHPPSYTSPEVFRDTILSSSNTYRKEHNASDLVWNETLTRYAKDWAEGCKWKHSVRPTFLLYLSHGPYGENLAFGYQNASAAVFAWGDERRMYDFKKPTGFTEETGHFTQLVWRATTDVGCAAIDCGYGNGTDENEKRGDTGSYTRAQGWYVVCEYSPPGNVMGTSRTAGGENGLFRVNVQSASTYSGPYPTDSGSPPASTGASGADRTFMACGWIWVWVGVLILMVMG

SEQ ID NO: 4457 - protein, 797 aa, Aspergillus flavus
  strain ATCC 200026 / FGSC A1120 / NRRL 3357 / JCM 12722 / SRRC 167
MPGAASIVAVLAALLPTALGQANQSYVDYNIEANPDLFSECLETGGTSFPDCESGPLSKTLVCDTSAKPHDRAAALVSLLTFEELVNNTANTGHGAPRIGLPAYQVWNEALHGVAHADFSDAGDFSWSTSFPQPISTMAALNRTLIHQIATIISTQGRAFMNAGRYGLDVYSPNINTFRHPVWGRGQETPGEDAYCLASTYAYEYITGIQGGVDANPLKLIATAKHYAGYDIENWDNHSRLGNDMQITQQDLAEYYTPQFLVASRDAKVHSVMCSYNAVNGVPSCSNSFFLQTLLRDTFDFVEDGYVSGDCGAVYNVFNPHGYATNESSAAADSIRAGTDIDCGVSYPRHFQESFHDQEVSRQDLERGVTRLYASLIRAGYFDGKTSPYRNITWSDVVSTNAQNLSYEAAAQSIVLLKNDGILPLTTSSSTKTIALIGPWANATTQMLGNYYGPAPYLISPLQAFQDSEYKITYTIGTNTTTDPDSTSQSTALTTAKEADLIIFAGGIDNTLETEAQDRSNITWPSNQLSLITKLADLGKPLIVLQMGGGQVDSSALKNNKNVNALIWGGYPGQSGGQALADIITGKRAPAARLVTTQYPAEYAEVFPAIDMNLRPNGSNPGQTYMWYTGTPVYEFGHGLFYTNFTASASAGSGTKNRTSFNIDEVLGRPHPGYKLVEQMPLLNFTVDVKNTGDRVSDYTAMAFVNTTAGPAPHPNKWLVGFDRLSAVEPGSAKTMVIPVTVDSLARTDEEGNRVLYPGRYEVALNNEREVVLGFTLTGEKAVLFKWPKEEQLIAPQ

SEQ ID NO: 4458 - protein, 877 aa, Aspergillus flavus
  strain ATCC 200026 / FGSC A1120 / NRRL 3357 / JCM 12722 / SRRC 167
MLGSLLLLAPLAGAAVIGSRADTKQCPGYKASNVQENDRSLTADLTLAGKPCNTYGTDLQNLKLLVEYQTDERLHVKIYDAEERVYQVPEKVTPRVDSGDGSSKDSALKFEYEEEPFSFTVKRDDEVLFDSSAENLIFQSQYLKLRTWLPENPYLYGLGEHTDPLRLSTTNYTRTFWNRDAYGTPANSNLYGTHPVYYDHRGESGTHGVFLLNSNGMDVFIDKTADGKQYLEYNALGGIFDFYFFTGSNPKEASIEYSKIVGLPAMQSYWTFGLHQCRYGYRDVYQVAEVVYNYTKAGIPLETMWTDIDYMDRRRVFSLDPDRFPLEKMRELVGYLHDHDQHYIVMVDPAVSVSDNGAFNRGLEQDVFLKTQNGSLYKGAVWPGVTAYPDWFHPDIQDYWNSEFSTFFNAETGVDIDGLWIDMNEASNFCPDPCTDPERYSSENNLPPAPPPVRSSSPRPLPGFPADFQPSSASRSQKRIVKAKVGLEGRDLLNPPYKIRNEAGSLSNKTINTGIVHAGEGYAEYDTHNLYGTMMSSSSREAMQYRRPEVRPLVITRSTYAGAGRDVGHWLGDNFSKWEHYRISIAEGLAFASMFQVPMVGADVCGFAGNTTEELCARWASLGAFFTFYRNHNEIGNIGQEFYVWPTVAESARKAIDIRYRLLDYIYTSFYKQSQTGEPFLQPVFYLYPEDENTFSIDLQFFYGDAILVSPVPDKGLTSVDAYFPDDIFYDWYTGTPVRGHGANITLSNIDITHIPLHIRGGSIIPIRSSSAMTTTELREKSFQLIIAPGLDGTASGSLYLDDGDSLEQKATLEVEFEYRKGVLHIDGKFELHASLVESVTLLGQGKGGSRARREDGTKKTIQTNLELSKPTEIKLE

SEQ ID NO: 4459 - protein, 432 aa, Aspergillus flavus
  strain ATCC 200026 / FGSC A1120 / NRRL 3357 / JCM 12722 / SRRC 167
MSIEVDWRAATSGPDGEALAERIRSFIHDKFQQVALPRFIRSVQVHSFDFGTIPPDLEVKDICEPFADFYEEDEDDETSDVSEELVSGHGTQWHRDLNEPPFHEEMAMNRPLRDPFDEAFHSSTLRSPMEHLNPHFLPRAGTPGIPGGTSTLGYHLMSLGGLSGTQTPLAAVAGGTPFANGWTDPGMGASSRGHPSISGPTAVHPSRMEADIDTSNPTSRPSTSSTLPSHPSASNQPSGDATTGKEHGSLAEDEHLDDPMTSGHPLRLPPRMRERRPEDFQVLCHAKYAGDVRLSLTAEILLDYPMPSFVGLPLKLNVTGITFDGVAVIAYIRKRVHFCFLSAEDADALIGSDQQEARGQDDRPWSSADPTASPKRQGGLLREIRVESEIGRKEDGKQVLKNVGKVERFVLAQVRRIFEEEMVFPSFWTFLI

SEQ ID NO: 4460 - protein, 437 aa, Aspergillus flavus
  strain ATCC 200026 / FGSC A1120 / NRRL 3357 / JCM 12722 / SRRC 167
MLITKTAFLAFLLSSVPLAHGAGGNSSSPDARGRRCVVRSSNGTADDSPEVSRVFAQCATNSVIVFQEGVDYNIFQPIKATNLSNVEIQMHGNLHLPQNISAVRDIVNAGTSTWFTLEGPRVDWTGPEDVNNGWIKSYGQAWWDANPPNGTGISGRPHLMSYKTSQATIKYFRSGKPIAWNMKLHGEDIAVSHAIVDASSTGSFPFNTDAFDVQGTNIRISDSIMYNGDDAIAVGSDSHNIVFERNTIGYQSHGMSIGSLGKDASAFANITNLRFEDVTVIDALYAARFKSWTGGQGLVKNVTWKNIRVYNVTFPIFVTQSYYDQSVSRDGVDTESSVMMEDFTWEDFSGSINSYQPGDGSCATDPCWYNAGLPNLKHTEALVIECNTDKSCKNFVTKNIQLYPQVLEPASVICMKATAELNPNLGFNCSNGTFTSA

SEQ ID NO: 4461 - protein, 566 aa, Aspergillus flavus
  strain ATCC 200026 / FGSC A1120 / NRRL 3357 / JCM 12722 / SRRC 167
MAFNFNWSPLMADASFYTRAQDLLTAALNKSPKPPIIVDDIIVTELNLGSIPPDLEILEIGDLAEDRFRGIFKMSYTGDAFLTLKTRVQANPLNTYLLTRPSFASPLPLAAATPLTIPLQITLSDFKLSGFVILVFSKQKGITVVFRNDPLESLKVSSTFDSIPFVRDFLQREIEAQLRILFMDELPAIIHRLSLRLWVPEYRAGEDIQTQPEQTAGEGPGQDPLASPPQDPVDSLGNALDESEIASLSLDSSVEAHSLFSQKNLLRLGALTDSQRTLSLFTPSIQEVVYRAWTSPSEQGDANGISTAPLSPMLSRTHSQVGSMSSFQDSASIVSSQSRSSASTHTFSGYGLNLGAGRHSKAHSRKRKKRVVDLRRPKTTSDTASVSDESAYTETASNPSVCSAPLPVVNEQPDPITPPLSPESDFRLPAIPERRRASLSRPVPRRDIATEMLRETGGPSAEPPRHRPQPADVDATPRGSLRAHITAQHDNEKQETGPSRQLPSTILPFTDEKSSSSTVDQALVERLAGEIARRMRDEKLMPTSSCGGAFWGRPDHEEYPPPAYGQ

SEQ ID NO: 4462 - protein, 403 aa, Aspergillus flavus
  strain ATCC 200026 / FGSC A1120 / NRRL 3357 / JCM 12722 / SRRC 167
MQSIKRTLLLLGAILPAVLGAPVQETRRAAEKLPGKYIVTFKPGIDEAKIQEHTTWATNIHQRSLERRGATGGDLPVGIERNYKINKFAAYAGSFDDATIEEIRKNEDVAYVEEDQIYYLDGLTTQKSAPWGLGSISHKGQQSTDYIYDTSAGEGTYAYVVDSGVNVDHEEFEGRASKAYNAAGGQHVDSIGHGTHVSGTIAGKTYGIAKKASILSVKVFQGESSSTSVILDGFNWAANDIVSKKRTSKAAINMSLGGGYSKAFNDAVENAFEQGVLSVVAAGNENSDAGQTSPASAPDAITVAAIQKSNNRASFSNFGKVVDVFAPGQDILSAWIGSSSATNTISGTSMATPHIVGLSLYLAALENLDGPAAVTKRIKELATKDVVKDVKGSPNLLAYNGNA

SEQ ID NO: 4463 - protein, 405 aa, Aspergillus flavus
  strain ATCC 200026 / FGSC A1120 / NRRL 3357 / JCM 12722 / SRRC 167
MLPLLLCIVPYCWSSRLDPRASSFDYNGEKVRGVNLGGWLVLEPWITPSIFDAAGAEAVDEWSLTKILGKEEAEARLSAHWKSFVSAGDFQRMADAGLNHVRIPIGYWALGPLEGDPYVDGQLEYLDKAVEWAGAAGLKVLIDLHGAPGSQNGFDNSGRRGAIQWQQGDTVEQTLDAFDLLAERYLGSDTVAAIEAINEPNIPGGVDQGKLQEYYGSVYGIVNKYNAGTSVVYGDGFLPVESWNGFKTEGSKVVMDTHHYHMFDNGLIAMDIDSHIDAVCQFAHQHLEASDKPVIVGEWTGAVTDCAKYLNGKGNGARYDGSYAADKAIGDCSSLATGFVSKLSDEERSDMRRFIEAQLDAFELKSGWVFWTWKTEGAPGWDMSDLLEAGVFPTSPDDREFPKQC

SEQ ID NO: 4464 - protein, 146 aa, Aspergillus flavus
  strain ATCC 200026 / FGSC A1120 / NRRL 3357 / JCM 12722 / SRRC 167
MYTPSIIQGLLLAITLVSSSSAKLGINCRGSANCNTFGNTQMAFQLKRAIDGIDPNRWYNNGEHIACVGSGARITGNGGFCAFLQNTGGTNGAVIKSLAHYIPEHGCKVCGSVPYFYPQGNNNVDDGELTFNYVDNACTKDEAKLC

SEQ ID NO: 4465 - protein, 140 aa, Aspergillus flavus
  strain ATCC 200026 / FGSC A1120 / NRRL 3357 / JCM 12722 / SRRC 167
MLATVFLIVASALTANAKLGINCRGSAKCSVLWGPSDAAQQLTNVIQHIDTNRWYMNGEHIACVGNQAGNGGGYCAFLQKTGGTNGGVIKNLAHYITDHGCKQCGSVPYYFPQGNNNVDDGELTYNYVDDPCATAGTQLC

SEQ ID NO: 4466 - protein, 984 aa, Aspergillus flavus
  strain ATCC 200026 / FGSC A1120 / NRRL 3357 / JCM 12722 / SRRC 167
MRLLSFIYLVWLALLTGTPQVSATDNGKTSDVAWDKYSLSVKGERLFVFSGEFHYQRLPVPELWLDVFQKLRANGFNTISVYFFWSYHSASEDVFDFTTGAHDIQRLFDYAKQAGLYVIARAGPYCNAETSAGGFALWAANGQMGSERTSDEAYYKKWKPWILEVGKIIAANQITNGGPVILNQHENELQETTYDSNDTKVIYMEQVAKAFEEAGVVVPSSHNEKGMRTVSWSTDYKNVGGAVNVYGLDSYPGSLSCANPNSGFNLLRTYYQWFQNYSYTQPEYLAEFEGGWFQPWGGSFYDSCASELSPEFADVYYKNNIGSRVTLHNIYMTFGGTNWGHSAAPVVYTSYDYGSPLRETREIRDKLKQTKLLGLFTRVSKDLLKTYMEGNGTSYTSDDSIYTWALRNPDSDAGFYVVAHNTSSSREVTTFSLNITTSAGALTIPDIELDGRQSKIIVTDYSIGSESSLLYSSAEVLTYATLDVDVLVFYLNAGQKGAFVFKDAPADLKYQTYGNSNLSALETSQGTQYSYTQGEGVTAVKFSNGVLVYLLDKETAWNFFAPPTVSSPTVAPNEHILVFGPYLVRGASIKHDTVEIVGDNSNSTSIEIYTGDEHVKKVSWNGNLIDTRATAYGSLIGTVPGAEDIEISLPSLSSWKAQDTLPEISPDYDDSRWTICNKTTSVNSVAPLSLPVLYSGDYGYHTGTKIYRGRFDGQNATGANVTVQNGVAAGWAAWLNGAYVGGFSGDPDKVASWEVLKFNHSSLRSRDNVLTIITDYTGHDQNSQKPIGTQNPRGIMGATLIGGGNFTLWRIQGNAGGEKNIDPVRGPMNEGGLYGERMGWHLPGYQVPESALDSSPLEGVSGAEGRFYTTSFQLDLEEDLDVPIGLQLSAPAGTEAVVQIFMNGYQFGHYLPHIGPQSLFPFPPGVIYNRGQNSLAISMWALTDAGARLEQVELKAYAKYRSGFDFNRDWTYLQPGWKDRTEYA

SEQ ID NO: 4467 - protein, 254 aa, Aspergillus flavus
  strain ATCC 200026 / FGSC A1120 / NRRL 3357 / JCM 12722 / SRRC 167
MHLAIKSLFISLLGASVLASPLPSNALVERNAPLNEFLSALLSHLPAIDGTIDAVSGVITDFDQLLADLTGARTTQNGYIGVCTDYTVLFARGTSEPGNVGVLVGPPLSEAFEQAVGAKALSFQGVNGYNADVAGYLAGGDAAGSKSMASLASEVLSKCPDTKLVMSGYSQGCQIVHNAVEQLPAADASKISSVLLFGDPYAGKAFPNVDASRVHTVCHAGDTICNNSVVILPPHLTYAVDVTNAVQFAVAAAN

SEQ ID NO: 4468 - protein, 442 aa, Aspergillus flavus
  strain ATCC 200026 / FGSC A1120 / NRRL 3357 / JCM 12722 / SRRC 167
MQRYISLSVSLSLLSGANALVRPDGVGRLPALGWNTWNAFGCDIDASKVLTAAEETINLGLKDAGYEYINIDDCWSVKSGRDPNTKRIIPDSAKFPDGISGVASKIHDLGLKVGIYSSAGTETCAGYPASLGYEKIDAESFAEWGIDYLKYDNCGVPTNWTDTYTHCVPDNSNGSKFPNGTCPDISNPAPTAYDWSSSNTAQRYNAMRDALLGVNRTILYSLCEWGQADVNTWGNGTGNSWRTTGDITPDWSRIVEIANENSFLMNYADFWGYPDPDMLEVGNGNLTLEENRAHFALWAAMKSPLIIGTALDSINEEHLAILKNKPLLSFHQDPVIGRPAYPYKWGYNPDWTFDPAHPAEYWSGPSSTLGGTLVLMFNSEDSAKHRTAVWSEIPELKDSAEKGSGYRVTDIWTGEDLGCVKDQYDVELQSHDIAALVVGESC

SEQ ID NO: 4469 - protein, 428 aa, Aspergillus flavus
  strain ATCC 200026 / FGSC A1120 / NRRL 3357 / JCM 12722 / SRRC 167
MVLLHPLLTAAALLGASARAQSVVGTPFGFASGTTGGGNAAPAAPKDTNELKEWLADPNPRVIVIDKEFNFIGTEDTCTDCECCIPDSNTCGDAGQNAIKTEGSDWCGSYPATTCTYDNAGLEGMEVASDKTIIGVGDAGVIRGKGLRLVNGVSNIIIQNVHITELNPQYIWGGDAISLDGTDKIWVDHVKVSLVGRQMFVTGYESSGGVTVSNSEFDGQTKWSASCDGHHYWSVLGYGKGDQITFANNYIHHTSGRSPKIEFDSHWHAYNNFWENNSGHAFDVGEGANVLIEGNVFSNVKTPMNPEDTPGSTFAVNAQDASSCTSALGRPCIANELTSSGELSGNDEAVLSGWPKGEGDTKAMTTDKVPSYVKANAGVGKLGSGGSGAASSSASITPSPTSSAIPSSSATPSSSAYARRHYARHHHY

SEQ ID NO: 4470 - protein, 240 aa, Aspergillus flavus
  strain ATCC 200026 / FGSC A1120 / NRRL 3357 / JCM 12722 / SRRC 167
MKFLTPLVLSSLASAAALNRRADMCGQWDTTTTDKFTLYNNLWGEGNADSGSQCTGLDSDDGNTIAWHTSWTWTGGAGQVKSFANVAYNFEATQLSQLSSIPSTWKWENTGSDIVADVAYDLFTSSSADGDEEYEIMIWLAALGGAGPISSTGSAIATPTVGGQSWSLYSGPNGQMTVFSFVASSTTEDFSADLNDFLKYLQEEQGMPSSQYLTHVQAGTEPFSGSNVKFTTSSYSVSVA

SEQ ID NO: 4471 - protein, 633 aa, Aspergillus flavus
  strain ATCC 200026 / FGSC A1120 / NRRL 3357 / JCM 12722 / SRRC 167
MATVRICVCGDEGTGKSSLITSLVKGVFVTNKIQPILPQITIPPTIGTPENVTTTTVVDTSALPQERSNLAREIRKSNVILLVYSDHYSYERVALFWLPYFRSLGVNVPVVLCANKSDLAADHSEAQVIEEEMLPLMAEFKEIDSCIRTSAREHRNVNEAFFLCQKAVTHPIAPLFDSKESALKPAAVAALQRIFYLSDKDRDGYLSDKELEDFQMRCFEKPLSEEDLVHIKETIQKTHPTSVAPSGIDCRGFIHLNKMYAEKGRHETVWIILRAFQYTDNLSLQESFLHPRFEVPPYASAELSPEGYRFFVNLFLLSDKDNDGGLNDAELASLFAPTPGLPASWADGSFPSSTVRNEAGHVTLQGWLAQWSMTTFTSPKTTLEYLAYLGFESSDRSNPSTTAALKVTRPRKRRKRPGRVGRNVVLGHVLGPPGSGKSALLDAFLARGFSTTYHPTIQPRTAVNTVELPGGKQCYLILDELGELEPAILENQVKLLDQCDVIVYTYDSSDPDSFAYIPELRSKYPHLEELPSVFVALKADLDRTTQRAEYQPHEYTAMLNMPSSPLHVSVTWSSMQEVFVHIAEAAMEPSTAFPRSEEDVEGKWMAWGIALGAVVCAGAAAVMIWRRVSGSGT

SEQ ID NO: 4472 - protein, 430 aa, Aspergillus flavus
  strain ATCC 200026 / FGSC A1120 / NRRL 3357 / JCM 12722 / SRRC 167
MKSIYSLVLCTALTAASPHPAFPQSPLGVPTTSSPSTGTFNSAEEVINASPFLSFHRDIVQIESISSNEHNVGEFIADFLRARNFTVIEQAVTSSSQRENQERFNVFAYPSSNTPEILITSHIDTVPPFIPYSLDTDSTTDNDPSTIRISGRGSVDAKGSVAAQIFAALDVLEQNPSAPLGLLFVVGEETGGDGMRAFSESSLNPAPSAFHTVIFGEPTELALVSGHKGMLGFEIVAKGHAAHSGYPWLGRSAISAVLPALSRVDQLGNIPADKGGLPSSPKYGNTTVNIGRVDAGVAANVVPATARADVAVRLAAGTPDEARDIVRRAVRDATDGNPDVYAEFNTRSEGYPPQDLDTDVDGFDITTVNYGTDVPNLQIHEREDGPVRRYLYGPGSIHVAHGDNEAITVGDLQEAVRGYRKLIEAALQRR

SEQ ID NO: 4473 - protein, 768 aa, Aspergillus flavus
  strain ATCC 200026 / FGSC A1120 / NRRL 3357 / JCM 12722 / SRRC 167
MHAIAGLTGFLAGVSLSYAAPTQENITSDAYFYGQSPAVYPSPEGTGSGAWASAYEKAKAFVANLTPEEKVNLTAGTDADNGCSGNIPAIPRLNFPGLCVSDAGNGLRSTDHVNAWSSGIHTGASWNKDLAQKRGLHMGSEYHKKGVNVLLGPVVGPLGRIAEGGRNWEGFSVDPYHSGLLVYETIRGIQAAGVGTSTKHYIANEQETNRNPESTDGIDVAAVSSNIDDKTMHELYLWPFQDVVRAGSVSIMCSYQRINNSYGCQNSKTLNGLLKTELGFQGYVMTDWGAQHGGIASSNAGLDMVMPSSTLWNSNLTDAIANGTMEASRLDDMATRIIASWYQMNQDAGFPSPGIGMPADVYAPHQAIIGKSSDSRKVLLQSAIEGHVLVKNKNNTLPLKSPEMISVFGYDAKGPDSLGFALEWLSYSPAIQPNHTLIVGGGSGGNSPAYISAPLDALQQQVIEDGSSILWNISAQDPEVDPNTDACLVFINSYATEGYDRAGLVDEGSDELVTNVASKCSNTIVTIHNAGIRLVNNWIDHENVTAVIFAHLPGQDSGRALVELLYGRSNPSGKLPYTVAKNADDYGALLHPKLPEGQYGLFPQDDFSEGVYIDYRAFDKQGIEPQFEFGFGLSYTTFDYSGLNIGQVSDNSTSRYPPSAAIQEGGNPHLWDVILRVSVDITNSGPVAGDEVAQLYVGIPNGPVRQLRGFEKVNIPVGQTVTVEFALGRRDLSTWDVVAQEWLLQSGTYQVYVGRSSRDLPLQGEFTI

SEQ ID NO: 4474 - protein, 663 aa, Aspergillus flavus
  strain ATCC 200026 / FGSC A1120 / NRRL 3357 / JCM 12722 / SRRC 167
MRLRTSLGVASACASVASAALKVTEDNSTITLANDRLTSTFAKDKGRVSELFLDGQDLLGPISGNTGVGPYLDCYCIPSGFYTAGSTDPRLEVVQGTDSTGTKYAGVILNDTYTPTGQQFQQYWFLRDGETGLHTFSRLAYYNETTPFLRNLQEFRTLFRPNTELWTHLTSSEAQTAPLPSKEAIANEVVVQDATWRFNNTPNDAYYTQFSEYFTKYTFSNLWRDNSVHGLYADGTNSNGTTYGAWLVMNTKDTYYGGPLHSDLTVDGIVYNYLVSNHHGEGTPNITNGFDRTFGPQYYLFNGGKGSKSSLEDLRSEAETLADPGWNADFYDSIAKHVIGYAPSSKRGSVQGQVKLPKGSTRPIAILTVDGQYFQDNSVEASSHQYWAEMGQDGTFQLDHVKEGKYRLTVFADGIFGDFVHDGVEVQAGKVTKVQETWEQESAGVEVWRLGTPDKSSGEFLHGDAPDPTHPLHPPQHFIYWGAYDWQQDFPNGVNYTIGSSDPAVDFNTVHWSVYGPTPANPDVEYDTTHDWTINFSLDKKQLQQRKTATLTIQLAGAKTAAGNTDVYNATEPYANLALESYINEQKEPLTLLVGFNQSSSCIVRSAVSCYQVRSRMEFPADWLNVGNNVLTLHLPRNATDYETAVLPGTVYVQYDALRLELA

SEQ ID NO: 4475 - protein, 1005 aa, Aspergillus flavus
  strain ATCC 200026 / FGSC A1120 / NRRL 3357 / JCM 12722 / SRRC 167
MKLLSVAAVALLAAQAAGASIKHRLNGFTILEHPDPAKRDLLQDIVTWDDKSLFINGERIMLFSGEVHPFRLPVPSLWLDIFHKIRALGFNCVSFYIDWALLEGKPGDYRAEGIFALEPFFDAAKEAGIYLIARPGSYINAEVSGGGFPGWLQRVNGTLRSSDEPFLKATDNYIANAAAAVAKAQITNGGPVILYQPENEYSGGCCGVKYPDADYMQYVMDQARKADIVVPFISNDASPSGHNAPGSGTGAVDIYGHDSYPLGFDCANPSVWPEGKLPDNFRTLHLEQSPSTPYSLLEFQAGAFDPWGGPGFEKCYALVNHEFSRVFYRNDLSFGVSTFNLYMTFGGTNWGNLGHPGGYTSYDYGSPITETRNVTREKYSDIKLLANFVKASPSYLTATPRNLTTGVYTDTSDLAVTPLIGDSPGSFFVVRHTDYSSQESTSYKLKLPTSAGNLTIPQLEGTLSLNGRDSKIHVVDYNVSGTNIIYSTAEVFTWKKFDGNKVLVLYGGPKEHHELAIASKSNVTIIEGSDSGIVSTRKGSSVIIGWDVSSTRRIVQVGDLRVFLLDRNSAYNYWVPELPTEGTSPGFSTSKTTASSIIVKAGYLLRGAHLDGADLHLTADFNATTPIEVIGAPTGAKNLFVNGEKASHTVDKNGIWSSEVKYAAPEIKLPGLKDLDWKYLDTLPEIKSSYDDSAWVSADLPKTKNTHRPLDTPTSLYSSDYGFHTGYLIYRGHFVANGKESEFFIRTQGGSAFGSSVWLNETYLGSWTGADYAMDGNSTYKLSQLESGKNYVITVVIDNLGLDENWTVGEETMKNPRGILSYKLSGQDASAITWKLTGNLGGEDYQDKVRGPLNEGGLYAERQGFHQPQPPSESWESGSPLEGLSKPGIGFYTAQFDLDLPKGWDVPLYFNFGNNTQAARAQLYVNGYQYGKFTGNVGPQTSFPVPEGILNYRGTNYVALSLWALESDGAKLGSFELSYTTPVLTGYGNVESPEQPKYEQRKGAY

SEQ ID NO: 4476 - protein, 375 aa, Aspergillus flavus
  strain ATCC 200026 / FGSC A1120 / NRRL 3357 / JCM 12722 / SRRC 167
MKITSTIPAVLLGLAPLSAAVSVSGSAEGFASGVTGGGDAEAQIPSDIDELKEWLTDDTPRVIVLDKEYDFTESEGTTSGTVCASWGTGSGCQKIIQDDCGDSPSSQATWYTAGTTGIDVASDKTILGDGDKGVIKGKGLRFRDGVSNIIVQNIEISDLNPEYVWGGDALYFDGSDLIWIDHVTTARTGRQHYTFGYETNTRITLSNNFINGETTYSTGCDGYTYWTFEMVGEADQITLQNNYIYMTAGRSPALSGGTLLHAVNNVWEKNNGHALEGGDAGARGIFEGNAWIGVSTIVGDYAGRLFNAPDSSSAGDCESALGRACEVNAVSDSGDLTAYTDTSFFSDFSGLTIAPATSATDAQSSVPNNAGMGKL

SEQ ID NO: 4477 - protein, 455 aa, Aspergillus flavus
  strain ATCC 200026 / FGSC A1120 / NRRL 3357 / JCM 12722 / SRRC 167
MHQRALLFSAFWTAVQAQQAGTLTAETHPSLTWQKCAAGGTCTEQKGSVVLDSNWRWLHSVDGSTNCYTGNTWDATLCPDNESCASNCALDGADYEGTYGVTTSGDALTLQFVTGANIGSRLYLMADDDESYQTFNLLNNEFTFDVDASKLPCGLNGAVYFVSMDADGGVAKYSTNKAGAKYGTGYCDSQCPRDLKFINGQANVEGWEPSDSDKNAGVGGHGSCCPEMDIWEANSISTAYTPHPCDDTAQTMCEGDTCGGTYSSERYAGTCDPDGCDFNAYRMGNESFYGPSKLVDSSSPVTVVTQFITADGTDSGALSEIKRFYVQGGKVIANAASNVDGVTGNSITADFCTAQKKAFGDDDIFAQHGGLQGMGNALSSMVLTLSIWDDHHSSMMWLDSSYPEDADATAPGVARGTCEPHAGDPEKVESQSGSATVTYSNIKYGPIGSTFDAPA

SEQ ID NO: 4478 - protein, 506 aa, Aspergillus flavus
  strain ATCC 200026 / FGSC A1120 / NRRL 3357 / JCM 12722 / SRRC 167
MSSGLSLERACAVALGIVASASLVAAGPCDIYSSGGTPCVAAHSTTRALYSAYTGALYQVKRGSDGSTTDIAPLSAGGVADAATQDSFCANTTCLITIIYDQSGRGNHLTQAPPGGFNGPESNGYDNLASAVGAPVTLNGKKAYGVFMSPGTGYRNNAASGTATGDEAEGMYAVLDGTHYNSACCFDYGNAEVSNTDTGNGHMEAIYYGDNTVWGSGAGSGPWIMADLENGLFSGLSSKNNAGDPSISYRFVTAVVKGEANQWSIRGANAASGSLSTYYSGARPSASGYNPMSKEGAIILGIGGDNSNGAQGTFYEGVMTSGYPSDATENSVQADIVAAKYAIASLTSGPALTVGSSISLQVTTAGYTTRYLAHDGSTVNTQVVSSSSTTALKQQASWTVRTGLANSACFSFESVDTPGSYIRHYNFALLLNANDGTKQFYEDATFCPQAGLNGQGNSIRSWSYPTRYFRHYENVLYVASNGGVQTFDATTSFNDDVSWVVSTGFA

SEQ ID NO: 4479 - protein, 331 aa, Aspergillus flavus
  strain ATCC 200026 / FGSC A1120 / NRRL 3357 / JCM 12722 / SRRC 167
MKAIAALALVGGAIAAPTKTVESRQLPGMGSLPGLGSSGSSTGSGLGSLASMLPGLGGSSSGGSLPGLGSSTGSGLGSLASLIPGLGGSSSGSSLPGLGGSSLIPGLGGSSSSGSGIPGLGSSTGNIPDLSSLLGGSSSGGLPGLTKRASITENGVTQNAGCQELTFIFARGTSEMGNMGSVVGPPVAKQLASLTGNKVTVQGVDYPADAARGNQGNANMGASGGPKMAELIQQAKKQCPNTKVVVGGYSQGAMVVHNAASKVGADAISGAVLFGDPFKTQGVGQLASNKVKEFCASGDPVCLNGMNFMAHLSYGSNAQEAAQFLVQAAGL

SEQ ID NO: 4480 - protein, 655 aa, Aspergillus flavus
  strain ATCC 200026 / FGSC A1120 / NRRL 3357 / JCM 12722 / SRRC 167
MLPKIFYLSLLPAALGHPHLQPRLDNGLARTPQMGWNTYNHYSCSPNETIVRSNAQALVDLGLASLGYRYVTTDCGWTVADRLSDGSLTWNETLFPEGFPALGKYLHDLDLLFGVYQDSGIKLCGSPPDNVGNYEDQDARTFASWEVDSLKYDNCYSDAATGYPNVNYEPSTSPQPRFANMSRALAAQNRSMVFQVCEWGIDFPARWAPALGHSWRIGNDIIPHWRAIYRTLNQAVPQTSFAGPGQWPDLDMLFVGNDILSIPEEQTHFSLWAILKSPLTIGAALKDDETSINDESLQILKQADIIGYNQDSLGVSASLRRRWTEEGYEVWSGPLSGGRTVAALINWRNESRDLTLDLPDIGLQYAGTVKNIWDGTTAQNVKTSYTAKVQGHGTILLELQDTTASGQYPGDTFATSTGSSTTFESIYGVTTSFRYNITVKLSEASSSSDVKIQSTASNKTITAQVSASGTEASAQIPLLAGSSNSITIVSPQSVDAITITPPNGTYFPNTAFTTIGDADTVSCGAGYCQPVGSKIGNISTNGTARAVIPATAGTKYLAIDYINNDVAFDSAWDWGSNSRNLTVSVNGNKPVRIEVPLSGQHSELFGPGKGWWDTATIGVLTEGWKDGDNDVVIGNEGGESGFTSYGPDFVGLRVL

SEQ ID NO: 4481 - protein, 270 aa, Aspergillus flavus
  strain ATCC 200026 / FGSC A1120 / NRRL 3357 / JCM 12722 / SRRC 167
MIKSIILQAIMVLSTLTSVHGANSSGCGKQPTLVNGVHKINDREYILKVPDNYNANKPHHLIFGLHWRGGNMNSVVNGESVEPWYGLETRAQGSAILVAPNGRNAGWANTNGEDVALIDAIIKQVEDDLCIDQSSRFATGFSWGGGMSYALACARAKEFRAVSVLSGGVISGCEGGHDPIAYLGIHGISDPVLPFDGGVTLANKFAANNGCQQAYVGKPGLGSHSSVQTDFKGCSRPVSFIAYDGGHDAAPLGVGNPLAPDATWKFFMAA

SEQ ID NO: 4482 - protein, 363 aa, Aspergillus flavus
  strain ATCC 200026 / FGSC A1120 / NRRL 3357 / JCM 12722 / SRRC 167
MQLLQSSVIAATVGAALVAAVPVELEARDSCTFTSAADAKSGKTSCSTITLSNIEVPAGETLDLTGLNDGTTVIFSGETTFGYKEWEGPLISVSGTNIKVQQASGAKIDGDGSRWWDGKGGNGGKTKPKFFYAHKLDSSSITGLQIYNTPVQGFSIQSDNLNITDVTIDNSAGTAEGHNTDAFDVGSSTYINIDGATVYNQDDCLAINSGSHITFTNGYCDGGHGLSIGSVGGRSDNTVEDVTISNSKVVNSQNGVRIKTVYDATGTVSNVKFEDITLSGITKYGLIVEQDYENGSPTGTPTNGIKVSDITFDKVTGTVESDATDIYILCGSGSCTDWTWSGVSITGGKTSSKCENVPTGASC

SEQ ID NO: 4483 - protein, 358 aa, Aspergillus flavus
  strain ATCC 200026 / FGSC A1120 / NRRL 3357 / JCM 12722 / SRRC 167
MVLVATLFSLFTVSLCRSIPRSSPSSSPYTQATDLKIHDPTVINANGAYYAYGVGEHIVIHQAPGLAGPWKQIGSVLDKDSIIPKGDRAKPWAPTTIEVKGTFYCYYSVSNAGCRDSAIGVATSQSPGPGGWTDHGAIVQSGTGQGSDEHPFNEVNAIDPAVLVTGDKGHLVFGSYWSGIWQVPLNEDFSSVGNTTGLNAHHLAKHPKTERVNSQDQNPDPLCRDSSGRRPVEGAYISYHAPYYYLWLSWGQCCDYDPNNLPPSGEEYSIRVGRSESPHGPFVDKQGKELTQGGGELIYGSNNDVYAPGGQGVITVETGDILYYHYCESLFFRGLSEARLGYSYLGYVDGWPVIREAP

SEQ ID NO: 4484 - protein, 367 aa, Aspergillus flavus
  strain ATCC 200026 / FGSC A1120 / NRRL 3357 / JCM 12722 / SRRC 167
MHFQLLGLAALGSLAAAAPAPSRTSELVERGSSCTFTSAAQASASAKSCSNIVLKNIAVPAGETLDLSKAKDGATITFEGTTTFGYKEWKGPLIRFGGNKITVTQAAGAVIDGQGSRWWDGKGTNGGKTKPKFIYAHKLQSSTIKGLHVKNSPVQVFSVQGNDVHLTDITIDNSDGDNNGGHNTDAFDVSESNGVYITGANVKNQDDCLAINSGENIEFTGATCSGGHGISIGSIGNRDSNTVKNVKVADSTVVDSDNGIRIKTISGATGSVSGVTYENITLKNIKKNGIVIEQDYKNGGPTGKPTTGVPITDLTVNGVTGSVASKATPVYILCGKGSCSDWTWKGVSISGGKKSDKCQNIPSGASC

SEQ ID NO: 4485 - protein, 771 aa, Aspergillus flavus
  strain ATCC 200026 / FGSC A1120 / NRRL 3357 / JCM 12722 / SRRC 167
MKYSKLLLLLVSVVQALDVPRKPHAPTGEGSKRLTFNETVVKQAITPTSRSVQWLSGAEDGSYVYAAEDGSLTIENIVTNESRTLIPADKIPTGKEAFNYWIHPDLSSVLWASNHTKQYRHSFFADYYVQDVESLKSVPLMPDQEGDIQYAQWSPVGNTIAFVRENDLYVWDNGTVTRITDDGGPDMFHGVPDWIYEEEILGDRYALWFSPDGEYLAYLSFNETGVPTYTVQYYMDNQEIAPAYPWELKIRYPKVSQTNPTVTLSLLNIASKEVKQAPIDAFESTDLIIGEVAWLTDTHTTVAAKAFNRVQDQQKVVAVDTASNKATVISDRDGTDGWLDNLLSMKYIGPIKPSDKDAYYIDISDHSGWAHLYLFPVSGGEPIPLTKGDWEVTSILSIDQERQLVYYLSTQHHSTERHLYSVSYSTFAVTPLVDDTVAAYWSASFSANSGYYILTYGGPDVPYQELYTTNSTKPLRTITDNAKVLEQIKDYALPNITYFELPLPSGETLNVMQRLPPGFSPDKKYPILFTPYGGPGAQEVTKRWQALNFKAYVASDSELEYVTWTVDNRGTGFKGRKFRSAVTRQLGLLEAEDQIYAAQQAANIPWIDADHIGIWGWSFGGYLTSKVLEKDSGAFTLGVITAPVSDWRFYDSMYTERYMKTLSTNEEGYETSAVRKTDGFKNVEGGFLIQHGTGDDNVHFQNSAALVDLLMGDGVSPEKLHSQWFTDSDHGISYHGGGVFLYKQLARKLYQEKNRQTQVLMHQWTKKDLEE

SEQ ID NO: 4486 - protein, 303 aa, Aspergillus flavus
  strain ATCC 200026 / FGSC A1120 / NRRL 3357 / JCM 12722 / SRRC 167
MKAATLLSLLSVTGLVAAAPAGNGPAGGIIDRDLPVPVPGLPTKGLPIVDGLTGGNKGGEKPGSKVTPREDPTGSAPDGKGNDGPDGDLTGRPGQGGLDSPFDLPTSELPPVKLPGGLDGGKGGLGLRRRGSPVDGLPVVGPVVGGVLGGGGAGSGAGAKGGAGSGTVGRRGSPVDGLPVVGPVVGGVLGGGGAGSGAGAKGGAGSGTPKRRDGPVDGVPVVGELAEGATGGLLGGDAGSADAAGADAGAGAGAGKVGGGEGANAGGGVTDKTRFLRGKRKRTNLWDCLFKREVFNSASPAIP

SEQ ID NO: 4487 - protein, 143 aa, Aspergillus flavus
  strain ATCC 200026 / FGSC A1120 / NRRL 3357 / JCM 12722 / SRRC 167
MQFTSFKALAIFAASFFAFSAAAHPRCETGAVWADPHDCHSFFECAAGGIPVRKTCGPGTAYNSRFGICDYEEKVRSCHGHGPVGHDESSEGHGHQWKDHGNGQSEGHGQEGKKDSKGQSSEGHGQGTQEHGSGEQEHSEGSH

SEQ ID NO: 4488 - protein, 259 aa, Aspergillus flavus
  strain ATCC 200026 / FGSC A1120 / NRRL 3357 / JCM 12722 / SRRC 167
MNLRLLTLALAAVAAASPVDIQERQLSGGNELRDGSCKPITFIFARASTEPGLLGISTGPAVCNGLKMAKAGQVACQGVGPKYTADLASNALPENTSPAAIQEAQDLFQQAVTKCPDTQIVAGGYSQGTAVMDDSIKRLPDNVKEKIKGVVLFGYTRNAQEHGQIANFPKDKVKVYCAVGDMVCDGTLIVGPAHFTYLGNTGEATQFLLGKLSASSSSSSSSGSSDTSSASTSAAADSSSSSSSSSSPFGNLGNLFGGL

SEQ ID NO: 4489 - protein, 326 aa, Aspergillus flavus
  strain ATCC 200026 / FGSC A1120 / NRRL 3357 / JCM 12722 / SRRC 167
MRVTAILTLATIAIASPTKVLNSRNELARRQATEGCSIGYCTQNGGTTGGAAGDTVTVTDLASLTEAAESETPLTIIVSGNIEGSAKIRVASDKTIYGETGSSITGVGFYIRQVSNVIMRNLKIGQVLADNGDAIGIDESTNVWVDHCDLSGDLSAGKDDLDGLLDITHAAEWVTVSNTYLHDHWKASLVGHSDSNADEDTGHLHITYANNYWYNINSRAPSIRFGTVHIINNYWDSLLGTGVNCRMDAQVLIQSSAFSNCPDEAIFFADSDYTGYAVVDDVDLGGSTNSVPEGTLTASSLPYDAIEALGSAQIAATIPETAGQKL

SEQ ID NO: 4490 - protein, 490 aa, Aspergillus flavus
  strain ATCC 200026 / FGSC A1120 / NRRL 3357 / JCM 12722 / SRRC 167
MRIGNLIVAASAASLVHAYPTRDIKKRGSGFTWVGVSESGAEFGSSIPGTLGTDYTWPDTSKIQVLRDDGMNVFRIPFLMERLAPNQMTGSLDATYLKDLKSTVQAVTDSGAYAVLDPHNYGRYSGSIISSTSDFKTFWKTVAGEFASNEKVIFDTNNEYHDMEQSLVLSLNQAAIDGIRAAGATTQYIFVEGNSYSGAWKWADTNDNLSQLTDPQDKIVYEMHQYLDSDGSGTSETCASSTIGKERLQTATEWLKTNNKKGFLGEFAGGVNEQCEQAVEGLLSYMSDNSDVWMGAEWWSAGPWWGSYMYSMEPTDGTAYSTYLPILKKYFVDGTGASTSSSATSAAPSTAAASTSTSVSASTSSASSTTISAVESSSTSSVAEAPSTTSGVVTATPTPSHPAPQPTSNSSSASSGAPTSSAPTTLATSPACGYQTTVTVTASRSTAAPSSSAGAVAHYYQCGGINYSGPTTCESGYTCVKQNPYYSQCL

SEQ ID NO: 4491 - protein, 307 aa, Aspergillus flavus
  strain ATCC 200026 / FGSC A1120 / NRRL 3357 / JCM 12722 / SRRC 167
MILLSYLLTYLLCALTCSARAIHNGRSLIPRAGSLEQVTDFGDNPSNVKMYIYVPTNLASNPGIIVAIHYCTGTAQAYYQGSPYAQLAETHGFIVIYPESPYEGTCWDVSSQATLTHNGGGNSNSIANMVTWTTKQYNADSSKVFVTGTSSGAMMTNVMAATYPDLFAAGIAYAGVPAGCFLSTADQPDAWNSTCAQGQSITTPEHWASIAEAMYPDYSGSRPKMQIYHGNVDTTLYPQNYEETCKQWAGVFGYNYDAPESTESNTPEANWSRTTWGPNLQGILAGGVGHNIQIHGDEDMKWFGFTN

SEQ ID NO: 4492 - protein, 392 aa, Aspergillus flavus
  strain ATCC 200026 / FGSC A1120 / NRRL 3357 / JCM 12722 / SRRC 167
MKVTRLAVLNTLATLTVAWLPTTDKTITSSNGTDLFKASHGKIRGVNLGSQFVFEPWIATKAWSELGCEGQESEFDCVMKLGQDAANKAFAKHWDSWITKEDIKEIRSYGLNTIRIPVGYWMNEDLIYHDSEYFPHGGFAYLEKLCGWASDAGLYIIIDLHGAPGAQVAKNAFTGQFADTPGFYVDFQYQRALEFLEWMTIKVHTLHNFRNVGMLEVVNEPVQNPQVTTTLRSNYYPNAFHSIRKVEGALSIDRKDYLHIQMMDGAWGAGDPHEHLTDDYYAAYDNHRYLKWDPRVEVSKDSYIKTSCNDNVATNWPAIIGEWSLGVPDNVQETADWKPYSNLDFYQKWFAAQVQNYEQHQGWIFWTWKTQLDEYRWSYRGTYLSGFWQTSS

SEQ ID NO: 4493 - protein, 725 aa, Aspergillus flavus
  strain ATCC 200026 / FGSC A1120 / NRRL 3357 / JCM 12722 / SRRC 167
MGALRWLSIAATASTALALNPEGLISAPRRSEAIPNPSGDVAVFSQSQYSFKTHKTTSQWNVLDLKSGDIKLLTNDSDVSEIVWLGSDDSTVLYVNGTNADIPGGVELWVSDISDFANGYKAASLPASFSGFKVVTTDSGDVRYVAYAESWANGTAYNEELVAKPLSSARIYDSIYVRHWDYYLTTRFNAVFSGTLKKSEGKGKATYKADGDLKNLVSPVKNAESPYPPFGGASDYDLSPDGKWVAFKSKAHDIPRANYTTAYIFLVPHDGSKTAVPINGPDSPGTPEGVKGDAGSPVFSPDSKKIAYWQMADESYEADHRTLYVYTVGSEETIPSLAADWDRSLDSVKWADDDNLIIGVEDAGRSRLFSIPADAGDDYKPKNFTDGGVVSAYYQLPDSTYLVTSTAIWTSWNVYIASPEKGVIKTLATANKIDPELKGLGPEIVDEFYYEGNWTKIQAFVIYPENFDKSKSYPLLYYIHGGPQSSWLDSWSTRWNPKVFADQGYVVVAPNPTGSSGFGDALQDAIQNQWGGYPYEDLVKGWEYVNENFDFIDTDNGVAAGASYGGFMINWIQGSDLGRKFKALVSHDGTFVADAKVSTEELWFMQHEFNGTFWDNRENYRRWDPSAPERILKFSTPMLIIHSDLDYRLPVSEGLSLFNILQERGVPSRFLNFPDENHWVQNKENSLVWHQQVLGWLNKYSGVEESNEDAVSLDDTVIPVVDYNP

SEQ ID NO: 4494 - protein, 253 aa, Aspergillus flavus
  strain ATCC 200026 / FGSC A1120 / NRRL 3357 / JCM 12722 / SRRC 167
MRLICSLPVVLPLFSTALADVEFIAPARGTIMKAGDVVTAHWKDSGESPRISELVQYDLYLCAGGDTLGSQENLAILIKDGVFARGNSVSFKIDPAVGGNEPNAYFLKMVASGPDAHVINFSDRFTLTDMAGAFSSNLEDGIGLLSEGHGQQELRRRQAAGAYTIPYQLQTGPTRYAPMAKKPGSTIPADKSPTPQFPTSAYEIATAYLSAPTIQTTVSASLTYSVSSIENTASPAPHPHDKKMKRFLERWKD

SEQ ID NO: 4495 - protein, 635 aa, Aspergillus flavus
  strain ATCC 200026 / FGSC A1120 / NRRL 3357 / JCM 12722 / SRRC 167
MMRGLLLAGALGLPLAVLAHPTHHAHGLQRRTVDLNSFRLHQAAKYINATESSSDVSSSFSPFTEQSYVETATQLVKNILPDATFRVVKDHYIGSNGVAHVNFRQTAHGLDIDNADFNVNVGKNGKIFSYGHSFYTGKIPDANPLTKRDYTDPVAALRGTNEALQLSITLDQVSTEATEDKESFNFKGVSGTVSDPKAQLVYLVKEDGSLALTWKVETDIDSNWLLTYIDANTGKDVHGVVDYVAEADYQVYAWGINDPTEGPRTVISDPWDSSASAFTWISDGENNYTTTRGNNGIAQSNPTGGSQYLKNYRPDSPDLKFQYPYSLNATPPESYIDASITQLFYTANTYHDLLYTLGFNEEAGNFQYDNNGKGGAGNDYVILNAQDGSGTNNANFATPPDGQPGRMRMYIWTESQPYRDGSFEAGIVIHEYTHGLSNRLTGGPANSRCLNALESGGMGEGWGDFMATAIRLKAGDTHSTDYTMGEWAANKKGGIRAYPFSTSLETNPLTYTSLNELDEVHAIGAVWANVLYELLWNLIDKHGKNDGPKPEFKDGVPTDGKYLAMKLVIDGMALQPCNPNCVQARDAILDADKALTDGANKCEIWKAFAKRGLGEGAEYHASRRVGSDKVPSDAC

SEQ ID NO: 4496 - protein, 224 aa, Aspergillus flavus
  strain ATCC 200026 / FGSC A1120 / NRRL 3357 / JCM 12722 / SRRC 167
MVMLRSLLVSALAALAAASPIAEPADQSLEARQLGSSNDLTNGACKDVTLIFARGSTEMGNMGTVIGPPLCSALKSKLGADKVACQGVGGLYTGGLMQNALPQNTDPGAISTAKSLFEQASTKCPNTQIVAGGYSQGSAVIDNAVQQLSAEVKDKVKGVVFFGFTRNLQDKGQIPNYPKDNVKVFCAMGDLVCDGTLIVTAAHLTYTINAPEAASFLASKVQSA

SEQ ID NO: 4497 - protein, 528 aa, Aspergillus flavus
  strain ATCC 200026 / FGSC A1120 / NRRL 3357 / JCM 12722 / SRRC 167
MLSRTILFSTSFLWVRVANAAFGITTSDDSYVIDAGSANSLKFTVSRSSCDITSINYYGSELQYSGTGSHIGSGLGSADVSAVEDGDYIKVTCDTDTLTQYFVVHNGDSVIHMATYTTEEPSVGELRFIARLNSELLPNEEPFGDVSTTSGGEAIEGSDVFLVDGETRSKFYSSQRFIDDQRHCVAGDAHRVCMILNQYETSSGGPFFRDINSNNGGSYNSLYWYMNSGHVQTEDRRQGLHGPYSMYFSRSGTPSTDIDTSFFANLDIKGYVAADGRGTVSGTASGADSSFKWVVHWYNADAQYWTYTSSDGSFTSPAMKPGDYTMVYYQGEYKVAETSVSVTAGSSTSKDISGFVETGDTIFKIGDWDGTPTGFRNAENQLRMHPSDSRMSSWGPLTYTVGSSELTDFPMAAFKGVNDPVTIKFTATSAQTGAATLRIGTTLSFAGGRPQATINDYEGSAPSAPTNLNSRGVTRGAYRGLGEVYDVNIPSGTIVEGENTITISVISGSSGDEFLAPNFIFDCVELFQ

SEQ ID NO: 4498 - protein, 839 aa, Aspergillus flavus
  strain ATCC 200026 / FGSC A1120 / NRRL 3357 / JCM 12722 / SRRC 167
MPRLDVEKTIEELSLGEKVALTAGIDFWHTASVPRLNIPTLRMSDGPNGVRGTRFFNGVPAACFPCATALGATWDTELLHEIGQLMGEESIAKGSHIILGPTINTQRSPLGGRGFESFAEDGVLSGLLAGYISKGIQEKGVAATLKHFVCNDQEHQRMAVDSIVTQRALREIYLLPFQLAMRICRTACVMTAYNKVNGTHVSQNKEIITDILRKEWGWDGLVMSDWFGTYSTSDAINAGLDLEMPGKTRWRGTALAHAVSSNEVAEFVMDERVRNVLNLVNFVDGLNIPENAPEKALNRPQDQALLRRAAAESVVLMKNEEDILPLKKEKSILVIGPNSKVAAYCGGGSASLDAYYTVNPFEGVSAQSKGEVKFSQGVYSHKDLPLLGPLLKTADGKTGFSFKVYNEHPSESNRELIEQLHLVSSSGFLMDYVNPKIKSLTYYVDMEGLFTPEEDGVYDFGVTVVGTGQLFIDGELVVDNTKNQRQGSAFFGSATVEEKGSKELKAGQTYKVLFQFGTAPTSDLDTRGVVVFGPGGFRFGASRRVGQEELISNAVKLASEAEQVVVFAGLTSEWETEGYDRDHMDLPPGSDEMISRVLDVNPNAVVVIQSGTPVTMPWANKTKALLHAWFGGNECGNGIADVLYGDVNPSGKLPITFPVRLQDNPSYVNFRSERGRVLYGEDVYVGYRYYEKVDLAPLFPFGHGLSYTTFTRSDLTLTTTPEKPQYEESGEPITATVTVTNTGKVAGAEIVQLWVAPPATEVNRPVRELKGFTKVFLQPGEQKKVEIVVEKKLATSWFDEMREKWASEKGEYGVLVTGTGEGVLKSSFKVEKTRYWLGL

SEQ ID NO: 4499 - protein, 319 aa, Aspergillus flavus
  strain ATCC 200026 / FGSC A1120 / NRRL 3357 / JCM 12722 / SRRC 167
MYLQSSLALVLLRAAVVHGYANPGACSGACNIHDPSLIQNGDGTYYRFSTGNNISFASASSIEGPWTALGSVLPGGSSIDNSGRYDPWAPDVQKVGDLYYLYYAVSSFGTQESAIGLATSETMEEGTWTDKGSIVTSTTGDQYNAIDANLLVDGSANYLTFGSFWQDIFQVTLNGDATSSTSTPVNVAFDPATTHPVEGAYLYKYGDYYYLFYSWGTCCGYDTSRPAEGEEYKIKVCRSSTPTGNFVDASGVACTDGGGTVVLESHDNVYGPGGQGVYTDPNLGPVLYYHYVDTTIGYADSQKLFGWNAIDFSSGWPSV

SEQ ID NO: 4500 - protein, 321 aa, Aspergillus flavus
  strain ATCC 200026 / FGSC A1120 / NRRL 3357 / JCM 12722 / SRRC 167
MANFKLFLALAACLSGQALAAPTKTIGKRAAITDVAHGYASQNGGTTGGAGGTTTTVSSYAQFTEAVSSDDAKIVIVDGTITETADQVKVGSNTSIIGKDANAILEGFGLLVKEKENVIIRNLGVKKVLADNGDAIGVQYSNNVWIDHCDVSSDRDHDKDYYDGLIDLTHAADYVTVSNTFVHDHWKAMLFGHSDSNGDEDTGHLRITVNNNYLNNLNSRGPSFRFGTGHLYNNYYLDVSDGINTRQGAQLLVEGNVWSGGKKPLYSTDDGYAVARDNDFGDGENTAPEGTLTSVPYEYDLLAASAVKDAVVGTAGQTLTF

SEQ ID NO: 4501 - protein, 332 aa, Aspergillus flavus
  strain ATCC 200026 / FGSC A1120 / NRRL 3357 / JCM 12722 / SRRC 167
MVQFSSIVQCTLLATAASAYVTSRQAAESLHDAFTAAGKKYFGNIAEQALLENPQNEPIIAADFGALTCENSMKWDATEPTQGGYNFDGADYVVNYAVEKGKLLRGHTLLWHSQLPSWVSQISDPATLTGVIQDHVTTLVSRWKGQIYAWDVVNEIFAEDGSLRESVFSNVLGEDFVRIAFEAARAADPDCKLYINDYNLDDASYSKTQGFVSKVGEWIAAGVPIDGIGMWLACLFKHAYAGGFPTSGAQAALEALASTGASEVAVTELDIGGATSDDWVNVVNACLNVEKCIGITVWGVSDKDSWRADESPLLFDVNYQPKDAYGAIIAAL

SEQ ID NO: 4502 - protein, 670 aa, Aspergillus flavus
  strain ATCC 200026 / FGSC A1120 / NRRL 3357 / JCM 12722 / SRRC 167
MINIRSASVAILLAPLCHAILASGQQNVLSPPRRKYTLDDIKPLTHAGSGEVKCCPEGTLFDGQSCVLGVPKCPVNTVFQDGKCVSVSKPTCPPGEEFNGRVCVTEASPYCPPPTVFQDKACVSKEPPTCPTGFELHGQVCVSKLHPTCPNDDRFNGQDCVSSQGPTCPQDTTELSNGVCVSKKQPSCPTGSQFDSTVKRCVSEQKPVCPEGTVRKGQNCVSVQGPACPEDTTFNPKTQTCTLTQDPTCPPEQEFENGQCYSTIQAECDSGTQLSVDRLSNTARCCPVGLTWNGEVCLIPVDVDGNCPPGLIKIGNRCEKQTVTIPICPPTFKPQGSRCVSVEPPECPPDYTRDGSVCSSLESPQCPEGYQLKGSDCVSTETLACPEDTKLEGEHCVSIDAPTCEGDARFDGTNCIVTTPECETGKYFNGKDCVTINQPSCTSGTIFDGHRCVSSNRPECPVGSLPSHGTCITNSRPSCKSGSVLVGDDCVTGPPQCDKGLIFDGTQCVTIDHPTCPPSYKWVNEECVNTEVKGCEPGYTLRNGKCVSDVRPECEPGTSFNGTACVGDAPECPPDTVFDGTECASEEIPGCPTGLKFNGKKCVAETDPSCPTNTKWDAASKECIGDKPPQCPPGQEFTGEHCALVDGECMEFEYCPARSLGVVLFDGAKM

SEQ ID NO: 4503 - protein, 433 aa, Aspergillus flavus
  strain ATCC 200026 / FGSC A1120 / NRRL 3357 / JCM 12722 / SRRC 167
MKLTQATTLLLSLGLSLPVEGFSLSRTNAVGPKPPFRPLPASTPRNKTCQVQSNGDGTDDAPYILAALKQCNNGGKVVFAEDKEYTIGTALDMTFLKHVDLEILGKITFTPDTDYWQENSFKHTFQNATTFFNLGGTDVNVYGGGELNGNGQVWYDLYAEDALILRPILVGIIGLHGGTIGPLKLRYSPQWYQLVANSSDVLFDGIDISGYSSSENEAKNTDGWDTYRSSNIVIQNSVINNGDDCVSFKPNSTEILVQNLHCNGSHGISVGSLGQYQGEVDIVQNVLVYNISMYNASDMARIKVWPGISSAMSEDLQGGGGLGSVQNITYDKMYIENVDWAIEVTQCYGQKNQTLCNENPSNLTISDVYFNDLTGVTSGKNDPNVGTIICSSPDVCSGIHATNIDVKSPDGDSGFVCTNVDEEFLDVECASSS

SEQ ID NO: 4504 - protein, 447 aa, Aspergillus flavus
  strain ATCC 200026 / FGSC A1120 / NRRL 3357 / JCM 12722 / SRRC 167
MQVKLFYTLALWAPILVSAQLSGSVGPLVDFKTKAKNKTCDITDYGAVADGKTDVGPAILDAWGNCSTGGLIYVPPGTYSLATDLELKHGESTAFQLDGVLARGHEGSYQLILVRNCHDCEFFSGNSQGAVQGYGYEYLQDGNYGERLFRFQDVSDFSVHGFAAIDSPAYYLVFDTVSNGEIYNLLVRGIADLGMTDAFDIWGQNVWIHDIEVTNGDECVTVKSPASDFLIENIYCNLSGGTAIGSLGTGTNISNIHYRNLYMNQADACYLKTHNGDGIVKNIVWENVIVHGGPYPLAVNEAWGKDVGSTGVQVQNLTFRNWYGENTANSRPAIRIECDEDVPCYDITLDNVNLWTEDGDYVEWSCANAYGSGACLQEAKDTGDLATYTTAVTVTATPSYSATHMPGDFTTNPPSTAPFTIPPMPTSFYPGATPISTLLSLSGAGGL

SEQ ID NO: 4505 - protein, 839 aa, Aspergillus flavus
  strain ATCC 200026 / FGSC A1120 / NRRL 3357 / JCM 12722 / SRRC 167
MRWSFLTVLLWLVSLTGAENGFNGWLRYAPVQCDKRCQRALPSSIVTLNSTDSGPIGTASQELQAGLENIVGKQLSIKRSSCGSRSSILVATLEQYRQACNRSSEVPSLGIDGFWLRAYGDTVQIVGENERGALYGAFEYLSLLAQGNFSHVDYTTSAHAPVRWVNQWDNMDGSIERGYAGPSIFFEDGHIVEDLSRVKQYARLLASIRINGVIVNNVNANATLLTSQNMDGLARIANVFRPYGIQIGISLNFASPDTLGGLGTYDPLDPSVISWWANITDSLYDRVPDMAGYLVKASSEGQPGPDTYNRTLAEGANVFAKALQPHGGILMFRTFVYDHHINESIWTNDRANAQVDFFKELDGQFEDNVILQIKYGPIDFQVREPVSPLFANLYKTNMAIELQVTQEYLGQQDHLVYLSPLWKELLDFDLRVDHQPSLVRDIVSGQRFDRQLGGWAAVVNVGTNTTWLGSHLAMSNLYAYGRLAWSPTDDSQGILQDWIRLTFGRDQNVLDTITDMSMASWPAYENYTGNLGIQTLTDILYTHYGPNPASQDNNGWGQWTRADHDTIGMDRTVKNGTGNAGQYPAEIAQVYEDLDSTPDDLLLWFHHVPYTHRLHSGKTVIQHFYDAHYDGAETAHRFLSQWESLKGRIDQQRYNEVLSRLVYQAGHSLVWRDAINNFYWNMSGISDEKNRVGHHPWRVEAESMTLDGYEPYTVSPFETASNYKAVVTTSNSTTGTAQTKLQFPSGTYDLGVNYYDMYGGKSEWTVYVNDRVVGQWEGNSENTLGHTPSIYIDGHSATRITFRGVEIENGDQLKIVGVPDGVEPAPLDYVVLLPPDVVD

SEQ ID NO: 4506 - protein, 634 aa, Aspergillus flavus
  strain ATCC 200026 / FGSC A1120 / NRRL 3357 / JCM 12722 / SRRC 167
MRIDCTVASLTALASGCQALSTRPYVPRGHSLSRRDDSAPIYRDASYCIDERVDDLLARMTIEEKAGQLFHTRLMDGPLDDEGSGNNAHNSTSNMIGEKHMTHFNLASDITNATETAEFINRIQELALQTRLGIPVTVSTDPRHSFTENVGTGFKAGVFSQWPESIGLAALRDPYVVRKFAEVAKEEYIAVGIRAALHPQVDLSTEPRWARISNTWGENSTLTSELLVEYIKGFQGDKLGPQSVKTVTKHFPGGGPVENGEDSHFAYGKNQTYPGNNLEEHLKPFKAAIAAGATEIMPYYSRPIGTEYEPVAFSFNKRIVTELLRNELGFEGIVLTDWGLITDGYIAGQYMPARAWGVENLTELERAARILDAGCDQFGGEERPELIVQLVQEGTVSEDRIDVSVRRLLREKFVLGLFDNPFVDPESAGRVVGNDYFVRLGREAQRRSYTLLSNNEDIVPLKKIEQSTKFYIEGFNASFIESWNYTVVDSPEEADYALLRYNAPYEPRPGGFEANMHAGSLAFNDTEKARQAKIYSTVPTIVDIVMDRPAVIPEIIEQAKAVFASYGSDSNAFLDVVFGVSAPEGKLPFDLPSSMEAVEAQMEDVPFDTRNPVFKFGHGLSYANPCASSSSKCS

SEQ ID NO: 4507 - protein, 405 aa, Aspergillus flavus
  strain ATCC 200026 / FGSC A1120 / NRRL 3357 / JCM 12722 / SRRC 167
MQLGHAKLFLFFLSLFTPALSRRIGHKHTHVAERQAPACTPTAGGSPTVDDVPAIESAMAACPSGTIMIPAKSTYHINSELSFAKCSGCTLQVEGTLLVSDDTKAWSGKDAVLNLEDVNDVSIVSKTGKGVIDGNGQAAWDLLNKDKNYSRVKCLLYLTGKTSGVTISGLTMRNPPNVFSSVKQSVTNVTYSNLILTAVSKSDALPKNTDGFDLGGTGIRMDNIKVQNGDDCIAIQNGAEDITVMNIQCTGSHGLSIGSIGKTPGEVDTVKNIHFKNAKMTKCSKAAGIKIYSGGYGTAEVSNVTWENVMVDGTSYAFQVQTCYGSDEKECASQPSTAKLTDIVVKGFSGKTDKDEPVASINCPAKGTCGLSLTEMKVQSATGGEEYQCSNAGAIGVKCAPGASG

SEQ ID NO: 4508 - protein, 281 aa, Aspergillus flavus
  strain ATCC 200026 / FGSC A1120 / NRRL 3357 / JCM 12722 / SRRC 167
MKNFVSMHAILLACSAGAGLAAITQGISEGTYSRIVEMATISQAAYANLCNIPSTITSAGKIYNAETDINGWVLRDDSRQEIITVFRGTGSDTNLQLDTNYTQAPFDTLPQCSGCAVHGGYYVGWISVKDQVEGLVQQQASQYPDYSLVITGHSLGASMAAITAAQLSATYNNITVYTFGEPRTGNQAYASYVDETFQATNPDATKFYRVTHTNDGIPNLPPTSQGYVHHGTEYWSVEPHGPQNMYLCLGDEVQCCEAQGGQGVNDAHVTYFGMASGACTW

SEQ ID NO: 4509 - protein, 463 aa, Aspergillus flavus
  strain ATCC 200026 / FGSC A1120 / NRRL 3357 / JCM 12722 / SRRC 167
MRSLSSIALLSVVGAASAQAGPWAQCGGKSFSGSSECASGWKCQELNEWFSQCVPGAESTTPTVSSTPTPTDAPSVSITASATTGINKSISVSSASKSTPLPSSSSASPSPRPTGSGSFAKADGLQFSIDGETKYFAGTNAYWLPFQMNDADIDSVFDHLEQAGLKILRVWGFNDVNTAPSPGTVYFQLHDKEKSTSTINTGKDGLQRLDYVVAAAEKHGVKLIIPFVNSWDDYGGYNAYVKAYGGSKTEWFTNEKIQSVYQAYIKAVVSRYRDSPAIFAWELGNEPRCSGCSTDVIHGWATKISAYIKSLDPNHMVALGDEGMGLTIGSDQSYPYGTSEGNDFEKNLAIPDIDFGTLHLYTTDWGIKDNAWGNGWVENHAKACKAAGKPCLFEEYGMKGNHCTDELKWQKTSLSSGTAADLIWQYGQQLSTGESPKDAYSIFYGTDEWKCAVMDHMENVNKN

SEQ ID NO: 4510 - protein, 504 aa, Aspergillus flavus
  strain ATCC 200026 / FGSC A1120 / NRRL 3357 / JCM 12722 / SRRC 167
MTTFTKLSDQDTPSIAIHPSRRISKINPNIYAGFTEHMGRCIYGGIYDPGNPLSDENGFRKDVLEALKTLDIPVVRYPGGNFMATYHWIDGVGPKDQRPARPELAWLGTETNQFGTDEFLKWCEVLGTEPYFCLNFGTGTLDEALAWVEYCNGTGNTYYANLRRKNGREEPYNVKYWALGNETWGPWQVEQMTKEAYSHKAYQWAKALKLLDPSLVLILCGQDGTASWDYYTLKHCLLPVNSPLSTSAVPLIDMHSIHLYTSSSSHLPNATAPLAAERAIEITSSLIDLARIENGVPPEQARPTICFDEWNVWDPIRAEGSKGAEECYTLSDALAVAVWLNVFVRKSKDLGMACIAQTVNVISPLMTTKEGITKQTTWWPLYLFSKYMRGWTISAHLASATYEGETSPKWIRGVKETPWLDVSAVLGEDGYVNVAVVNIHEEKAIETTIDGASGEVTVFTVTGDSVAATNMKGKEEVAVVESTWDGQGPYAFPKHSLTLLRWKA

SEQ ID NO: 4511 - protein, 221 aa, Aspergillus flavus
  strain ATCC 200026 / FGSC A1120 / NRRL 3357 / JCM 12722 / SRRC 167
MVSFSSLLLAVSAVSGALAAPGDSTLVELAKRAITSSETGTNNGYYYSFWTNGGGDVEYTNGNGGQYSVKWTNCDNFVAGKGWNPGSAKTVTYSGEWESNSNSYVSLYGWTQNPLVEYYIVDKYGDYDPSTGATELGTVESDGGTYKIYKTTRENAPSIEGTSTFNQYWSVRQSGRVGGTITAQNHFDAWANVGLQLGTHNYMILATEGYKSSGSATITVE

SEQ ID NO: 4512 - protein, 437 aa, Aspergillus flavus
  strain ATCC 200026 / FGSC A1120 / NRRL 3357 / JCM 12722 / SRRC 167
MKLSGSSALLLLGFGLLGHASPLVHVQGKNCTVKPLGHGQDDVPNILHAVEKCGQTPGGRISLPAPYTYRINQRMTTHLESSTLEVGGMLLFSDDITYWVNNSYRIDFQNQSTAWRITGHDYVVDGGPERGGIDGNGQLWYTWAKGGSNVFGRPMPLHVLNSTRAVLRNIAIRQPQFWAVLVESSSHVELDNFYVNATNSDPNATEDTVWIQNTDGIDTYRSDHVTITNWVYEGGDDAVAFKPNSTNIHVENVTVYGGPGIAFGSLGQYPDRYDIVENITVKNANFQPSSQRAMNSGIYFKSWIGVNFGVPPNGGGNGHGYVRNVTVEDITFKDVQLPIYIDTCLSYLFDQNVTQYCDTSTFRFDDLHFRNISGNGLATPTNYTGRNITFAVSMICSKEAPCTDITFEDVDIKLPESYSGKSVLCENAGVQGLECNS

SEQ ID NO: 4513 - protein, 404 aa, Aspergillus flavus
  strain ATCC 200026 / FGSC A1120 / NRRL 3357 / JCM 12722 / SRRC 167
MRFISASSLLLALAPTLNAVPVEVAGSAQGLDVTLSQVGNTRIKAVVKNTGSEDVTFVHLNFFKDAAPVQKVSLFRNGMLPNLNLATTEVQFQGIKQRLITEGLSDDALTTLAPGATIEDEFDIASTSDLSEGGTITINSNGLVPITTDNKVTGYIPFTSNELSIDVDAAEAASVTQAVKILERRTKVTSCSGSRLSALQTALRNTVSLARAAATAAQSGSSSRFQEYFKTTSSSTRSTVAARLNAVANEAASTSSGSTTYYCSDVYGYCSSNVLAYTLPSYNIIANCDLYYSYLPALTSTCHAQDQATTTLHEFTHAPGVYSPGTDDLGYGYSAATALSASQALLNADTYALFANGTYSSLLSFVNPLLTPDNSCQPQLLDARTCNRQFGRSTSCKVYWKAVE

SEQ ID NO: 4514 - protein, 752 aa, Aspergillus flavus
  strain ATCC 200026 / FGSC A1120 / NRRL 3357 / JCM 12722 / SRRC 167
MRFVSLAVGAALLGAAGASSISSNVGLLKANGVALGNWEAAYEKASAFVSGLTTDQKLALITGSNVESTNGNFTPLYFLDGDMGLQDFYYVSAFSLSSALAMTWDRDAIYEQAKAVGSEFYNKGVQVVAGPTSQPLGRTPWGGRGVEGFGPDPYLNGLATGLTTKGYVDAGVIPGGKHFLLYEQETNRTSSFGSSGEGSPYSSNADDKTIHETYLWPFYDAVKNGAGAVMCAMTKVNGTMACENSDLLMKMLKTELGFPGMVWPDMNGQNSAKGSALGGEDYGSSSIWSTSTMESFLSNGTLSEARLNDMAIRNLIGYYYVNLDNGRQPTRQTTDVYVDVRANHSKLIRENGAKSMALLKNEGVLPLSKPRVMSIFGAHAGPIMGGPNSNVDVMGSGPTYQGHLATGSGSGMASMPYLITPYGALTNKAAQDGTVLRWVLNDTYSSGGGSSLVPSSTSSTAVEPSFENFATGSDICLVFINALAGEGADRTELYNADQDAMVNTVADNCNNTVAVVNTVGPRLLDQWIEHDNVTAVLYGSLLGQESGNSIVDLLYGDVNPSGRLVHTIAKNESDYNVGLCYTAQCNFTEGVYLDYRYFDAHNITPRYPFGHGLSYTTFHYSSLAIKAPSSITKAPKGNLTVGGPSDLWDVVGTVSARIANNGTLSGAEVPQLYLGFPDSADQPVRQLRGFDRVELSAGQEAVVTFNLRRRDISYWNVKTQQWMVAGGKYTVFVGGSSRDLRLNGTFFLWVGS

SEQ ID NO: 4515 - protein, 315 aa, Aspergillus flavus
  strain ATCC 200026 / FGSC A1120 / NRRL 3357 / JCM 12722 / SRRC 167
MRSSLLMGALCAAGAMANPLDKRAYTTDWTVVTVTTTITAPVPPAATTSSSTYVPVQEPVASVEPAPAPVEQSSSAVFVEVPATSSAPAPAEPTAEVQPTTAAAAADQGSAWTSAWTSAWTSSWTSSAAQPTTLASTTSSASGATATNAYQSTVLYNHNVHRSNHSASSLEWDASLEASAQTLAARCVYQHDTFSSTINGGGYGQNIGYGVSSEKIGEMITNLMYNNEMGYFEALYGEANPSMDNFDAWGHFSQIVWKGTTHVGCATVTCNSLGNVDSSVAVPFTVCNYSPAGNYAGEYADNVLRPLGQAMYVVS

SEQ ID NO: 4516 - protein, 234 aa, Aspergillus flavus
  strain ATCC 200026 / FGSC A1120 / NRRL 3357 / JCM 12722 / SRRC 167
MFSRIALLPAFLPVALACLGYEGGVPTPTAHYSNSAVIEIAAGEVFDAGWAKYDRGSGACGGQTEGDWKDAVFYLHSGATLKNVIIGADQSEGVHCDGACTLEFVWFEDVCEDAISIKNDKEGEETWIIGGGAYHADDKVVQHNGCGTVNIINFYAEDYGKVYRSCGNCSSQCKRNVYVEGTTARDGGEVVGINQSFGDTATLVNVCTDADHPCVLYDGCEGDCEPSKVGYCSG

SEQ ID NO: 4517 - protein, 467 aa, Aspergillus flavus
  strain ATCC 200026 / FGSC A1120 / NRRL 3357 / JCM 12722 / SRRC 167
MHSLSLISLALLSPLLVNAQLSGHVGPLTSSSSKASTKTCNVQDYGAKADKETDIGSAIEKAWDDCAEGGVVYIPSGDYAMSSRLKLSGGKASAIQLDGIIYRTGSDGGNLFMIEHSSDFEFFSSTSQGAIQGLGYEFHKDGSLNGPRLLRFYDVTDFSVHDVALVDSPAFHLSLDTCKNAEIYNMAIRGGDSGGLDGVDIWSENVWVHDVEVTNKDECVTVKSPAKNILVENIYCNWSGGCAMGSLGADTNISDVVYRNVYTWKSNQMYMIKSNGGSGSVSNLVLENFIGHGNAYSLDIDGEWSSMSTVSGDGVQLNNITVRNWKGTEEDGAARGPIKVVCAEKAPCTDITIDDFALWTESGDEQTYSCENGFGSGFCLQDGDGTSSYSTVITETAAPTGYEASSMSNDLSTAFGTDASIPIPTIPTSFFPGATPYSALAGAASGNAAKATSSATASRFRHRRGSH

SEQ ID NO: 4518 - protein, 629 aa, Aspergillus flavus
  strain ATCC 200026 / FGSC A1120 / NRRL 3357 / JCM 12722 / SRRC 167
MVALSTLSGLSALPFLFSLVQNVYGVSLEVSTEKGNSSSPILYGFMFEDINHSGDGGIYGQLLRNNGLQGSKPGLTAWAAVGDATIAVDAQNPLTEAIPHSLKLDVKQGASGAVGFTNEGYWGVPVDGSEFLNTFWIKGNFSGDITVRLVGNNTGTEYGSTKISQSSNSSNFTKVLAKIPTKKAPDGAVLYELTVDGASVGGSSLNFGLFELFPQTYKSRSNGLKPQVAQPLADMKGSFLRFPGGNNLEGASEARRWKWNETIGPVENRPGRQGDWSYYNTDGLGLDEYFYWCEDMGLTPVLGVWAGFALESGGNTPITGDALKPYIDDVLNELEYVLGDASTKYGSLRASYGRKEPWKLTMVEIGNEDMLGGGCESYVERFTAFYDAIHAAYPDLTIIASTDQSSCLPSKLPEGAWVDYHNYNTADNLVKQFSQFDNKDRSVPYFIGEYSCQQDNAWPFMQGSVAEAVYMIGIERNSDVVKMAAYAPLLQLVNSTQWTPNLIAFTQNPSTVIETTSYYVQQMFSVNRGDTIHNVTSDSAFGPVYWVASSADDKYYVKLANYGADTQEITVTISGKTGGKLTVLADSDPKAFNSDTQTLVTPSESDVKATNGKFTFTLPAWSVGVLAAH

SEQ ID NO: 4519 - protein, 449 aa, Aspergillus flavus
  strain ATCC 200026 / FGSC A1120 / NRRL 3357 / JCM 12722 / SRRC 167
MRSKTFSVLSSCLLLIATVQGQLSGSVGPSTSISDKKAVKTCNVLDYGATNDNKTDVGQPIMDAFEDCGSGGVIYIPDGDYLIQEWVSLENGTAFAIQLDGVIYRNGTTTSQGYMFGISGGSDFELYSSTSKGAIQGSGYLYHMNGEFTAPRLLHISDVSHWSVHDIALVDAPMFHFVIDDASNGEVYNMAIRGGNSGGLDGIDVSGDNIWIHDVMVTNKDECVTVKTGSHNFQIENIYCNWSGGCAMGSLGSGTNVSNIVYRNIYTWNSNQMYMIKSNGGDGEVSNLLFENFIGHGNAYSLDLDSEWSSMDTVDGDGIFYRNITFKNWKGTETDGESRPSIRVICPEATPCTDITIEDVDLWTEEGDSETYVCKNAFGSGACLKSDSSSTATYATTTTVTSAPSGYSATTMAADLTSAFGTDASIPIPTIPTSFYPGATPYSALAGSS

SEQ ID NO: 4520 - protein, 232 aa, Aspergillus flavus
  strain ATCC 200026 / FGSC A1120 / NRRL 3357 / JCM 12722 / SRRC 167
MVSFSSILLACSAAIGALATPIEPLADHPNEAFNETAFNDLVGRSTPSSTGYNNGYYYSFWTDGGGDVTYTNGNGGSYSVQWSNVGNFVGGKGWNPGSSRAITYSGSFNPSGNGYLAVYGWTTDPLIEYYIVESYGTYNPGSGGTYKGQVTSDGGTYNIYTSVRTNAPSIIGTATFTQFWSVRTSKRVGGTVTTGNHFNAWAKYGLTLGTHNYQIVATEGYQSSGSSAITVY

SEQ ID NO: 4521 - protein, 1020 aa, Aspergillus flavus
  strain ATCC 200026 / FGSC A1120 / NRRL 3357 / JCM 12722 / SRRC 167
MLISKTVLSGLALGASFVGVSAQQNSTRWPLHDNGLTDTVEWDHYSFLINGQRHFVFSGEFHYWRIPVPELWRDLLEKIKAAGFTAFSIYNHWGYHSPKPGVLDFENGAHNFTSIMTLAKEIGLYMIIRPGPYVNAEANAGGLPLWTTTGAYGKLRDNDPRYLEALTPYWANISKIIAPHLITNGGNVILYQIENEYAEQWLDEETHEPNTSGQEYMQYLEDVARENGIDAPLIHNLPNMNGHSWSKDLSNATGNVDVIGVDSYPTCWTCNVSECASTNGEYIPYKTLIYYDYFKELSPTQPSFMPEFQGGSYNPWGGPQGGCPDDLGPDFANLFYRNLISQRVSAISLYMLYGGTNWGWHASTDVATSYDYSSPISENRKLIEKYYETKVLTQFTKIAQDLSKVDRLGNSTKYSSNPAVSVAELRNPDTGAAFYVTQHEYTPSGTVEKFTVKVNTSEGALTIPQYGSQITLNGHQSKIIVTDFKFGSKTLLYSTAEVLTYAVIDGKEVLALWVPTGESGEFTVKGVNSAKFADKGRTANIEIHPGANNVTVSFMQRSGMSLVELGDGTRIVLLDRSAAHVFWSTPLNNDPAEAGNNTVLVHGPYLVRSAKLEGCDLKLTGDIQNSTEVSIFAPKSVCSVNWNGKKTSVKSAKGGVITTTLGGDAKFELPTISGWKSADSLPEIAKDYSATSKAWVVATKTNSSNPTPPAPNNPVLYVDENDIHVGNHIYRATFPSTDEPPTDVYLNITGGRAFSYSVWLNSDFIGSWLGTATTEQNDQTFSFSNATLSTDEDNILVVVMDNSAHDLRDGALNPRGITNATLIGPGSYSFTEWKLAGNAGFEDHLDPVRAPLNEGSLYAERVGIHLPGYEFDEAEEVSSNSTSLTVPGAGIRVFRTVVPLSVPQGLDVSISFRLTAPSNVTFTSAEGYTNQLRALLFVNGYQYGRFNPYIGHQIDFPVPPGVLDYNGDNTIAVTVWSQSVDGAEIKVDWNVDYVHETSFDMNFDGAYLRPGWIEERREYA

SEQ ID NO: 4522 - protein, 313 aa, Aspergillus flavus
  strain ATCC 200026 / FGSC A1120 / NRRL 3357 / JCM 12722 / SRRC 167
MSITIDTSVDIDLPTPPQSNGSQKRNLLLAPPSVAAHEEKLRDVFSTFDRSSTDLQMLDRLSAGFVSLPPNTYDLVLVLTDAQSDEAVRLLTRDVYTALVPAMKAGARLQLQQGSLGASEGLEAILAGLVEKDGGFEKPVQEAAVPLKLGGRKKKDKTNGVNGVQNGVATNGASTNGVGMFDPAQNNDDELIDEDALLSDDDLKRPLPRPQNCVPETAKKRRRPCKDCTCGLASQLEEEDRAREAKAAQDLNILKLNTDDLNDELDFTVQGKTSSCNSCSLGDAFRCSSCPYIGLPPFKPGEEVKIMNDMVQL

SEQ ID NO: 4523 - protein, 404 aa, Aspergillus flavus
  strain ATCC 200026 / FGSC A1120 / NRRL 3357 / JCM 12722 / SRRC 167
MVILSKVAAVAVGLSTVASALPTGPSHSPHARRGFTINQITRQTARVGPKTASFPAIYSRALAKYGGTVPAHLKSAVASGHGTVVTSPEPNDIEYLTPVNIGGTTLNLDFDTGSADLWVFSEELPKSEQTGHDVYKPSGNASKIAGASWDISYGDGSSASGDVYQDTVTVGGVTAQGQAVEAASKISDQFVQDKNNDGLLGLAFSSINTVKPKPQTTFFDTVKDQLDAPLFAVTLKYHAPGSYDFGFIDKSKFTGELAYADVDDSQGFWQFTADGYSVGKGDAQKAPITGIADTGTTLVMLDDEIVDAYYKQVQGAKNDASAGGYVFPCETELPEFTVVIGSYNAVIPGKHINYAPLQEGSSTCVGGIQSNSGLGLSILGDVFLKSQYVVFDSQGPRLGFAAQA

SEQ ID NO: 4524 - protein, 450 aa, Aspergillus flavus
  strain ATCC 200026 / FGSC A1120 / NRRL 3357 / JCM 12722 / SRRC 167
MLDFMDYIQLAFAEGTNWNRDNSYSSLTATAQSLLDFSTPERLRVHLSSLSTPNFATSYTLGTVGLIDGSVSYLYSTVPFTNTPSRSALIPLRKLSPGYRQVTPPSAPIEDWNLDSILDNPQNVQPSFASKPTLLHATLHLPPPTTLNALFLRRISPTMHLTLAVCSTRGPPLSKSAPQASLLTQLSHDTGKYSNEYLFSTDNALFGWRGLWNFGPDPRSATDTAAPRLSLLSAGAEAYYSPVSSLIGMSTGLRFSTLPAATDVPASTATGSATANQSTPISTFPYTLTLTLTPLTGSLSTTYSLRASPNLAFSSRFGFNVYSWESEMVAGCELWRKSRKQDDGLEWARRKMRASEPLSLPSLPAESTERQEEEEATDSVLKIRVDQSWNVRVLWEGRVKELLVSAGVGLGPSSFSSSSWAAAAAGSGQSSGGGVPSYWRGVGVSVLYSS

SEQ ID NO: 4525 - protein, 451 aa, Aspergillus flavus
  strain ATCC 200026 / FGSC A1120 / NRRL 3357 / JCM 12722 / SRRC 167
MNLWLLTLWVTLVTAWVDNQGTTCTLYPESLTHQGQEVDDSPSIQQAFDMCGTNGTVIFSENVFHVNTVLNTTNLLNCDVHLRGELRFSANVPYWRTHAISVVLQDQVTAWLFGGHNVSFYGEGGFYNGNGQAWYNANRNESNQAGRPMSFTVYNSTDLRVDGLRVIQPQFWATFVWASKNVSFTNLFVNATSDSEWGTMNTDGFDSWQSDNLLVENATIIMGDDCIAAKGNTTNLLAKNIYCEGGTGVTIGSIGQYPEMPDYNLNITFENVTIKDAMDGAYIKTWQGTRIFTPSNGDWGGGGTGLVKNVTFRDFVMDNVGLPIQVAQCVYSAGSNKSCNTSTLQIEDVKWENIRGTSRFNIASSIYCSDEVPCPNMSFENVNITSLNATRGQAYYDTDIQYELFQCTNVVGQNSSGIPCNQAAPSNFSQWIYGNVDSSGLATALSDHLGN

SEQ ID NO: 4526 - protein, 317 aa, Aspergillus flavus
  strain ATCC 200026 / FGSC A1120 / NRRL 3357 / JCM 12722 / SRRC 167
MLSFLAALSLPLALVNAYANPGTCNGNCWAHDPGLWKHDDGRYFLFSTGNGIHISSAPSLQGPWTEVGYALPDGSSINHDGNKNLWAPDVHKGDDGKYYMYYSVSTLGSQNSVIGVASSTTMEPGSWTDHGSTGLSSDGSQGYNTIDANWIKIGDQQVLNFGSYWQGLYQIDLAGPLKIGTAAPVNIAYNATGQHAIEASFLYQQNGFYYLFFSSGKANGYDTSFPAQGEEYRINVCRSSTGRGDFVDKNGVSCLQSGGTTVLASHDNVYGPGGQGVLEDNGAVLYYHYAPRNGDLSVSSYQFGWNRLNWVDGWPTV

SEQ ID NO: 4527 - protein, 374 aa, Aspergillus flavus
  strain ATCC 200026 / FGSC A1120 / NRRL 3357 / JCM 12722 / SRRC 167
MLNIMTLRVLSATLFILQCASALPALNSSIETYHFPEGLDRAHSYGIQVKQSTGGVHTVESYSAIVSEANTTSGKGIEHNTSFALFDFEGSADLIVTYNNGPVKSAVIRPYSYGIKPTVKGNTVSFSLDRPRNVVLQVNNDIFDTLQLFTNAIETDIPSQRDPNVVYFGPGIDNGPSSKNGTLVIPSGKVVYLAPGAVVTSRLAFQNATSGSIQGRGVINPRSSGGILIEWSSNILVKDILILGAKGFSVTTGTSKNITMSGIRSMSSTGNGDGIDFFCSEDVLIDGVFLRNSDDNIALYQHRWNYYGNSKNITVQNSSLWADWAHPINIGTHGNTDKLRQWTVLPSAILTSWITASRKCGIRGALRSIPEIVT

SEQ ID NO: 4528 - protein, 639 aa, Aspergillus flavus
  strain ATCC 200026 / FGSC A1120 / NRRL 3357 / JCM 12722 / SRRC 167
MHMLSFIGALALPVFVCAQSCEPASLSPRLAGVDLEKFRLTPNAEYVDSDQQIPISTTNVGLIEQSYVETAIKLVRETFPTASFRLREDHYVGDNGVAHVHFRQTVHDLDVDNGDFNVNVGRDGSVFSYGNSFYTGPVPSITQLTKRDFTDPVAALKFALTHLQLPITAGDVSAESTEHPHKYILRGTSGAVTDPKARLVYLVKPEGTLCLVWRVETDVDDNWLLTYVDAKTAEDIHGVVDYISEATFQVYGWGINDPGQVDSRAVLTDPWNLKESPLTWFSDGQKNWTTTRGNNGIAQENINNLPTYLNNFRPDSPTQNFSYEYPAGGSPKDYINASITQLFYTANAYHDLLYTLGFNEKAGNFQWNNSGLGGKDKDYVILNAQDGASRNNADFATPPDGSPARMRMYLFTHTTPPRDGVFESGIVIHEYTHGLSMRLTGGPDNSRCLSAFESASMGEGWGDFMATAIRLKPSDTRATDYGMGMWVYNDEKGIRQYLYSTSMETNPLNYTSLNRMWEAHAGGTVWASMLYEVLWNLIDKHGKNDGPRPTFDERGVPRDGKYLAMKIVIDAMALQPCNPDFVQARNAILDADQALTGGQNKCEIWTGFAKRGLGQGAEYGRGRRVGSYDIPSGVCQKKI

SEQ ID NO: 4529 - protein, 815 aa, Aspergillus flavus
  strain ATCC 200026 / FGSC A1120 / NRRL 3357 / JCM 12722 / SRRC 167
MASIAHLVVSGLLAATAVNGQNYGGSGRSDDAFSYVQPRNTTILGQYGHSPAVLPSPNATGAGGWEEALAKAQQFVAQLTLEEKADMVTGQPGPCVGNIVAIPRLGFKGLCLQDGPLAIRVADYASVFSAGVTAASTWDKDILYERGVAMGEEFKGKGAHVALGPVAGPLGRSGYGGRNWEGFAADPYLTGVAMERTIQGYQDAGVQACAKHFIGNEQETQRNPNYNPNGTLTDVIQEAISSNIDDRTIHELYLWPFANAARAKVASVMCSYQRLNGSYACQNSKVLNGLLKEELGFQGYVQSDWGGTHSGVSSIEGGLDMNMPGGLGQYGQTPEAGSFFGKNVTFAVNNGTVDISRVDDMIVRIMTPYYWLGQDQGYPEIDPSSADLNTFSPRSTWLREFNLTGERSRDVRGDHGELIRRHGAEATILLKNENKALPLKAPKSIAVFGNDAGDTTEGAVNKATFEFGTLAAGGGSGTGRFTYLVTPLEALKARGKQDNTLVQWWLNNTLIADSDVTSLWVPTPPDACLVFLKTWAEEGSDREYLSVDWNGNEVVDSVASKCNNTIVVTHSSGINELPFANHPNVTAIVAAHYPGQESGNSIVDILYGDVNPSGKLPYTIAKNGSDYNAPPTTAVETTGADDWQAWFDEKLEIDYRYFDAHNISVLYEFGFGLSYTTFSLSDIKTEPLAESISSVPEQLPIQPGGNPALWESVYNVSVTVTNTGDVKGATVPQLYVTFPDSAPAGTPPKQLRGFDKVSLAPGESQTVGFELMRRDLSYWDVVSQEWLIPEGEFTIRVGFSSRDLSQETKITPVTA

SEQ ID NO: 4530 - protein, 347 aa, Aspergillus flavus
  strain ATCC 200026 / FGSC A1120 / NRRL 3357 / JCM 12722 / SRRC 167
MLFSYLLATLPLLANAALTYKGADISSVFIEEKAGVAYKNLAGETQALEAILTDNGVNSIRQRVWVKNGDYDLTYNVNLAKRVAATGASIYLDLHYSDDWADPKHQTTPDGWSTDDINTLADQIYQYTLSVCNTFAEEKINVEIVSIGNEITSGLLWPLGKTPNYENIARLLHSGAWGVKDSKLATKPKILIHLDNGWDWDQQKYFYDTALGTGLLTSDDFDMIGVSYYPFYNEKATLASLKTSLTNIQTTYGKEVAVVETNWPVKCSSPEFAFPADLKDIPFSVDGQVTFLQRLADTLTATKASGFFYWEPAWTKNAGLGSSCEDNLLVDYNTNQVRSSVKAFGQV

SEQ ID NO: 4531 - protein, 866 aa, Aspergillus flavus
  strain ATCC 200026 / FGSC A1120 / NRRL 3357 / JCM 12722 / SRRC 167
MAAFPAYLALLSYLVPGALSHPEAKTLTSRASTEAYSPPYYPAPNGGWISEWASAYEKAHRVVSNMTLAEKVNLTSGTGIYMGPCAGQTGSVPRFGIPNLCLHDSPLGVRNSDHNTAFPAGITVGATFDKDLMYERGVGLGEEARGKGINVLLGPSVGPIGRKPRGGRNWEGFGADPSLQAFGGSLTIKGMQSTGAIASLKHLIGNEQEQHRMSSVITQGYSSNIDDRTLHELYLWPFAESVRAGAGSVMIAYNDVNRSACSQNSKLINGILKDELGFQGFVVTDWLAHIGGVSSALAGLDMSMPGDGAIPLLGTSYWSWELSRSVLNGSVPVERLNDMVTRIVATWYKMGQDKDYPLPNFSSNTEDETGPLYPGALFSPSGIVNQYVNVQGNHNVTARAIARDAITLLKNNDNVLPLKRNNTLKIFGTDAGTNSDGINSCTDKGCNKGVLTMGWGSGTSRLPYLITPQEAIANISSNAGFHITDTFPSGVTAGPDDIAIVFINSDSGENYITVDGNPGDRTLAGLHAWHNGDNLVKAAAEKFSNVVVVVHTVGPILMEEWIDLDSVKAVLVAHLPGQEAGWSLTDILFGDYSPSGHLPYTIPHSESDYPESVGLIAQPFGQIQDDYTEGLYIDYRHFLKANITPRYPFGHGLSYTTFNFTEPNLSIIKALDTAYPAARPPKGSTPTYPTAKPDASEVAWPKNFNRIWRYLYPYLDNPEGAAANSSKTYPYPDGYTTEPKPAPRAGGAEGGNPALWDVTFSVQVKVTNTGSRDGRAVAQLYVELPSSLGLDTPSRQLRQFEKTKILAAGESEVLTLDVTRKDLSVWDVVVQDWKAPVNGEGVKIWVGESVADLRVGCVVGEGCSTL

SEQ ID NO: 4532 - protein, 914 aa, Aspergillus flavus
  strain ATCC 200026 / FGSC A1120 / NRRL 3357 / JCM 12722 / SRRC 167
MRFTATAAALVASSIPATLGQHVRDLSNEKWTLSSDALNHTVPGNLPSHAHLDLLKAGVIDDPYHGLNDFNLRWIPESNWTYTTDKIKDLMPIEFCGKYVASTNNQYRQYSFDVSQILEGCNEDPILKIDFGSAPNIVNAIAEDRNSPVWPDGIQQTYEYPNRWFMRKEQSDFGWDWGPAFAPAGPWKPAYIVQLPKAQNIHVLNTDLDIYRKGQINHLPPDQSQPWVVNASIDFVGSLPPNPSMSIEFKDTKSGEILTSKRIGNVTVSGNSVTGVTVLGGVTPKLWWPLGLGDQNLYNITVTVTGHQNQTLAHVTKRTGFRTIFLNQRNITDAQLAQGIAPGANWHFEVNGHEFYAKGSNIIPPDAFWPRVTEARMARLFDAVVAGNQNMLRVWSSGIYLHDFIYDLADERGILLWSEFEFSDALYPVDDAFLDNIAAEVVYNVRRVNHHPSLALWAGGNEIESLMLPTVERKAPEEYAKYVGEYEKLYISLILPLVYQNTRSITYSPSSTTEGYLDVDLSAPVPMVERYHNTTPGSYYGDTDFYNYDSSVSFNSHVYPVGRFANEFGYHSMPSLQTWQQAVDPEDLHFNSTTVMLRNHHYPAGGTFTDNFHNTSLGMGEMTIAVQRYYPIPNKLDSVANFSAWCHATQLFQADMYKSEIQFYRRGSGMPERQLGSLYWQLEDIWQAPSWAGIEYGGRWKVLHYVSRDIYQRIIVSPFWNYTTGDLDLYVTSDLWESAKGKVNLTWLDLSGTPLPHNAGTPGSVPFNVGALNTTKIYSTNIKNLTLPNPKDAILVLSLSGEGHLPNSDKKTTFTHQNHFTPVFPKDLALVDPGLELSYNTKSKTFTVEAKSGVSLYTWLDYPADVVGYFDENAFVLLPGQKKEIGFTVQEDNTDGKWVQGVTVQSLWNQTLEK

SEQ ID NO: 4533 - protein, 526 aa, Aspergillus flavus
  strain ATCC 200026 / FGSC A1120 / NRRL 3357 / JCM 12722 / SRRC 167
MPSLRRLLPFLAAGSAALASQDTFQGKCTGFADKINLPDVRVNFVNYVPGGTNLSLPDNPTSCGTTSQVVSEDVCRIAMAVATSNSSEITLEAWLPQNYTGRFLSTGNGGLSGCIQYYDLAYTSGLGFATVGANSGHNGTSGEPFYHHPEVLEDFVHRSVHTGVVVGKQLTKLFYEEGFKKSYYLGCSTGGRQGFKSVQKYPNDFDGVVAGAPAFNMINLMSWSAHFYSITGPVGSDTYLSPDLWNITHKEILRQCDGIDGAEDGIIEDPSLCSPVLEAIICKPGQNTTECLTGKQAHTVREIFSPLYGVNGTLLYPRMQPGSEVMASSIMYNGQPFQYSADWYRYVVYENPNWDATKFSVRDAAVALKQNPFNLQTWDADISSFRKAGGKVLTYHGLMDQLISSENSKLYYARVAETMNVPPEELDEFYRFFQISGMAHCSGGDGAYGIGNQLVTYNDANPENNVLMAMVQWVEKGIAPETIRGAKFTNGTGSAVEYTRKHCRYPRRNVYKGPGNYTDENAWQCV

SEQ ID NO: 4534 - protein, 827 aa, Aspergillus flavus
  strain ATCC 200026 / FGSC A1120 / NRRL 3357 / JCM 12722 / SRRC 167
MALDIDYVLSHISQEDKIALLAGIDFWHTHPIPELNVPSIRSTDGPNGIRGTKFFAGVPAACLPCGTALASTWDQNLLREVGVLIGKECLAKGAHCWLGPTINMPRSPLGGRGFESFAEDPHLAGAMAASMITGCESTGVISAVKHFVGNDQEHERRAVDVLVTQRALREIYLRPFQIVARDAGPGALMTSYNKINGKHVVESKEMLDMVRQEWKWNPLIMSDWLGTYTTIDSMNAGLDLEMPGPSRYRGRYVESALQARLIKESTIDSRARKVLEFVQQASRAPVSAVETGRDYPEDRALNRNLCANSIVLLKNQNDILPLPKTIKKIALVGSHVRTPAISGGGSASLEPYYTVSLYDAVSEALPHTEILYEVGAYAHKMLPVIDRLLTNAVMHFYNEPVGTERILRATQRMSKTAFQLMDFNAPELNRGLFYATLTGDFTPDVSGVWDFGLTVFGTGLLYVDDELVVDNTTHQTRGTAFFGKGTVQELGSKTLNAEQTYKIRIEYGSANTSPMKAIGVVHFGGGAAHLGACLHVDSAEMVRSAVKAAAEADYTILCTGLNHEWESEGFDRSHMDLPPGIDALITSVLDVAANKTVIVNQSGTPVTMPWADRARGIVQAWYGGNETGHGIADVIFGDVNPSGKLPLSWPVDVKHNPAYLNYASVGGRVLYGEDVYVGYRYYEKVGREVLFPFGHGLSYTTFTVSPDVVFSQEVFRPEEPPTAAVKIKNTGKVAGAQVLQLYISAPHSPTPRPTKELHGFTKVLLQPGEERVAHIRMDKYATNFWDEIEGMWKSEEGIYEALIGTSSQNILAKGTFRVDRTRYWLGL

SEQ ID NO: 4535 - protein, 418 aa, Aspergillus flavus
  strain ATCC 200026 / FGSC A1120 / NRRL 3357 / JCM 12722 / SRRC 167
MKATDLFHVTVLVAGALALEHQQPLIGDLSQDLNHIIDSSPLLSFHRALVQIPSISEHEKNVGEYVLDFLSSQNLTVEKQIVTPESDTEEERFNIYAYVGKNRQPDVLVTSHIDTVPPFIPYSLHAPTSDTSFIRTDLVIAGRGTVDAKASVAAIVFAALETLDENPNASIGLLFDVGEENSGVGMKHFSNSELNPTPPTYHTVIFGEPTELSLVAAHKGTLGFKLVAEGKAAHSGYPWLGESAISSLIPVLAHLDTLQDLPPEKGGLLRSETLGKSTLNIGRVHGGIAANVVPAHAEAAISVRLAAGTPEDTRTIIERAVAKVTSGDRSVYPDFGDRKAGAPPQYFDVDVDGFEVITVNYGTDAPALKIHDQRTQRVKRYLYGPGSILVAHADNEAITVGELEEAVRGYKRLIAASL

SEQ ID NO: 4536 - protein, 324 aa, Aspergillus flavus
  strain ATCC 200026 / FGSC A1120 / NRRL 3357 / JCM 12722 / SRRC 167
MHGSLLKLALLSFSLASSAAVLPRDTGRTSAPSGCSTVGTSGDYSTIGDALTALGSSTADACIYIAAGTYEEQLVINYAGHLTLYGETTDTQTYKQNTVTITHTISSPEAGSLDNSATVNIKSDLVSVYNINIANGYGSGAQAVALVANADQLGFYACQFTGYQDTLYAKAGHQYYINSRIEGAVDYIFGDASAWFENCDIVSNGAGYITAMSRETTSDTAWYAIDHCNIKAASGVDLTGDVYLGRPWRVLARVIYQYSVLPDIINAKGWHSMADGATPLYYEFNNTGAGSDTSDREYLSTIDAPVAKETVLGDDYKNWVDSSY

SEQ ID NO: 4537 - protein, 406 aa, Aspergillus flavus
  strain ATCC 200026 / FGSC A1120 / NRRL 3357 / JCM 12722 / SRRC 167
MISLNSIFLLSLVGLSRAAPSRSETSPDRTIKPRAACTPTAGGSSSTDDVPAIQEAITSCGDGGTIVIPADTTYYLNSVLDFKGCSNCDFQVEGLLQFTSSTDYWNGKTAMISVSDIDGLKLRSVTGSGVIDGNGQESWDKFAEDSSYKRPTLLYITGGSNIEVSGLRQKNPPNVFISVKGDTSNAQFTSLTMDATSNSDNLPKNTDAFDIGASTYVTISSVAITNDDDCVAFKPGANYVTVENVSCTGSHGISVGSLGKSSDDTVQNVYARNITMINSSKAAGIKTYPSGGDHGLSTVKNATFEDFIVDGCDYAFQIQSCYGEDDTYCEENPGDAVLEGIVVKGFTGTTSDKEDPVVANLNCGSKGTCDVTISGFEVKAPSGDAKILCGNTPSDLGVTCSSGASG

SEQ ID NO: 4538 - protein, 521 aa, Aspergillus flavus
  strain ATCC 200026 / FGSC A1120 / NRRL 3357 / JCM 12722 / SRRC 167
MKVSLWLTLLGVNLSLALAVGTDFPASCQAFSPDTRAANAHREFTEYVPAGTNLSLPYNDATCARPNQVVTVDLCRVALYVETSNRSSVTTEIWLPRNWTGRFLGTGNGGIDGCIKYEDLAYGAANGFAVVGSNNGHNGTTAASFYQNSDVLADFAWRALHLSTVIGKEITQAFYGEPHRKSYYLGCSLGGRQGINSAVEFPDDFDGIIAGSPAVDFNSLVSWRASFFPITGSANSTDFISVSTWKDLIHAEVLTQCDTLDCVNDGIIEDPSLCNFCPEALKCTDDRINNCLSPAQVEIVRKVFSPMYGEDGQLIFPAMQPGSELEAADQLYTGKPFRYSKEWFQYVVYNPSWDPAEFDIHDAKVADDLNPQNIRTWPNDLSNYEKRGGKIITFHGQQDGKITSFNTERFYNHLATAMNMSSSELDNFFRFFRISGMSHCSSGPGAWAFGQGGSPAPAMTPFNGNENILAALVAWVEHGVAPETITGTKYVDDNPELGISIRRSHCRFVIQLNHGRHELCY

SEQ ID NO: 4539 - protein, 414 aa, Aspergillus flavus
  strain ATCC 200026 / FGSC A1120 / NRRL 3357 / JCM 12722 / SRRC 167
MFLSRVFCVLAALACVSAARETCVVPAGGSNATDDAPAIVHAFKKCGRGGKVVFKPTTYHIGSVMNITWLEDVDIDLGGTLLWGTNIQYWLNHSLPVGYQNQSTAFILGGNNVRIDGHGIGTLDGNGDTWYQWIKEQPNTSNYPGRPHAITFNGLTNSVVRGLRFLRSQMCHHVEFDSILVNNTGNVVSSSNTDGADTIRSSHITFNNWTVYNGDDSISLKGNSTDITITNSNLYNGLGIALGSIGQYKDQFETIERLKVSNVNFHNTLHAIYVKTWTADQNGYPPNGGGGGLGYISDVTAKDLKATSLRGAAFAISQCTRFSGAPGEGNCTNSEFQVRDISVLNLSGTTESNRVASLQCSAVAPCTDIALSGINLELKNGTAASEYLCGNVENQKGFECTGAVCEGGSATGEC

SEQ ID NO: 4540 - protein, 419 aa, Aspergillus flavus
  strain ATCC 200026 / FGSC A1120 / NRRL 3357 / JCM 12722 / SRRC 167
MRLTPSLISCLSLLHFTSALVAFPGAEGFGANAVGGRQGEVYVVSNLNDSGEGSLRDAVSQPGRIVVFSVGGVIEITDRIVVSKQVTILGQTAPGDGITVYGNGWSFSNADDAIVRYIRIRMGKGGSSGKDAMGIADGKNMIFDHVSVSWGRDETFSINGDVSNVTIQNSIIAQGLETHSCGGLMQTDGGVSLFRNLYIDNKTRNPKVKGVNEFTNNVIYNWGGGGGYIAGGSDGESNVNVIGNYFISGPDTSVTAFTRGNENFHAYVETNYYDSDKDGTLNGSELGVDSTNYGGMDLVTEKYDYPAVASVLSPDDALTYVTKYAGASKVRDSVDTQLVAQVESYGKDGALISDEADMGGAGDLDQGTTPTDTDGDGIPDDAEAELGTDPNTADSMDLDTSGYTFLEVWANSLVPSSYA

SEQ ID NO: 4541 - protein, 861 aa, Aspergillus flavus
  strain ATCC 200026 / FGSC A1120 / NRRL 3357 / JCM 12722 / SRRC 167
MKLGWIEVAALAAASVVSAKDDLAYSPPFYPSPWADGQGEWAEVYKRAVDIVSQMTLTEKVNLTTGTGWQLERCVGQTGSVPRLNIPSLCLQDSPLGIRFSDYNSAFPAGVNVAATWDKTLAYLRGQAMGEEFSDKGIDVQLGPAAGPLGAHPDGGRNWEGFSPDPALTGVLFAETIRGIQDAGVIATAKHYIMNEQEHFRQQPEAAGYGFNVSDSLSSNVDDKTMHELYLWPFADAVRAGVGAVMCSYNQINNSYGCENSETLNKLLKAELGFQGFVMSDWTAHHSGVGAALAGLDMSMPGDVTFDSGTSFWGANLTVGVLNGTIPQWRVDDMAVRIMAAYYKVGRDTKYTPPNFSSWTRDEYGFAHNHVSEGAYERVNEFVDVQRDHADLIRRIGAQSTVLLKNKGALPLSRKEKLVALLGEDAGSNSWGANGCDDRGCDNGTLAMAWGSGTANFPYLVTPEQAIQNEVLQGRGNVFAVTDSWALDKIAAAARQASVSLVFVNSDSGEGYLSVDGNEGDRNNITLWKNGDNVVKTAAENCNNTVVIIHSVGPVLIDEWYDHPNVTGILWAGLPGQESGNSIADVLYGRVNPGAKSPFTWGKTRESYGSPLVKDANNGNGAPQSDFTQGVFIDYRHFDKFNETPIYEFGYGLSYTTFELSDLHVQPLNASRYTPTSGMTEAAKNFGEIGDASEYVYPEGLERIHEFIYPWINSTDLKASSDDSNYGWEDSKYIPEGATDGSAQPLLPASGGAGGNPGLYEDLFRVSVKVKNTGNVAGDEVPQLYVSLGGPNEPKVVLRKFERIHLAPSQEAVWTTTLTRRDLANWDVSAQDWTVTPYPKTIYVGNSSRKLPLQASLPKAQ

SEQ ID NO: 4542 - protein, 201 aa, Aspergillus flavus
  strain ATCC 200026 / FGSC A1120 / NRRL 3357 / JCM 12722 / SRRC 167
MDARNIRLTNFVYQGGDDCIAIKPRSYDINIHNVTCRGGNGIAIGSLGQYKEDSSIIRYNDDMHGSAYIKTWTGVPTPQDSYDSAGLPRGGGRGNVSNLIFSNFEAQGANIGPTINQNQGDNGSYSGTSLMTVSDITFANCTGYVTNEGEVTSTVTCSENHPCYDIYYDNVVLYQGKNASEPGIGSCKWTTDNGVHGLEGC

SEQ ID NO: 4543 - protein, 375 aa, Aspergillus flavus
  strain ATCC 200026 / FGSC A1120 / NRRL 3357 / JCM 12722 / SRRC 167
MKYAAVLTTVAALASRALGAGVSGTAEGFASSATGGGSATAVYPTTTDELVSYLGDDEARVIVLSQTFDFTNTEGTTTETGCAPWGTGSACQVAINKDDWCTNYESSAPSTSVTYDNAGSLGITVNSNKSLIGEGTKGVIKGKGLRIVNGVENVIIQNIAVTDINPKYVWGGDAITINQADLVWIDHVTTARIGRQHYVLGTEADNRVTLSNNYIDGESDYSATCDGHHYWNVYLDGSSDKVTMKGNYFYKTSGRAPKVQGNTYLHAVNNYWNDNSNHAFEIGSGGYVLAEGNTFADVTAAVEDSSFEGELFSSSSDADTCSSYIGRACKANSFTNSGDLSGTTVDVLSKFKGETVATADTASTAPASNAGQGNL

SEQ ID NO: 4544 - protein, 386 aa, Aspergillus flavus
  strain ATCC 200026 / FGSC A1120 / NRRL 3357 / JCM 12722 / SRRC 167
MKLNPSLLTAAGLVSAQLASALPQASSSTVSPSPSPSATPGSFVTTSGLNFVIDGKTGYFAGSNSYWIGFQKNNDDVDLVFSHLQESGLKILRVWGFNDVNQKPTDGSVYYHLLADGTATVNEGEDGLQRLDYVVSSAEKHGIKLIINFVNFWDDYGGINAYVKAFGGSKEDFYTNDAMQAAYRAYIKAVISRYSDSTAIFAWELANEPRCQGCETTVLYNWIESTSQYIKSLDSKHLVCIGDEGFGLDTGSDGSYPYQYSEGSDFAKNLAIPTIDFGTFHLYPSSWGTTNDWGNGWVTSHGAACKEAGKPCLFEEYGVTSDHCAVEKPWQNTALNTTAISGDLYWQYGDQLSGGPSPDDGNTFYYGTDDFKCLVTDHIAAINSRN

SEQ ID NO: 4545 - protein, 844 aa, Aspergillus flavus
  strain ATCC 200026 / FGSC A1120 / NRRL 3357 / JCM 12722 / SRRC 167
MAAFSQYPLSTGWSFKDSDDQSPEAWMPVPVVPSVAHQDLQANQKLKNPYIGFNELDARWVNDKSWTYRTVFQKPAVAAGSSIILAFDGLDTFATVKLDGSVILQSDNMFLAHRVDVTKALEAEGDHVLEIDFDCAMRRARELREKDTKHNWASFNGDPARMAVRKAQYHWGWDWGPLLSTAGIWREVRLEVYSAKISDLWTEVELASDHQTARVSAFTEVDAADSVDSYKASFLLSLHGKEVAREVATLKDKVAKVTFDVTQPSLWWPNGYGDPALYEISVSLEKEDCEIHSVSKKIGIRTAELIQQPDRHGKSFFFRINGVDVFCGGSCWIPADNLLPSITAERYRKWIELMVAGRQVMIRVWGGGCYEDDSFYQACDELGVLVWQDFMFGCGNYPTWPELLESIEKEANYNVRRLRHHPSIVVYVGNNEDYQVQESAGLVYDYEDKNPENWLKTDFPARYIYEKLLPSVVEKLSPKTVYHPGSPWGDGKITSDPTVGDMHQWNVWHGTQEKYQIFDTLGGRFNSEFGMEAFPHMSTIEYFVENEADKYPQSHVLDFHNKADGHERRIATYLVENLRTATDLETYVYLTQVVQAETMMFGYRGWRRQWGDERHCGGALLWQLNDCWPTISWAIVDYFLRPKPAFYAVARVLKPIAVGVRREHHDWSVTHAQPPKTSKYELWIASSLQKETVGTIELRFLSVNTGLDVRAPILRDNVKIVPNGTTNILEGVINHKAQPEPHVLAARLWVDGEVTARDVDWPQPFKYLDLSDRGLEVNKVSESGNEQKLLITAKKPVKCLVFEERDGIRVSDSAMDIVPGDGQTVTVTGLKAGDAPLKYKYLGQ

SEQ ID NO: 4546 - protein, 416 aa, Aspergillus flavus
  strain ATCC 200026 / FGSC A1120 / NRRL 3357 / JCM 12722 / SRRC 167
MIWTLAPFVALLPLVTAQQVGTTADAHPRLTTYKCTSQNGCTRQNTSVVLDAATHFIHKKGTQTSCTNSNGLDTAICPDKQTCADNCVVDGITDYASYGVQTKNDTLTLQQYLQTGNATKSLSPRVYLLAEDGENYSMLKLLNQEFTFDVDASTLVCGMNGALYLSEMEASGGKSSLNQAGAKYGTGYCDAQCYTTPWINGEGNTESVGSCCQEMDIWEANARATGLTPHPCNTTGLYECSGSGCGDSGVCDKAGCGFNPYGLGAKDYYGYGLKVNTNETFTVVTQFLTNDNTTSGQLSEIRRLYIQNGQVIQNAAVTSGGKTVDSITKDFCSGEGSAFNRLGGLEEMGHALGRGMVLALSIWNDAGSFMQWLDGGSAGPCNATEGNPALIEKLYPDTHVKFSKIRWGDIGSTYRH

SEQ ID NO: 4547 - protein, 284 aa, Aspergillus flavus
  strain ATCC 200026 / FGSC A1120 / NRRL 3357 / JCM 12722 / SRRC 167
MAFINSAAEDEVQFEGIKRRLRSSGITKEAVTSLGAGETLEDEFDIASTSDLASGGPVSIRSHGFVPIVVDGKITGYIPYKSNDLTVNVDGGKAAKVTKALSQLTRRTEVTDCKGDAESSLTTALSNAAKLANQAAEAAESGDESKFEEYFKTTDQQTRTTVAERLRAVAKEAGSTSGGSTTYHCSDPYGYCEPNVLAYTLPSKNEIANCDIYYSELPPLAQKCHAQDQATTTLHEFTHAPGVYQPGTEDLGYGYDAATQLSAQDALNNADSYALYANAIELKC

SEQ ID NO: 4548 - protein, 751 aa, Aspergillus flavus
  strain ATCC 200026 / FGSC A1120 / NRRL 3357 / JCM 12722 / SRRC 167
MFGSPKRAALAAASLLAIFGNGPSVMAQETSSNNAVVADGKTFALNGENVSYRFRVNETTGDLVSDHFGGSITGDLFPGFGAEALGGWVGLAGRFRREFPDHGRGDFRIPAVRIRQEAGYTVTDLQYQSYSVIPGKPALPGLPSTFGSEEDVTTLVVHLYDNYSSIAVDLSYSIFPKYDAIVRSANVTNKGTQNITVEALSSFSFDFPYEDLEMISLRGDWAREAHRQRRKVEYGLQGFGSSTGFSSHLHNPFLAIVHPSTTESQGEAWGFNLVYTGSFSVDVEKGSQGLTRALLGFNPSQLSWQLGAGETLTSPECVSVYSSDGIGGMSRSFHRLYRNHLIKSKFATSDRPPLLNSWEGLYFDYNESTIYRLAEESAALGVKLFVMDDGWFGDKYPRVSDNAGLGDWVPNPDRFPDGLTPLVEDVTKLKAGNSSTDLRFGLWVEPEMANPNSTLYHEHPDWVLHAGQYPRTLQRNQLVLNLALPEVQDYIIDEITNILNSSAISYVKWDFNRAMHETPSPSNDHEYILGMYRVFDTLTTRFPDVLWEGCASGGGRFDPGVLEYFPQIWTSDNTDALMRITIQLGTSLAYPPSAMGAHLSAVPNAQTGRTIPVKFRGHVAMMGGSFGLELDPAELQEDEKAEVPGLIALAEKVNPIILTGDMWRLRLPEESNWPAVLFISEDGNQAVLFYFQLGPNVNHATPWLRLQGLDPKATYSVDGNGSYSGATLMNMGLQYKFESDYDSKVVFLQKQ

SEQ ID NO: 4549 - protein, 257 aa, Aspergillus flavus
  strain ATCC 200026 / FGSC A1120 / NRRL 3357 / JCM 12722 / SRRC 167
MYQKLLLVPLLLTSALASPHDASSHQKFHQLNERAAFPIPASKGSQTFKEPYYVKGTYDGGMKTFGRGVKCTGQKEGGDKDAVFIVADGGILRNAIIGADQIEGVHCEGSCTIENVWWQEVCEDALTFKGTGTGVHKVIGGGAQGADDKVIQHNSGGSAIIQDFTVQNFGKLYRSCGNCKKQFKRTVQISGVKASNGKTLVGINPNLGDSATIDGCASSVKEICVEYEGTDNNGKEPKKAHSGPSNTCKFKEPLASC

SEQ ID NO: 4550 - protein, 435 aa, Aspergillus flavus
  strain ATCC 200026 / FGSC A1120 / NRRL 3357 / JCM 12722 / SRRC 167
MKFFLATLFASAVSSIAVDRLIPGAQIIPESDTRALLRVGGHHDKYHDRRTITIRPSRNDTDDVSRDFLWGIKHANHGGRLLLKKGEKYVIGRKLDLTFLDDIEVQLDGELKFTDDVSYWQENNFYYDFQKSITFWRWGGKDIKIFGTGLLNGNGQRWYNEFAGQEILDPDNEYYRPILFLTENATRISVEGITQLNSPCWTNFFIQSKDVSFDDVYIHAFSTNKSALPKNSDGFDSLNVDGLTVTNTRVDVGDDCFSPKPNTTNIFVQNLLCNNTHGVSMGSIGQYPGVMDIIEHAYIENVTLLNGQNGARLKAWAGQDVGYGRINNITYKNIRIENTDAPVVLDQCYFDIEAAECAQYPSQVNVTNILFENISGTSSGKNGKVVADLVCSPNAVCSDIQLKNINLTSPAGSPPEIVCEGVQGDIGVECQASAD

SEQ ID NO: 4551 - protein, 324 aa, Aspergillus flavus
  strain ATCC 200026 / FGSC A1120 / NRRL 3357 / JCM 12722 / SRRC 167
MVHLKALASGTLFASLASSAVISRQAAASINDAFVAHGKKYFGTCSDQALLQNSQNEAIVRADFGQLTPENSMKWDALEPSQGSFSFAGADFLADYAKTNNKLVRGHTLVWHSQLPSWVQGITDKDTLTEVIKNHITTIMQRYKGQIYAWDVVNEIFDEDGTLRDSVFSQVLGEDFVRIAFETAREADPNAKLYINDYNLDSADYAKTKGMVSYVKKWLDAGVPIDGIVSLLPPRDEGLTSCTALTALASTGVSEVAVTELDIEGASSESYLEVVNACLDVSSCVGITVWGVSDKDSWRSSTSPLLFDSNYQAKDAYNAIIDAL

SEQ ID NO: 4552 - protein, 328 aa, Aspergillus flavus
  strain ATCC 200026 / FGSC A1120 / NRRL 3357 / JCM 12722 / SRRC 167
MRFQHLTTALAVGVSAHLAQAAGLHDAAVAKGLLYFGTATDNPELTNTSYVTQLNNTGDFGQITPGNSQKWDSTEPSQNEFSFTNGDVIADLADANDQKLRCHNLVWHQQLPNWVSSGSWTNETLTAVLQNHITNVVKHYKGRCYAWDVVNEALADDGSYRDSIWYKTIGEAYIPIAFAAAAAADKDVKLYYNDYSIEWGGSKSTAAQNIVKLIQSYGGKIDGVGLQAHFTVGQTPARKDLASNLKAFTDLGVEVAYTEVDVRMETPATDANLQQQSTEFANIPSSTATGRVKVYYQCGGINYQGSTECEEGLTCKKWNPYYSQCIQA

SEQ ID NO: 4553 - protein, 776 aa, Aspergillus flavus
  strain ATCC 200026 / FGSC A1120 / NRRL 3357 / JCM 12722 / SRRC 167
MVHLSPLLRPLAAFSFFTSLASTESIFPDCSTGPLSKNNVCDTSLDPVSRAKSLVAAMTLEEKINNTKYDSSGAPRLGLPAYNWWNEALHGVAEGHGVSFSDSGNFSYATSFPMPILLGAAFDDDLVKQVATVISTEARAFANGGHAGLDYWTPNINPFRDPRWGRGQETPGEDPLHLSRYVYHLVDGLQDGIGPERPKVVATCKHFAAYDLENWEGIERYAFDAVVSPQDLSEYYLPSFKTCTRDAKVDAVMCSYNSLNGIPTCADRWLLQTLLREHWGWEQTGHWVTGDCGAIDNIYADHHYVADGAHAAAAALNAGTDLDCGSVFPEYLRSALQQGLYNNQTLNNALIRLYSSLVKLGYFDPADDQPYRSIGWNEVFTPAAEELAHKATVEGIVMLKNDGTLPLKSNGTVAIIGPFANATTQLQGNYEGPPKYIRTLIWAAVHNGYKVKFSQGTDINSNSSAGFAEAISAAKEADTVIYAGGIDNTIEKESQDRTTIVWPGNQLDLIEQLSDLEKPLIVVQFGGGQVDDSSLLANAGVGALLWAGYPSQAGGAAVFDILTGKSAPAGRLPVTQYPASYVDEVPMTDMTLRPGSNNPGRTYRWYDKAVLPFGFGLHYTTFNVSWNHAEYGPYNTDSVASGTTNAPVDTELFDTFSITVTNTGNVASDYIALLFLTADRVGPEPYPIKTLVGYSRAKGIEPGQSQQVKLDVSVGSVARTAENGDLVLYPGSYKLEVDVGQDFPTATFTVSGKEKVLDEFPEPQQNATSAVTRWGR

SEQ ID NO: 4554 - protein, 328 aa, Aspergillus flavus
  strain ATCC 200026 / FGSC A1120 / NRRL 3357 / JCM 12722 / SRRC 167
MKLNLASLSFLASIAPLVSGHYVFSKLIVDGQTTKDFEYIRENSNGYQPTLASEIVNNDFRCNKGSMDSAAKTKVYTVAPGAEIGFQLAYGASMKHPGPLQIYMSKAPGDVKTYDGSGDWFKVYQEGVCEDISDGLKDTDWCTWGKDTASFKIPKDTPPGQYLVRVEHIGLHRGFSGNSEFYFTCAQIEVTGSGSGVPGPLVKIPGMYKPEDPNIHFDIYYPVPTSYDLPGPSVWSGGASSGSSSSISAPPVNNAAAASSVTPTTLVTLSKTSSTPAATSTAAPTLPAPSNGTIKKYYQCGGQGWTGSGSCEAGTTCRDWNPWYSQCV

SEQ ID NO: 4555 - protein, 387 aa, Aspergillus flavus
  strain ATCC 200026 / FGSC A1120 / NRRL 3357 / JCM 12722 / SRRC 167
MKIRAALALSATASGVLAAVVPQQALLNNPQIHHENEKYLIELAPYQTRWVTEEEKWALKLDGVNFIDITEERNPGFYPTLHQASNVRYPTKMEHVEEVVGLTHRLTKANMERDLEKFTSFHTRYYKSQTGIESATWLYNQVQTVIEQSGAAEHGATVDRFAHSWGQFSIIARIPGKSNKTVVLGAHQDSINLFLPSILAAPGADDDGSGTVTILEALRGLLQSDTVAQGKAPNTIEFHWYSAEEGGMLGSQAIFSQYKQERRDIKAMLQQDMTGYVQGALNAGRKEAVGIMIDYVDRGLTQFLKDVVTAYCNVGYLETKCGYACSDHTSASKYGYPSAMATEAEMENTNKRIHTTDDRIKYLSFDHMLEHAKLTLGFAYELAFASF

SEQ ID NO: 4556 - protein, 177 aa, Aspergillus giganteus
MVAIKNLVLVALTAVTALAVPSPLEARAVTWTCLNDQKNPKTNKYETKRLLYNQNKAESNSHHAPLSDGKTGSSYPHWFTNGYDGDGKLPKGRTPIKFGKSDCDRPPKHSKDGNGKTDHYLLEFPTFPDGHDYKFDSKKPKENPGPARVIYTYPNKVFCGIIAHTKENQGELKLCSH

SEQ ID NO: 4557 - protein, 94 aa, Aspergillus giganteus
MKFVSLASLGFALVAALGAVATPVEADSLTAGGLDARDESAVLATYNGKCYKKDNICKYKAQSGKTAICKCYVKKCPRDGAKCEFDSYKGKCYC

SEQ ID NO: 4558 - protein, 804 aa, Aspergillus japonicus
MAVAALALLALLPQALGQHNSSYVDYNVEANPDLFPQCLDTISLSFPDCQSGPLSKNLVCDSTASPYDRAAALVSLFTLEELIANTGNTSPGVPRLGLPPYQVWSEALHGLARANFTDNGAYSWATSFPSPILSAAAFNRTLINQIASIISTQGRAFNNAGRFGLDVYSPNINTFRHPVWGRGQETPGEDAYTLTAAYAYEYITGIQGGVNPEHLKLAATAKHFAGYDIENWDNHSRLGNDVNITQQDLAEYYTPQFLVAARDAHVHSFMCSYNAVNGVPSCSNTFFLQTLLRDTFSFVDHGYVSGDCGAVYGVFNPHGYAANEPSAAADAILAGTDIDCGTSYQYHFNESITTGAVARDDIERGFIRLYANLVELGYFDGNSSSSNPYRSLGWPDVQKTDAWNISYEAAVEGIVLLKNDGTLPLASPSEGKNKSIALIGPWANATTQLQGNYYGDAPYLISPVDAFTAAGYTVHYAPGTEISTNSTANFSAALSAARAADTIVFLGGIDNTIEAEAQDRSSIAWPGNQLELISQLAAQKSDDQPLVVYQMGGGQVDSSALKSNAKVNALLWGGYPGQSGGLALRDILTGARAPAGRLTTTQYPAAYAESFSALDMNLRPNETTQNPGQTYMWYTGEPVYAFGHGLFYTTFNASSAQAAKTKYTFNITDLTSAAHPDTTTVGQRTLFNFTASITNSGQRDSDYTALVYANTSTAGPSPYPNKWLVGFDRLAAVAKEGGTAELNVPVAVDRLARVDEAGNTVLFPGRYEVALNNEREVVVEVELVGEQVVLLKWPEEVQGVAGDE

SEQ ID NO: 4559 - protein, 362 aa, Aspergillus kawachii
MHFLQNAFVAATMGAAPAAATPLEKRSCTFTSASAAKSGKSSCSTITFDNIAVPAGETLDLTGLKKGTTVIFEGETTFGYKEWKGPLISMSGTDITVKQASGAKINCDGARWWDGKGSNGGKTKPKFFQAHKLDESSITGLKIYNTPVQGFSILADHLTITDVTIDDSAGTSKGHNTDAFDIGQSTYITIDGATVYNQDDCLAINSGEHITFTNGYCDGGHGLSIGSIGGRSDNTVNDVTISNSKVVNSQNGVRIKTIYGKTGTVENVKFEDITLSDISKYGIVVEQDYENGSPTGTPTNGVKVEDITFKKVTGSVKSSGTDIYILCGSGRCSNWTWSGVDVTGGKKSSKCKNVPSGASCSD

SEQ ID NO: 4560 - protein, 521 aa, Aspergillus kawachii
MRISNLIVAASAATMVSALPSRQMKKRDSGFKWVGTSESGAEFGSALPGTLGTDYTWPETSKIQVLRNKGMNIFRIPFLMERLTPDGLTGSFASTYLSDLKSTVEFVTNSGAYAVLDPHNYGRFDGSIIESTSDFKTWWKNVATEFADNDKVIFDTNNEYHDMEQSLVLNLNQAAINGIRAAGATTQYIFVEGNAYTGAWDWTTYNDDLSGLTDSEDKIIYEMHQYLDSDSSGTSETCVSSTIGKERIEKATEWLKTNNKQGIIGEFAGGVNSVCEEAVEGMLAYMSENSDVWVGASWWSAGPWWGTYMYSLEPTDGTAYSTYLPILEKYFPSGDASSSSSASASVAAATSAVSTTTTAAFEQTTTPATQVEIASSSSSSSAVAASQTTLSKVKSKSKSPCKLSSATSSAVSSAAAVTTPAVAATTPAAAPTSSSVAFATTSVYVPTTTAAAPSQVSSSAAASSSGVVGVSDPQGPSATNSAGEVNQYYQCGGINWTGPTVCASPYTCKVQNDYYYQCVAE

SEQ ID NO: 4561 - protein, 639 aa, Aspergillus kawachii
MSFRSLLALSGLVCSGLANVISKRATLDSWLSNEATVARTAILNNIGADGAWVSGADSGIVVASPSTDNPDYFYTWTRDSGLVIKTLVDLFRNGDTDLLSTIEHYISSQAIIQGVSNPSGDLSSGGLGEPKFNVDETAYTGSWGRPQRDGPALRATAMIGFGQVLLDNGYTSAATEIVWPLVRNDLSYVAQYWNQTGYDLWEEVNGSSFFTIAVQHRALVEGSAFATAVGSSCSWCDSQAPQILCYLQSFWTGSYILANFDSRRSGKDTNTLLGSIHTFDPEAGCDDSTFQPCSPRALANHKEVVDSFRSIYTLNDGLSDSEAVAVGRYPEDSYYNGNPWFQSTLAAAEQLYDALYQWDKQGSLEITDVSLDFFKALYSGAATGTYSSSSSTYSSIVSAVKTFADGFVSIVETHAASNGSLSEQFDKSDGDELSARDLTWSYAALLTANNRRNSVVPPSWGETSASSWPGTCAATSASGTYSSVTVTSWPSIVATGGTTTTATTTGSGGVTSTSKTTTTASKTSTTTSSTSCTTPTAVAVTFDLTATTTYGENIYLVGSISQLGDWETSDGIALSADKYTSSNPLWYVTVTLPAGESFEYKFIRVESDDSVEWESDPNREYTVPQACGESTATVTDTWR

SEQ ID NO: 4562 - protein, 362 aa, Aspergillus kawachii
  strain NBRC 4308
MHFLQNAFVAATMGAALAAAAPLEKRSCTFTSASAAKSGKSSCSTITLDNIAVPAGETLDLTGLKKGTTVIFEGETTFGYKEWKGPLISMSGTDITVKQASGAKINCDGARWWDGKGSNGGKTKPKFFQAHKLDESSITGLKIYNTPVQGFSILADHLTITDVTIDNSAGTSKGHNTDAFDIGQSTYITIDGATVYNQDDCLAINSGEHITFTNGYCDGGHGLSIGSIGGRSDNTVNDVTISNSKVLNSQNGVRIKTIYGKTGTVENVKFEDITLSDISKYGIVVEQDYENGSPTGTPTNGVKVEDITFKKVTGSVKSSGTDIYILCGSGSCSNWTWSGVDVTGGKKSSKCKNVPSGASCSD

SEQ ID NO: 4563 - protein, 275 aa, Aspergillus kawachii
  strain NBRC 4308
MLHRTISRILTTTTTTATILIILLSALITLTTAQQQQPQSKATVIVTIITTATATAPPTTTTTTTQEPPSYTSPALFQSSILDVSNTYRKAHNASNLIWNTTLTQYALNWAQECKWQHSNGPYGENLAFGYPNVSSAVAAWGDEVQKYNFQEPTGFTEETGHFTQLVWRETREVGCAAIDCGYNNTNTTTNDDDDNGNGKRSEAGGGGGGGGINGTERPQGWYVVCEYSPRGNIIGGNKKLGDKEFFKINVQPSSTYSGPYNTGSAGNGAQRVEF

SEQ ID NO: 4564 - protein, 633 aa, Aspergillus kawachii
  strain NBRC 4308
MATVRICVCGDEGTGKSSLITSLVKGVFVTNKIQPILPQITIPPTIGTPENVTTTTVVDTSALPQERNNLAREIRKSNVILLVYSDHYSYERVALFWLPYFRSLGVNVPVVLCANKSDLAADHTEAQVIEEEMLPLMAEFKEIDSCIRTSAREHRNVNEAFFLCQKAVTHPIAPLFDSKESSLKPAAIAALQRIFYLCDKDRDGYLSDKEIKDFQMRCFEKPLSEEDLIHIKETIQRTHPHSVTPSGIDCRGFLQLNKMYAEKGRHETVWIILRAFQYTDNLSLQENFLHPRFDVPPYASAELSPEGYRFFVNLFLLSDKDNDGGLNDAELASLFAPTPGLPASWADGSFPSSTVRNEAGHVTLQGWLAQWSMTTFTSPKTTLEYLAYLGFESSDRSNPSTTAALKVTRPRKRRKRPGRVGRNVVLGHVLGTAGSGKSALLDAFLSRGFSTTYRPTIQPRTAVNTVELPGGKQCYLILDELGELEPALLENQVKLLDQCDVIVYTYDSSDPDSFAYIPALRAKYPHLEELPSVFIALKADLDRTTQRAEYQPHEYTAMLNMPSPPLHVSATWSSIQEVFVHIAEAAMEPSTAFPRSEEDVEGKWMAWGIALGAVVCAGAAAVMIWRRVSGSGV

SEQ ID NO: 4565 - protein, 271 aa, Aspergillus kawachii
  strain NBRC 4308
MKLLSFLVGLAGLAAASPMGLAERQLSDGNELREGSCKPIIFIFARASTEPGLLGISTGPAVCNDLKMAKAGQVLCQGVGPAYTADLMSNALPDNTSPAAISEAESLFKLAASKCPNSQILAGGYSQGTAVMDDSIKQLSDDVKDKIKGVVLFGYTRNAQEGGQIGNFPKDKVKIYCAMGDMVCDGTLIVTAAHFTYVMNTGEASQWLESKLSDTTTSSLTDSSSSGTSSSTSTGDSSSESSSATGLGGLSGLSGLGSSTSGGFPSLASLF

SEQ ID NO: 4566 - protein, 440 aa, Aspergillus kawachii
  strain NBRC 4308
MSVFKASLLFLLSSSLVHGVPHSSRASRSQQCVVPSKYQASNGTADDSSAISQAFAECATDSVIIFEEGVNYNVFQPITATNLSNVEIRMHGNLHLPQNITAVQNIVSDGSSTWFTLEGPKVDWTGPEDVNNGWIDSYGQPWWDANPAGSSGIDNRPHLMSFKTSQATIKYFRSRKPIAWNVKLHGQDITVSHAIIDATSTGSFPFNTDGFDVEGTNIQITDSIMYNGDDAIAVGADSHDILFTRNTIGYQTHGMSIGSLGKDPTDFANISNIRFDDVTVVDGLYAARFKSWSGGTGLVKNVTWNNIRVFNVTFPIYVTQSYSDQGASRSGTVNASSAVMMEDFTWSDFSGSINTYQPGDGSCVSDPCWYNVGLPNLKHTEALIIECHTSQSCKNFVTDNIQLYPQVLEPASVICLNATAALNPDLGFTCKNGTYSPIST

SEQ ID NO: 4567 - protein, 521 aa, Aspergillus kawachii; identical to SEQ ID NO: 4560
  strain NBRC 4308

SEQ ID NO: 4568 - protein, 785 aa, Aspergillus kawachii
  strain NBRC 4308
MDTRQAKRKRQSSSSSGQRPQEPQEPPTPVSIRRTRRTEYHITSATSCNTPHQSKKVRFSDPGPGRQHGSAHSTGLTPAMLRSSFEERAEDDPLIRSPSRRQRRRSTPLPRSRRSMGAFDAASTASSEHVVQFTPLRQLLDARTKRRIRRIGLSDEINHLEREKRESAQYEKTLQTLLRERDSLKNELDSVKRNQDVSKSIASSEETTWLSPQSMIEQVSSENIRLREQLSFPSPGATTDHDTISNSEGETMVINESAWDCDTMLISNSPDIRGVDARVSVPDNISLLSQGHANTDASTQASIPDYRQEAEIIALSADLAAARKEKRDLFDACRARVASFSGTAIEGLLRQSSPPPDFLDQVLPTLAQTLRRASDAAQALDNVTEELSGLGFPGNNAEEIISTMRDQFRAARLQLERAVPGETANASLSDGKATLGALVKRVEILVKSLGGEQERLEGSVGRENALRGQFDTLLARYEGASKKIHDLEESIASSAGDMLHTRMRMQELECEGKEQAVSIQRLNAALDKYHEEVKGLEALVTELEDDKAKNNESHKQEVDELQQQLEEQARSLRTAESTVAERETRIRELEEALEQNRTSVRDLTARIESLEAERQQTIQDLEQEATEQQQRLEQEVGSMNVLVSELNTSLEEAKSDVDRLRRSNTGLEEQLRLEVEARDSLLDKWAAEQARSFAIMKETVNSERRKARVRTANWELRSDEIQSSDGLNIEPITPVSMTRFVDVEAGRGKHRKRLDSGVGILTDDLEDADAGIMPESLPSDPAELL

SEQ ID NO: 4569 - protein, 286 aa, Aspergillus kawachii
  strain NBRC 4308
MMRLARTVVYFALSFLPTAFADIEFIEPAAGAVIRAGDVVTAHWRDSGALPRLASLVQYDLYLCAGGDTAGSNVRALSMFSPLIQTLLTPRSSIQEDVALLVKDALFTRGNSVSFKIDPEVGGNDANAYFLRIAASGPETSVVNYSDRFTLTNMTGSFSPTVLNGIHSAIYSTDSFPSSLEDDNHEELRKRQVAGPFTIPYQLQTGPTRYAPMAKKPGSTIPAGTPTPQYPTSAYSVATTYLPQATVQMTLSASETYSVVSIENTASPAPHAGDTKMKRFLERWKD

SEQ ID NO: 4570 - protein, 304 aa, Aspergillus kawachii
  strain NBRC 4308
MLLSTHLLFVITTLVTSLLHPIAAHAVKRSGSLQQVTDFGDNPTNVGMYIYVPNNLASNPGIVVAIHYCTGTGPGYYGDSPYATLSEQYGFIVIYPSSPYSGGCWDVSSQATLTHNGGGNSNSIANMVTWTISKYGADSSKVFVTGSSSGAMMTNVMAATYPELFAAATVYSGVSAGCFYSNTNQVDGWNSTCAQGDVITTPEHWASIAEAMYSGYSGSRPRMQIYHGSIDTTLYPQNYYETCKQWAGVFGYDYSAPEKTEANTPQTNYETTIWGDSLQGIFATGVGHTVPIHGDKDMEWFGFA

SEQ ID NO: 4571 - protein, 438 aa, Aspergillus kawachii
  strain NBRC 4308
MVILSASGLAILAGLSLAASAVPSLQKNGTTCTVIPLGNGQDDVPNILSAVDQCGQTSGGRIVLPAPYTYRINQRMTTHLTDSRLEIGGTLLFSDNIDYWVNNSYRVDFQNQSSAWRITGHDYVVDGGPYQGGVDGNGQLWYTWAKGGSNVFGRPMPVHVFQSTRATLRNLAIRQPQFWAVLVDSSSHINLDNFYVNATNHDFSVSPEGEWVQNTDGIDTYRSDHITITNWIYQGGDDAVAFKGNSTNIHVENVTVYGGPGIAFGSLGQYPDRTDIVENVTVRNVQVQPSYQRAMNSGVYFKSWIGVNYGDPPNGGGGGHGYVRNVTVENLRLKDVQLPVYIDTCLSYLFSENITQYCDTSTYEFNDLHFKNISGNGLATVTDYPGKNISFAVSLLCSEKAPCTDLTFQNINIKLPANYTGKDVLCENAEVQGLRCNT

SEQ ID NO: 4572 - protein, 257 aa, Aspergillus kawachii
  strain NBRC 4308
MAPLKSLLLTASLATLAISTPLASDPGSLYARQFGTGSTANELEQGSCKDVTLIFARGSTELGNMGTVIGPPLCDSLKSKLGSDKVACQGVGGQYSAGLVQNALPQNTDPGSISAAKQMFEEANSKCPNTKIVAGGYSQGSAVIDNAVQEVSSTVRDQIKGVVLFGFTRNVQDHGQIPNYPKDDVKVYCAVGDLVCDDTLIVTAMHLTYGMDAGDAASFLAEKVQSSTSTSTSTSSSSDAASSSSAAGGLASFFGGL

SEQ ID NO: 4573 - protein, 411 aa, Aspergillus kawachii
  strain NBRC 4308
MRQAQSASLLAALLSATQVAAHGHVTNLVVDGVYYEGFDISVFPYESDPPKVAAWTTPNTGNGFISPDAYRDPNIICHENATNAQAHVVVGAGEKINIQWTAWPDSHHGPVLDYLARCDGSCETVDKTDLEFFKIDGVGLVSDSEVPGTWGTDQLINNNNSWMVEIPPSIAAGNYVLRHELIALHGAEEEDGAQNYPQCFNLQVTGTGTATPSGVKGTELYTATENGILVNIYSTLTTYTVPGPTAYSGAVSITQTTSAITSTGTAVVGSASAVASASSTAAAATSAAAVTSVDTNTQVAQSSSAPAPAAPSSSSSAYTQIPVQVPSSWTTLLTFTNTPQAVQPTTSVQPEPAQSTITPAPAVSSAASGSSGSQSLYGQCGGINWTGATQCASGSSCHSYNPYYYQCIASA

SEQ ID NO: 4574 - protein, 368 aa, Aspergillus kawachii
  strain NBRC 4308
MHSYQLLGLAAVGSLVSAAPAPSRVSEFAKKASTCTFTSASEASESISSCSDVVLSGIEVPAGETLDLSDAADGSTITFEGTTSFGYKEWKGPLIRFGGKDLTVTMADGAVIDGDGSRWWDSKGTNGGKTKPKFMYIHDVEDSTFKGINVKNTPVQAISVQATNVHLNDFTIDNSDGDDNGGHNTDGFDISESTGVYISGATVKNQDDCIAINSGESISFTGGTCSGGHGLSIGSVGGRDDNTVKNVTISDSTVSDSANGVRIKTIYKETGDVSEITYSNIQLSGITKYGIVIEQDYENGSPTGTPSTGIPITDVTVDGITGTLEDDATQVYILCGDGSCSDWTWSGVDLSGGKASDDCENVPSSASC

SEQ ID NO: 4575 - protein, 411 aa, Aspergillus kawachii
  strain NBRC 4308
MKTLSLVAVLLVQAWTASSSPRAKRSSGFQWFGSNESGAEFGSGNIPGTLGTDYIWPDATAIETLHSAGMNIFRVPFLMERLVPNELTGAADATYMADLKATVQIITDLGAYAVVDPHNFGRYYGNIITSTSDFAAFWTTVASEFTDNDLVIFDTNNEFHDEDQTLVLNLNQAAITAIRATGATTQYIFVEGNSYTGAWTWTTTNTNLVNLTDPNDHLIYEMHQYLDSDGSGTSSTCVSSTIGAERIADATSWLRENGKQAVLGEFAGGANSVCEEAVTGMLDAMVDASDVWLGGMWWSAGPWWGDYIFSLEPDDGVAYEYYLSVLEGYTPGSSSSSGGTTTTAAASTSSTSAAGSATTSKVTTTTAAATATSTAVAAHYAQCGGQGWTGATTCADGYTCTVENAWYSQCL

SEQ ID NO: 4576 - protein, 536 aa, Aspergillus kawachii
  strain NBRC 4308
MSSFQIYRAALLLSILATANSQQVGTYTTETHPSLTWQTCTSSGSCTTNNGAVVIDANWRWVHSTSSSTNCYTGNEWDTSICTDDVTCAANCALDGATYEATYGVTTSGDELRLNFVTQGSSKNIGSRLYLMSDDSTYEMFKLLGQEFTFDVDVSNLPCGLNGALYFVAMDADGGTSKYSGNKAGAKYGTGYCDSQCPRDLKFINGEANCDGWEPSSNNANTGVGDHGSCCPEMDVWEANSISNAFTAHPCDSTSQTMCDGDTCGGTYSASGDRYSGTCDPDGCDYNPYRLGDTDFYGPGLTVDTNSPFTVVTQFITDDGTSSGTLTEIKRLYVQNGKVIANGASTYSSVNGSSITSDFCEAQKTLFGDENVFDTHGGLAGMGEAMANGMVLVLSLWDDYASNMLWLDSDYPVDSSASTPGVARGTCSTDSGVPATVEAESPNAYVTYSNIKFGPIGSTYSSGSSSGSGSSSSSSSTTTKATSTTLKTTTTTSSGSSSTSAAQAYGQCGGQGWTGPTTCVSGYTCTYQNAYYSQCL

SEQ ID NO: 4577 - protein, 435 aa, Aspergillus kawachii
  strain NBRC 4308
MRLTHVLSHTLGLLALGATAEAFSRSREAACGPKKPFRPLPTSQSRDKTCHVRSHGDGTDDSDYILSALNQCNHGGKVVFDEDKEYIIGTALNMTFLKNIDLEVLGTILFTNDTDYWQANSFKQGFQNATTFFQLGGEDVNMYGGGTINGNGQVWYDLYAEDDLILRPILMGIIGLNGGTIGPLKLRYSPQYYHFVANSSNVLFDGIDISGYSKSDNEAKNTDGWDTYRSNNIVIQNSVINNGDDCVSFKPNSTNILVQNLHCNGSHGISVGSLGQYKDEVDIVENVYVYNISMFNASDMARIKVWPGTPSALSADLQGGGGSGSVKNITYDTALIDNVDWAIEITQCYGQKNTTLCNEYPSSLTISDVHIKNFRGTTSGSEDPYVGTIVCSSPDTCSDIYTSNINVTSPDGTNDFVCDNVDESLLSVNCTATSD

SEQ ID NO: 4578 - protein, 459 aa, Aspergillus kawachii
  strain NBRC 4308
MRAIILPYILFLATLARAQLSGPVGPLVDYSTKARNQTCNIIDYGALADGKTDISQPLLDAWGNCSVGGLVYIPPGNYSLAEDIELKHGQSSAIQLDGVIMRGHRGSYQMILIRDCNDFELFSGNSRGAIQGFGYEYLQNETYGERLLRIQEVSNFSVHGFALVDSPSYYIVFDTVSSGEVYNILIRGVTSVGATDAIDVWGENMWFHDIEVSNGDECVTVKSPAHNYLIENIYCNLSGGTAIGSLGTGTNISDIHYRNLYLNRADACFLKSNNGDGVVKNIIWENVIVHGGPYPLAIDEAWGDDRGSVGVQVSNLTFRNWHGESASASRPVIRLQCDSDIPCYDITIDNVNLWANDTSYVVWLCENAYGDGACLPSAKGTTDLKSFTSKQTITATPSYAAPTMAADFTSDLPSTSPFTIPPMPTSFYPGATPISTLLHLHGAGGLPSASPVSHHQRQH

SEQ ID NO: 4579 - protein, 339 aa, Aspergillus kawachii
  strain NBRC 4308
MRYSLALGALCAAGALANNVDKRSYVTDWTVVTLTTTITEYPTPTVYENVAAQEATAAASSSSAAAAAAAAESSSSAAAAAAAASASAEASSSAAAAAAAAAAEASTSSVVTPVVETTAAATTAAAVATSAAEEVATSWTSAWTSAWTSSWSSTVAPSTTLATSTSSSASSTATNAYQSAVLYNHNVHRSNHSASSVEWSSDLESSAYTLAAKCVYEHDTSIDGGGYGQNIGYGVEASEIGVMITNLMYNDEMGYYTDLYGEADPDMTYFDNWGHFSQIVWAATTHVGCATVTCDSLGNVDASEALPFTVCNYSPAGNYEGEYATNVKRPLGQAVYVAS

SEQ ID NO: 4580 - protein, 459 aa, Aspergillus kawachii
  strain NBRC 4308
MHYTLSLALAFLPFGIQAQQTLWGQCGGQGYSGATSCVAGATCSTINEYYAQCTPATGSGSATTLKTTTSTTTAAMTTTTATSSPAASASPTTTASASGNPFSGYQLYVNPYYSSEVASLAIPSLTGSLSSLQAAATAAAKVPSFVWLDTADKVPTMADYLADIKSQNSAGASPPIAGQFVVYDLPDRDCAALASNGEYSIADNGVEHYKAYIDSIREVLVQYSDVHTLLVIEPDSLANLVTNLNVAKCANAQSAYLECTNYALTQLNLPNVAMYLDAGHAGWLGWPANQQPAADLFASVYKNASSPAAVRGLATNVANYNAWTISSCPSYTQGNSVCDEQQYINAIAPLLEAQGFDAHFIVDTGRNGKQPTGQQAWGDWCNVINTGFGVRPTTSTGDDLVDAFVWVKPGGESDGTSDSSATRYDAHCGYSDALQPAPEAGTWFQAYFVQLLTNANPAF

SEQ ID NO: 4581 - protein, 384 aa, Aspergillus kawachii
  strain NBRC 4308
MVRQLILIGGMLAAVAVHAAPAEPAHPMVTEAPDANLIEKRATTCTFSGSEGASKASKSKTSCSTIYLSDVAVPSGTTLDLTDLNDGTHVIFQGETTFGYEEWTGPLVSVSGTDITVEGESGAVLNGDGSRWWDGEGGNGGKTKPKFFYAHDLTSSTIKSIYVENSPVQVFSIDGSTDLTMTDITVDNTDGDTDDLAANTDGFDIGESTYITITGAEIYNQDDCVAINSGENIYFSASVCSGGHGLSIGSVGGRDDNTVKNVTFYDVNVLKSQQAIRIKTIYGDTGSVSEVTYHEIAFSDATDYGIIIEQNYDDTSKTPTTGVPITDFVLENIIGTCEDDDCTEVYIACGDGSCSDWTWTGVSVTGGKVSDDCLNVPSGISCDL

SEQ ID NO: 4582 - protein, 378 aa, Aspergillus kawachii
  strain NBRC 4308
MVTSSSVIILTLWAALVSASPVADPLVTPAPKLDDLAKRATSCTFSGSEGASSASKSKTSCSTIVLSDVAVPSGTTLDLTDLNDGTHVIFEGETTFGYEEWSGPLVSVSGTDITVTGADGAYLNGDGSRWWDGEGSNGGKTKPKFFYAHDLTSSTISGIYIQNSPVQVFSIDGSTYLTMEDITIDNSDGDDGEAANTDGFDIGDSTYITITGANVYNQDDCVAVNSGENIYFSGGVCSGGHGLSIGSVGGRSDNTVKNVTFYDSEIKSSQNGVRIKTIYGDTGSVSEVTYKEITLSDITDYGIVVEQNYDDTSKSPTDGITIEDFVLDNVQGSVESSGTNIYIVCGSDSCTDWTWTDVDVSGGKTSSDCENVPDDISC

SEQ ID NO: 4583 - protein, 346 aa, Aspergillus kawachii
  strain NBRC 4308
MKYLPLAVAVTASLAPTASAHYIFSKLVLNGEASADWQYIRETTRSICYEPTKFTNTFDNLTPNDNDFRCNLGSFSNAAKTDVAEVAAGDTIGMKLFYDTSIAHPGPGQVFMSKAPTGNVQEYEGDGEWFKIWERTLCNEEGDLTKDAWCTWGMSEFEFQIPAETPAGEYLVRAEHVGLHGAQANEAEFFYSCAQVKVTGSGTGSPSLTYQIPGLYNDSMTLFNGLNLWVDSAEKIQTDILETPIGDDVWNGSGSGSSSAASPSVSSASVASPGTTTAAVHAYVQTPASSSSSSSSNIQSAAASSGNLVSHWGQCGGLGYAGPTECESPCTCVEQNPWYHQCVTSA

SEQ ID NO: 4584 - protein, 841 aa, Aspergillus kawachii
  strain NBRC 4308
MRGSNLFQLTLALLLSLVTAEDGYDGWLRYAPVSCDLHCRQALPSHIVLLNSTKGSPIETAGQELKAGFQSILSTNLTSHPFQCDSSASILVATLDEYRQKCRDINVPELDPDGFWLQSEGDTVRILGNNARGALYGAYEYLAMVAQGNFSRVAYTTSPHAPIRWVNQWDNMDGSIERGYGGASIFFKDGTVVEDMAPVEQYARLLASIRINALVVNNVNANATLLLPENMKGLGRIADACRPYGVQIGISLNFASPEDLGGLGTYDPLDPGVIAWWQNITDSLYTYVPDMAGYLVKADSEGQPGPDTYNRTLSQGANLFARALQPHGGVLMYRAFVYNNNLNESDWKADRAKAAVEYFKDLDGQFDENVVVQIKYGPIDFQVREPTSPLFANLYQTNTAIELEVSQEYLGQQCHLVYLPPLWKTVLDFDLRVDHKPSMVRDIISGQRFNRTLGGWAAVVNVGTNRTWLGSHLAMSNLYAYGRLAWSPTDDSEQILKDWTRLTFGQNHHVIDTIADMSMTSWPAYENYTGNLGIQTLTDILYTHYGPNPATQDNNGWGQWTRADHNSVGMDRTISNGTGYTGQYPEEVARLYESLETTPDDLVLWFHHVPWTHRLHSGLTVIQHFYNAHYAGSEAAHGFIKQWESLKGLIDRERYEAMRSRLVYQAGHSIVWRDAINNFYYNMTGIPDVVGRVGHHPWRIEAESMRLEGYQTYTVSPFEAASNTTAIITTSNSTTGTARTTIKAPSGVYDIGVNYYDLYGGQSKWTLSVGDKLVGQWLGDMEHQSLGHTPSIYLDGHSATRITFHGVVVRQGDQLKIVGEANGVEPAPVDYVVLLPPGVVD

SEQ ID NO: 4585 - protein, 993 aa, Aspergillus kawachii
  strain NBRC 4308
MHLLPLTLFLTAAFGVSVPRSPLIPGAQIIPASNTAHLHAIGAQYPKYPDRETVTIRPSRNELDDVSSDFLWGLKQANHGGRLLLKRGETYVIGKKLDLTFLDNIEVQLEGEIQFTNNITYWQANNFYYDFQKSITFWRWGGQDIKIFGSGVLNGNGQKWYDEFAGKQILDSDNTFYRPILFLTDNATRVSVEGITQLNSPCWTNFFVRTNDVSFDNVYIHAFSTNASSDPANTDGMDSLEVDGVSFTNMRIDVGDDCFSPKPNTTNIFVQNMWCNNTHGVSMGSIGQYAGEMDIIENVYIENVTLLNGQNGARLKAWAGQDVGYGRINNVTYKNIQIQNTDAPIVLDQCYFDINATECAEYPSAVNITNILFENIWGSSSGKDGKIVADLVCSPDAVCTNITLSNVNITSPKGTAEIVCDDIQGGIGVDCGSGKTTLLEHILLSPDHGLRIAVIVNDMSSLNIDATLIKHHHTVSHTKESLIQLQNGCICCTLRGDLLAELARLASQDGVEYVVIESTGISEPMQVAETFTAEFGAAMLEADGDGSGAEQQVLSVEERRVIEDIVKQGGLHTLTSLDTTVTVIDAFNLYSNLDTAEFLSDRYTSGEVIPEDERTISDLMVDQIEFADVIIINKIDLVDKVAKDKIHTLIKLLNPAAKVLEAKYSKIDVREILDTGRFDFVKAASGAGWLRSLHEMSRLSTGNGERVAPKPETLEYGINNFVYTARRPFHPRRLFKLLHDKFIILQNAAGEDGDDDDEEEEGEDDVDDEEMKDDDEDNTEDEEEDDDEDITSIPPETILSNKRSDPILAPILRSKGFFWLATRPYQFGEWSQAGAMLTLGCGGGWFAELPDEAWPEDADVRKSIEDDFKGEWGDRRQEIVFIGEGIDTTAIKKLLDECLLDKKEMKKWEKVMRTKGVKRAEKQEIMAGIWEDGWEDWPDLEDDDIKDEEEEVKGEKSGKRKASELLNGHGHGHAHGHSHAHGPGHKSRPVVKK

SEQ ID NO: 4586 - protein, 387 aa, Aspergillus kawachii
  strain NBRC 4308
MALYRNIFLLASLGLSSAAPSKVQRVPDSSLHARAVCTPTAGGNSSTDDVPAITEALSSCGNGGTIVFPEGSTYYLNSVLDLSSCSDCDIQVEGLLKFASDTDYWSGRTAMISVSDVDGLKLRSLTGSGVIDGNGQDAWDLFASDSSYSRPTLLYITGGSNLEISGLRQKNPPNVFNSVKGGATNVVFSNLKMDANSKSDNPPKNTDGFDIGESTYVTITEVTVVNDDDCVAFKPSSNYVTVDTISCTGSHGISVGSLGKSSDDSVKNIYVTGATMINSTKAAGIKTYPSGGDHGTSTIQSCYGEDDDYCEENPGNAKLTDIVVSSFSGTTSDKYDPVVANLDCGADGTCGISISGFDVKAPSGKSEVLCANTPSDLGVTCTSGASG

SEQ ID NO: 4587 - protein, 496 aa, Aspergillus kawachii
  strain NBRC 4308
MMKRSALLASFLPLALGCDNPETHSCASAFSVSSAAAATFCATFTASTVTATTGVPDVFLSNCDYKTKHLSSACSCLGTSDGSAPASTPAAPAVSSSSKVGKAPAVAATRTSAIPTTFHTTPIRVPVSTPAAAAVTTQAVVPVQSSVAGNGGTTCTVTEYASISSAVASCSNILLSNINAPASSTIDLSGLQTGAAVIFAGETTFGDTYDSDFDPIVISGTDVTITGEEGHVINGNGEAYWDGEGSNGGQDKPDHFIVVKDMYNSKIENLNILNYPVHCFEIEDTEYLTITGLILNNTAGDAANSKSDGDPAAHNTDGFDIKQSDFLTLSNTWVHNQDDCVAVTSGSSIVVDNLYCYGGHGLSIGSIGGKSNNTVNGVTFSNSQVINSENGCRIKSNADTTGEVYNVRYENITLSGITDYGIDVQQDYENGGATGDPTNDVKIENISFVNVKGTMSDGKDYYILCGDGSCSNFVFTDVDITGGSDDSCNYPSSGCP

SEQ ID NO: 4588 - protein, 578 aa, Aspergillus kawachii
  strain NBRC 4308
MHGTRLVFSIAALPLAILVYATASTPAPVDLNSLRLTSNTDYVNSIDVNANQSVIVSADEHYTNTAAQLVQNIVPGASFRLVDDHYVGDNGVAHVYFRQTAHDIDIDNADFNVNVCSPLTLVEKSSPLQIGRDGQLLSFGHSFFTGASPSSYLDKPNLSSPVVALRGARDALQLPLIIDNVSTEAADGRNEYIFRKAAGAVSDPTAKLVYIVKPDGTLALTWRVEIDMYEHWLLTYIDAETTTVHGVVDYVADATYQVYTNDPTEGHRTILTNPWDLSASEYTWISDGLNNYTTTRGNNAIAHWNPTGGGSYLYNLRPSNPDLNFQWPYSPNMSPPRSYINASIVQLFYTANTYHDLLYTLGFTESAGNFQWNNSARGGRDKDYVILNAQDGSGYSNANFATPPDGIPGRMRMYIWIESTPSRDGSFDAGIVIHEYTHGVSNRLTGGSHNAGCLNTLESGGMGEGWGDFMATAIRIKPNDTRRTSYTMGAWADNDKRGVRDYPYSTSFAENPLNYTSVNTMNGVHAIGTVWATMLYEVMWNLIDKYGKNDGPRPVFRDGVPTDGKYLMMKLVVDGMAL

SEQ ID NO: 4589 - protein, 429 aa, Aspergillus kawachii
  strain NBRC 4308
MALIVLKVLFLASLIIPSIALSDQARNGNARTKCEVKPGGSSEIDDVPAILDALTTCGSGGRVTFTNHTYYINSVMNTTWLDDVEIDLQGTLLWSTNISYWLNHSLPVGYQNQSTAWILGGKDIVFEGHGYGTFNGSGPTWYKYVGSKSNYPRRPNQLTVSGATGAVFKGLRFVQSQMWTMSIIYTSDSVFDSIYVNNLYDDGDSAQNTDGANTIYSNNITFTNWEVVNGDDSISTKANSTDITIANSKFTSGLGIAIGSIGQYNGAFETVKGLKISNITYDKTTHAVYFKTWTGDQVGYPPNGGGGGLGYASDIVATNLKTNNLKGAPFTISQCTTFSGASGNCTNSKFQIRDLVFTDISGTVDSAEVASFQCSAVAPCEDITIENVSLRIAGNTTLADEYLCGNVEGAVGWNCTGEVCVGSSATGGC

SEQ ID NO: 4590 - protein, 88 aa, Aspergillus kawachii
  strain NBRC 4308
MRFTYQALAVFISSLLVNSAAAHACESSAVWPDPANCHKFYQCNPGTEPAHKECGAGTAFNPKISACDYEQNVPSCFKDPHHPRPFHA

SEQ ID NO: 4591 - protein, 292 aa, Aspergillus kawachii
  strain NBRC 4308
MKSFITLSLLATALGAPTSTLQARQFDLSSLTSGLSALTSGSAASSSSGSTGSTGTGSETTTGSSGLSALASLFPSSSTSSTTGSTSGTSDSSSDGLSSLLSMFSSSGSGSSTENGVTQHSGSCKKLTFIFARGTTEIGNMGTVVGPEVASELASLTGNQVTVQGVNYPADWEGNVSLGSSGGPTMASYVKEALQQCPNTKVVLGGYSQGSMVVHYAANQLSADQLSGAVLFGDPLKMEGVGKLSSSKVKEFCASGDPVCENGVNVMAHLTYGSDAKEAAQFLVQAAGVSSS

SEQ ID NO: 4592 - protein, 211 aa, Aspergillus kawachii; identical to SEQ ID NO: 4349
  strain NBRC 4308

SEQ ID NO: 4593 - protein, 327 aa, Aspergillus kawachii
  strain NBRC 4308
MVQIKAAALAMLFASHVLSEPIEPRQASVSIDTKFKAHGKKYLGNIGDQYTLTKNSKTPAIIKADFGALTPENSMKWDATEPSRGQFSFSGSDYLVNFAQSNNKLIRGHTLVWHSQLPSWVQAITDKNTLIEVMKNHITTVMQHYKGKIYAWDVVNEIFNEDGSLRDSVFYKVIGEDYVRIAFETARAADPNAKLYINDYNLDSASYPKLAGMVSHVKKWIEAGIPIDGIGSQTHLSAGGGAGISGALNALAGAGTKEIAVTELDIAGASSTDYVEVVEACLDQPKCIGITVWGVADPDSWRSSSTPLLFDSNYNPKPAYTAIANAL

SEQ ID NO: 4594 - protein, 225 aa, Aspergillus kawachii
  strain NBRC 4308
MLTKNLLLCFAAAKAVLAVPHDSVVERSDALHKLSERSTPSSTGENNGYYYSFWTDGGGDVTYTNGNAGSYSVEWSNVGNFVGGKGWNPGSAKDITYSGTFTPSGNGYLSVYGWTTDPLIEYYIVESYGDYNPGSGGTYKGTVTSDGSVYDIYTATRTNAPSIQGTATFTQYWSVRQNKRVGGTVTTSNHFNAWAKLGMNLGTHNYQILATEGYQSSGSSSITIQ

SEQ ID NO: 4595 - protein, 860 aa, Aspergillus kawachii
  strain NBRC 4308
MRFTLIEAVALTAVSLASADELAYSPPYYPSPWANGQGDWAQAYQRAVDIVSQMTLAEKVNLTTGTGWELELCVGQTGGVPRLGVPGMCLQDSPLGVRDSDYNSAFPSGMNVAATWDKNLAYLRGKAMGQEFSDKGADIQLGPAAGPLGRSPDGGRNWEGFSPDPALSGVLFAETIKGIQDAGVVATAKHYIAYEQEHFRQAPEAQGYGFNISESGSANLDDKTMHELYLWPFADAIRAGAGAVMCSYNQINNSYGCQNSYTLNKLLKAELGFQGFVMSDWAAHHAGVSGALAGLDMSMPGDVDYDSGTSYWGTNLTVSVLNGTVPQWRVDDMAVRIMAAYYKVGRDRLWTPPNFSSWTRDEYGYKYYYVSEGPYEKVNHYVNVQRNHSELIRRIGADSTVLLKNDGALPLTGKERLVALIGEDAGSNPYGANGCSDRGCDNGTLAMGWGSGTANFPYLVTPEQAISNEVLKNKNGVFTATDNWAIDQIEALAKTASVSLVFVNADSGEGYINVDGNLGDRRNLTLWRNGDNVIKAAASNCNNTIVIIHSVGPVLVNEWYDNPNVTAILWGGLPGQESGNSLADVLYGRVNPGAKSPFTWGKTREAYQDYLVTEPNNGNGAPQEDFVEGVFIDYRGFDKRNETPIYEFGYGLSYTTFNYSNLEVQVLSAPAYEPASGETEAAPTFGEVGNASNYLYPDGLQKITKFIYPWLNSTDLEASSGDASYGQDSSDYLPEGATDGSAQPILPAGGGPGGNPRLYDELIRVSVTIKNTGKVAGDEVPQLYVSLGGPNEPKIVLRQFERITLQPSEETKWSTTLTRRDLANWNVEKQDWEITSYPKMVFVGSSSRKLPLRASLPTVH

SEQ ID NO: 4596 - protein, 499 aa, Aspergillus kawachii
  strain NBRC 4308
MFSRRNLLALGLAATVSAGPCDIYEAGDTPCVAAHSTTRALYSSFSGALYQLQRGSDDTTTTISPLTAGGIADASAQDTFCANTTCLITIIYDQSGNGNHLTQAPPGGFDGPDTDGYDNLASAIGAPVTLNGQKAYGVFMSPGTGYRNNEATGTATGDEAEGMYAVLDGTHYNDACCFDYGNAETSSTDTGAGHMEAIYLGNSTTWGYGAGDGPWIMVDMENNLFSGADEGYNSGDPSISYRFVTAAVKGGADKWAIRGANAASGSLSTYYSGARPDYSGYNPMSKEGAIILGIGGDNSNGAQGTFYEGVMTSGYPSDDTENSVQENIVAAKYVVGSLVSGPSFTSGEVVSLRVTTPGYTTRYIAHTDTTVNTQVVDDDSSTTLKEEASWTVVTGLANSQCFSFESVDTPGSYIRHYNFELLLNANDGTKQFHEDATFCPQAALNGEGTSLRSWSYPTRYFRHYENVLYAASNGGVQTFDSKTSFNNDVSFEIETAFAS

SEQ ID NO: 4597 - protein, 628 aa, Aspergillus kawachii
  strain NBRC 4308
MVAFSALSGVSALSLLLCLVQHAHGVSLKVSTQGGNSSSPILYGFMFEDINHSGDGGIYGQLLQNPGLQGTTPNLTAWAAVGDATIAIDGDSPLTSAIPSTIKLDVADDATGAVGLTNEGYWGIPVDGSEFQSSFWIKGDYSGDITVRLVGNYTGTEYGSATITHTSTADNFTQASVKFPTTKAPDGNVLYELTVDGSVAAGSSLNFGYLTLFGETYKSRENGLKPQLANVLADMKGSFLRFPGGNNLEGNSAENRWKWNETIGDLWDRPGREGTWTYYNTDGLGLHEYFYWCEDLGLVPVLGVWDGFALESGGNTPITGDALTPYIDDVLNELEYILGDTSTTYGAWRAANGQEEPWNLTMVEIGNEDMLGGGCESYAERFTAFYDAIHAAYPDLILIASTSEADCLPESMPEGSWVDYHDYSTPDGLVGQFNYFDNLDRSVPYFIGEYSRWEIDWPNMKGSVSEAVFMIGFERNSDVVKMAAYAPLLQLVNSTQWTPDLIGYTQSPDDIFLSTSYYVQEMFSRNRGDTIKEVTSDSDFGPLYWVASSAGDSYYVKLANYGSETQDLTVSIPGTSTGKLTVLADNDPDAYNSDTQTLVTPSESTVQASNGTFTFSLPAWAVAVLAAN

SEQ ID NO: 4598 - protein, 362 aa, Aspergillus kawachii
  strain NBRC 4308
MHSFASLLAYGLAAGATLASASPIEARDSCTFTTAAAAKAGKAKCSTITLDSIKVPAGTTLDLTGLTSGTKVIFEGTTTFDYEEWAGPLISMSGKDITVTGASGHLINCDGSRWWDGKGTSGKKKPKFFYAHGLDSSSITGLNIKNTPLMAFSVESDDITLTDITINNADGDSLGGHNTDAFDVGNSVGVNIIKPWVHNQDDCLAINSGENIWFTGGTCIGGHGLSIGSVGDRSNNVVKNVTIEHSTVSNSENAVRIKTISGATGSVSEITYSNIVMSGISDYGVVIQQDYEDGKPTGKPTNGVTITDVKLESVTGTVDSKATDIYLLCGSGSCSDWTWDDVKVTGGKKSSACKNYPSVASC

SEQ ID NO: 4599 - protein, 370 aa, Aspergillus kawachii
  strain NBRC 4308
MPSAKPLFCLATLAGAALAAPAPSRATDFNKRSTCTFTDAATASESKTSCSDIVLKDITVPAGETLNLKDLNDGTTVTFEGTTTWEYEEWDGPLLRISGKDITVTQSSDAVLNGNGAKWWDGEGTNGGKTKPKFFYAHDLDDSKISGLYIKNTPVQAISVESDNLVIEDVTIDNSDGDSEGGHNTDGFDISESTYITITGATVKNQDDCVAINSGENIYFSGGTCSGGHGLSIGSVGGRDDNTVKNVTFIDSTVSDSENGVRIKTVYDATGTVEDITYSNIQLSGISDYGIVIEQDYENGDPTGTPSNGVTISDVTLEDITGSVDSDAVEIYILCGDGSCTDWTMSGIDITGGETSSDCENVPSGASCSQ

SEQ ID NO: 4600 - protein, 332 aa, Aspergillus kawachii
  strain NBRC 4308
MKFQSTLLLAAAAGSALAVPHGPGHKKRASVFEWFGSNESGAEFGTNIPGVWGTDYIFPDPSAISTLIDKGMNFFRVQFMMERLLPDSMTGSYDEEYLANLTTVIKAVTDGGAHALVDPHNYGRYNGEIISSTSDFQTFWENLAGQYKDNDLVMFDTNNEYHDMDQDLVLNLNQAAINGIRAAGATSQYIFVEGNSWTGAWTWVDVNDNMKNLTDPEDKIVYEMHQYLDSDGSGTSETCVSETIGKERVTEATQWLKDNKKVGFIGEYAGGSNDVCRSAVSGMLEYMANNTDVWKGASWWAAGPWWGDYIFSMEPPDGTAYTGMLDILEAYL

SEQ ID NO: 4601 - protein, 408 aa, Aspergillus kawachii
  strain NBRC 4308
MKTTTYSLLALAAASKLASAHTTVQAVWINGEDQGLGNTDDGYIRSPPSNSPVTDVTSTDMTCNVNGDQAASKTLSVKAGDVVTFEWHHSDRSDSDDIIASSHKGPVQVYMAPTAKGSNGNNWVKIAEDGYHKSSDEWATDILIANKGKHNITVPDVPAGNYLFRPEIIALHEGNREGGAQFYMECVQFKVTSDGSNELPSGVSIPGVYTATDPGILFDIYNSFDSYPIPGPDVWDGSSSGSSSSGSSSAAVSSAAAAATTSAVAATTPATQAAVEVSSSAAAATTEAAAPVVSSAAPVQQATSAVTSQAQAAPTTFATSSKKSSKTACKNKTKSNSQVAAATSSVVAPAATSSVVPVVSASASASAGGVAKQYERCGGINHTGPTTCESGSVCKKWNPYYYQCVASQ

SEQ ID NO: 4602 - protein, 241 aa, Aspergillus niger
MKVLALSALLSLASAASISRRSDFCGQWDTATAGDFILYNDLWGEDNASSGSQCTGVDSASGSEIAWHTSWSWEGGSSDVKSYANAALQFTGTQLSSISSIPSTWKWTYSGSDIVADVAYDMFLGSTADASSDEYEIMVWLAALGGAGPISSTGSTIATPTINGVTWDLYTGPNGDTTVYSFVAQSTTEDFSGDLNDFFTYLVDNEGVSDSLYLTTLEAGTEPFTGSDAELKVSEYSVSIE

SEQ ID NO: 4603 - protein, 370 aa, Aspergillus niger
MAFAHHAEAAQSSIVSGSAPGFAAGVTGGGDATPVYPTTIDELKEYLTSSSPQNIVIEGTFDFVGSEGTKTYQACNIYDCTPDNGGQAILNTLGGCGDTSTYDVTIDVAGYQGINVASDKTLVGKGTGAVLNGKGLRFVGVSNIIIQNIEITNLNPKYVWGGDALTFSDTNQIWIDHVTTSSLGRQHYSFGQESDNAITISNSFINGKTDYSATCDGHTYWGLELVGSSDQITFYKNYVYYTSGRSPALSGNTLFHAVNSVWADNSGHAIEGTDNGMGLFEGNVFNNVPTIVQSGFVGQLFSSESANLSQCETSLGRDCVTNAYTSSGSFSYDDDGFFVDFENLPIVSAASASSIASTVPSDAGNTLSST

SEQ ID NO: 4604 - protein, 327 aa, Aspergillus niger
MVQIKVAALAMLFASQVLSEPIDPRQASVSIDTKFKAHGKKYLGNIGDQYTLTKNSKTPAIIKADFGALTPENSMKWDATEPSRGQFSFSGSDYLVNFAQSNNKLIRGHTLVWHSQLPSWVQSITDKNTLIEVMKNHITTVMQHYKGKIYAWDVVNEIFNEDGSLRDSVFYKVIGEDYVRIAFETARAADPNAKLYINDYNLDSASYSKLTGMVSHVKKWIAAGIPIDGIGSQTHLSAGGGAGISGALNALAGAGTKEIAVTELDIAGASSTDYVEVVEACLNQPKCIGITVWGVADPDSWRSSSTPLLFDSNYNPKPAYDAIANAL

SEQ ID NO: 4605 - protein, 367 aa, Aspergillus niger
MHSYRLHGLAAVGSLVSAAFAPSRVSEFAMKASTCTFTSASEASESISSCSDVVLSSIEVPAGETLDLSDAADGSTITFEGTTSCGYKEWKGPLIRFGGKNLTVTMADGAVIDGDGSRWWDSKGTNGGKTKPKFMYIHDVEDSTFKGINIKNTPVQAISVQATKVHLNDFTIDNSDGDDNGGHRSDGVDISESTGVYISGATVKNQDDCIAINSGESISFTGGTCSGGHGLSIGSVGGRDDNTVKNVTISDSTVSNSANGVRIKTIYKETDDVSEITYSNIQLSGITDYGIVIEQDYENGSRTGTPSTGIPITDVTVDGVTGTLEDDATQVYILWVDGSCSDWTWSGVDLSGGKTSDKCENVPSGAS

SEQ ID NO: 4606 - protein, 515 aa, Aspergillus niger
QQVGTYTTETHPSLTWQTCTSSGSCTTNDGAVVIDANWRWVHSTSSSTNCYTGNEWDTSICTDDVTCAANCALDGATYEATYGVTTSGDELRLNFVTQGSSKNIGSRLYLMSDDSTYEMFKLLGQEFTFDVDVSNLPCGLNGALYFVAMDADGGTSEYSGNKAGAKYGTGYCDSQCPRDLKFINGEANCDGWEPSSNNVNTGVGDHGSCCPEMDIWEANSISNAFTAHPCDSVSQTMCDGDSCGGTYSASGDRYSGTCDPDGCDYNPYRLGNTDFYGPGLTVDTNSPFTVVTQFITDDGTSSGTLTEIKRLYVQNGEVIANGASTYSSVNGSSITSDFCESEKTLFGDENVFDTHGGLAGMGEAMANGMVLVLSLWDDYAANMLWLDSDYPVNSSASTPGVARGTCSTDSGVPATVEADSPNAYVTYSNIKFGPIGSTYSSGSSSGSGSSSSSSSTTTKATSTTLKTTTTTSSGSSSTSAAQAYGQCGGQSWTGPTTCVSGYTCTYQNAYYSQCL

SEQ ID NO: 4607 - protein, 536 aa, Aspergillus niger
MSSFQVYRAALLLSILATANAQQVGTYTTETHPSLTWQTCTSDGSCTTNDGAVVIDANWRWVHSTSSSTNCYTGNEWDTSICTDDVTCAANCALDGATYEATYGVTTSGDELRLNFVTQGSSKNIGSRLYLMSDDSTYEMFKLLGQEFTFDVDVSNLPCGLNGALYFVAMDADGGTSEYSGNKAGAKYGTGYCDSQCPRDLKFINGEANCDGWEPSSNNVNTGVGDHGSCCPEMDIWEANSISNAFTAHPCDSVSQTMCDGDSCGRTYSASGDRYSGTCDPDGCDYNPYRLGNTDFYGPGLTVDTNSPFTVVTQFITDDGTSSGTLTEIKRLYVQNGEVIANGASTYSSVNGSSITSDFCESEKTLFGDENVFDTHGGLAGMGEAMANGMVLVLSLWDDYAANMLWLDSDYPVNSSASTPGVARGTCSTDSGVPATVEADSPNAYVTYSNIKFGPIGSTYSSGSSSGSGSSSSSSSTTTKATSTTLKTTTTTSSGSSSTSAAQAYGQCGGQSWTGPTTCVSGYTCTYQNAYYSQCL

SEQ ID NO: 4608 - protein, 804 aa, Aspergillus niger
MAHSMSRPVAATAAALLALALPQALAQANTSYVDYNIEANPDLYPLCIETIPLSFPDCQNGPLRSHLICDETATPYDRAASLISLFTLDELIANTGNTGLGVSRLGLPAYQVWSEALHGLDRANFSDSGAYNWATSFPQPILTTAALNRTLIHQIASIISTQGRAFNNAGRYGLDVYAPNINTFRHPVWGRGQETPGEDVSLAAVYAYEYITGIQGPDPESNLKLAATAKHYAGYDIENWHNHSRLGNDMNITQQDLSEYYTPQFHVAARDAKVQSVMCAYNAVNGVPACADSYFLQTLLRDTFGFVDHGYVSSDCDAAYNIYNPHGYASSQAAAAAEAILAGTDIDCGTTYQWHLNESIAAGDLSRDDIEQGVIRLYTTLVQAGYFDSNTTKANNPYRDLSWSDVLETDAWNISYQAATQGIVLLKNSNNVLPLTEKAYPPSNTTVALIGPWANATTQLLGNYYGNAPYMISPRAAFEEAGYKVNFAEGTGISSTSTSGFAAALSAAQSADVIIYAGGIDNTLEAEALDRESIAWPGNQLDLIQKLASAAGKKPLIVLQMGGGQVDSSSLKNNTNVSALLWGGYPGQSGGFALRDIITGKKNPAGRLVTTQYPASYAEEFPATDMNLRPEGDNPGQTYKWYTGEAVYEFGHGLFYTTFAESSSNTTTKEVKLNIQDILSQTHEDLASITQLPVLNFTANIRNTGKLESDYTAMVFANTSDAGPAPYPKKWLVGWDRLGEVKVGETRELRVPVEVGSFARVNEDGDWVVFPGTFELALNLERKVRVKVVLEGEEEVVLKWPGKE

SEQ ID NO: 4609 - protein, 564 aa, Aspergillus niger
MRSTGYLLTLSAAFQVAQAAVTANNSQLLTWWHNTGEINTQTPVADGNVRQSGLYSVKVQTTPASSSLYYDSFVYLAIPGNGMSDQLQYTQGYNQTQAWTSFLYSHDATVKISRNGSSANSNVVIRPTSLNFPVRYDNQSVYITVPYSPTGYRFSVEFDDDLISLAPSGARQPENALLIFASPFENSSTKPQPGSPNSIAPAPGRVLGLNTTSASTVVFNPGVYYFTGHDHMVLSSSVTWVYFAPGAYVKGAVEFLSTASEVKASGHGVLSGEQYVWYADPDEGYQKASGANNNGLRMWRGTLGNSSQTFVLNGVTVSAPPFNSMDWSGNSLDLITCRVDDYKQVGAFYGQTDGLEMYPGTILQDVFYHTDDDGLKMYYSNVTARNIVMWKESVAPVVEFGWTPRNTENVLFDNVDVIHQAYANAGNNPGIFGAVNNYLYAPDGLSSNHSTGNSNMTVRNITWSNFRAEGSSSALFRINPIQNLDNISIKNVSIESFEPLSINTTESWMPVWYDLNNGKQITVTDFSIEGFTVGNTTITASNAASVGRIDGVDPAYAGSVHYID

SEQ ID NO: 4610 - protein, 281 aa, Aspergillus niger
MKQFSAKYALILLATAGQALAASTQGISEDLYNRLVEMATISQAAYADLCNIPSTIIKGEKIYNAQTDINGWILRDDTSKEIITVFRGTGSDTNLQLDTNYTLTPFDTLPQCNDCEVHGGYYIGWISVQDQVESLVKQQASQYPDYALTVTGHSLGASMAALTAAQLSATYDNVRLYTFGEPRSGNQAFASYMNDAFQVSSPETTQYFRVTHSNDGIPNLPPADEGYAHGGVEYWSVDPYSAQNTFVCTGDEVQCCEAQGGQGVNDAHTTYFGMTSGACTW

SEQ ID NO: 4611 - protein, 378 aa, Aspergillus niger
MVTSSSVIGLTLWAALVSASPVADPLVTPAPKLEDLEKRATSCTFSGSEGASSASKSKTSCSTIVLSDVAVPSGTTLDLTDLNDGTHVIFEGETHFGYEEWSGPLVSVSGTDITVTGADGAYLNGDGSRWWDGEGSNGGKTKPKFFYAHDLTSSTISGIYIQNSPVQVFSIDGSTYLTMEDITIDNTDGDDGEAANTDGFDIGDSTYITITGANVYNQDDCVAVNSGENIYFSGGVCSGGHGLSIGSVGGRSDNTVKNVTFYDSDIKSSQNGVRIKTIYGDTGSVSEVTYKEITLSDITDYGIVVEQNYDDTSESPTDGITIEDFVLDNVQGSVESSGTNIYIVCGSDSCTDWTWTDVDVTGGKTSSDCENVPDDISC

SEQ ID NO: 4612 - protein, 331 aa, Aspergillus niger
MKFQSTLLLAAAAGSALAVPHGSGHKKRASVFEWFGSNESGAEFGTNIPGVWGTDYIFPDPSTISTLIGKGMNFFRVQFMMERLLPDSMTGSYDEEYLANLTTVVKAVTDGGAHALIDPHNYGRYNGEIISSTSDFQTFWQNLAGQYKDNDLVMFDTNNEYYDMDQDLVLNLNQAAINGIRAAGASQYIFVEGNSWTGAWTWVDVNDNMKNLTDPEDKIVYEMHQYLDSDGSGTSETCVSGTIGKERITDATQWLKDNKKVGFIGEYAGGSNDVCRSAVSGMLEYMANNTDVWKGASWWAAGPWWGDYIFSLEPPDGTAYTGMLDILETYL

SEQ ID NO: 4613 - protein, 373 aa, Aspergillus niger
MKYAAALTAIAALAARAAAVGVSGTPVGFASSATGGGDATPVYPTTTDELVSYLGDDEARVIVLSKTFDFTDTEGTTTTTGCAPWGTASGCQLAINKDDWCTNYEPDAPTTTVTYNTAGELGITVNSNKSLIGEGTSGVIKGRGLRMVSGVSNIIIQNIAVTDINPEYVWGGDAITLDEADLVWIDHVTTARIGRQHYVLGTDADSRVSITNNYINGESDYSATCDGHHYWNVYLDGSSDKVTFSGNYLYKTSGRAPKVQDNTYLHIYNNYWENNSGHAFEIGSGGYVLAEGNYFSNVDTVLETDTFEGALFSSDSASSTCESYIGRSCVANVNGGDLTGTSTTVLSNLSGDTLPSADAASTSPASNAGQGNL

SEQ ID NO: 4614 - protein, 368 aa, Aspergillus niger
MHSYQLLGLAAVGSLVSAAPAPSRVSEFAKKASTCTFTSASEASESISSCSDVVLSSIEVPAGETLDLSDAADGSTITFEGTTSFGYKEWKGPLIRFGGKDLTVTMADGAVIDGDGSRWWDSKGTNGGKTKPKFMYIHDVEDSTFKGINIKNTPVQAISVQATNVHLNDFTIDNSDGDDNGGHNTDGFDISESTGVYISGATVKNQDDCIAINSGESISFTGGTCSGGHGLSIGSVGGRDDNTVKNVTISDSTVSNSANGVRIKTIYKETGDVSEITYSNIQLSGITDYGIVIEQDYENGSPTGTPSTGIPITDVTVDGVTGTLEDDATQVYILCGDGSCSDWTWSGVDLSGGKTSDKCENVPSGASC

SEQ ID NO: 4615 - protein, 362 aa, Aspergillus niger
MHSFASLLAYGLVAGATFASASPIEARDSCTFTTAAAAKAGKAKCSTITLNNIEVPAGTTLDLTGLTSGTKVIFEGTTTFQYEEWAGPLISMSGEHITVTGASGHLINCDGARWWDGKGTSGKKKPKFFYAHGLDSSSITGLNIKNTPLMAFSVQANDITFTDVTINNADGDTQGGHNTDAFDVGNSVGVNIIKPWVHNQDDCLAVNSGENIWFTGGTCIGGHGLSIGSVGDRSNNVVKNVTIEHSTVSNSENAVRIKTISGATGSVSEITYSNIVMSGISDYGVVIQQDYEDGKPTGKPTNGVTIQDVKLESVTGSVDSGATEIYLLCGSGSCSDWTWDDVKVTGGKKSTACKNFPSVASC

SEQ ID NO: 4616 - protein, 417 aa, Aspergillus niger
MFTKQSLVTLLGGLSLAVAQTTTEGYPSLAEIRAAQATVQPYSPVSNVKGLTFNRFVNIWLENTDFDAAAATEHLPVLAKKGLLLNNFWAVTHPSEPNYCRHLPLGDTFGMDNDDFHQIPSNVSTIADLFDTKNIAWGEYQEGLPYPGYQGYRYPESGANDYVRNRNPLILFDSVTEDALRLRQIKNFSSFYDDLENHRLPQYMFITPNMTNDGHDTNITFSGDWTWGFLSELLENDYFTKDTLIMLTFDETGTYEIGNNIYTFLLGGAVPDDLLGTKDDTFYTHYSVIASLSTNWGLPSLGRWDCGANLFSWLAKKTGYVNYEVDTSNLYMNETHWGPLSDDDYSEYYAGWPVPTTDASCSAGNGILSTVKKTYEGLTATFNYTTPFPYDSRSGNNVGVKYSRTLKNGKVESGTSE

SEQ ID NO: 4617 - protein, 467 aa, Aspergillus niger
MGVSAVLLPLYLLSGVTSGLAVPASRNQSSCDTVDQGYQCFSETSHLWGQYAPFFSLANESVISPEVPAGCRVTFAQVLSRHGARYPTDSKGKKYSALIEEIQQNATTFDGKYAFLKTYNYSLGADDLTPFGEQELVNSGIKFYQRYESLTRNIVPFIRSSGSSRVIASGKKFIEGFQSTKLKDPRAQPGQSSPKIDVVISEASSSNNTLDPGTCTVFEDSELADTVEANFTATFVPSIRQRLENDLSGVTLTDTEVTYLMDMCSFDTISTSTVDTKLSPFCDLFTHDEWINYDYLQSLKKYYGHGAGNPLGPTQGVGYANELIARLTHSPVHDDTSSNHTLDSSPATFPLNSTLYADFSHDNGIISILFALGLYNGTKPLSTTTVENITQTDGFSSAWTVPFASRLYVEMMQCQAEQEPLVRVLVNDRVVPLHGCPVDALGRCTRDSFVRGLSFARSGGDWAECFA

SEQ ID NO: 4618 - protein, 394 aa, Aspergillus niger
MVVFSKTAALVLGLSTAVSAAPAPTRKGFTINQIARPANKTRTVNLPGLYARSLAKFGGTVPQSVKEAASKGSAVTTPQNNDEEYLTPVTVGKSTLHLDFDTGSADLWGFSDELPSSEQTGHDLYTPSSSATKLSGYSWDISYGDGSSASGDVYRDTVTVGGVTTNKQAVEAASKISSEFVQDTANDGLLGLAFSSINTVQPKAQTTFFDTVKSQLDSPLFAVQLKHDAPGVYDFGYIDDSKYTGSITYTDADSSQGYWGFSTDGYSIGDGSSSSSGFSAIADTGTTLILLDDEIVSAHYEQVSGAQESYEAGGYVFSCSTDLPDFTVVIGDYKAVVPGKYINYAPVSTGSSTCYGGIQSNSGLGLSILGDVFLKSQYVVFNSEGPKLGFAAQA

SEQ ID NO: 4619 - protein, 211 aa, Aspergillus niger
MKVTAAFAGLLVTAFAAPVPEPVLVSRSAGINYVQNYNGNLGDFTYDESAGTFSMYWEDGVSSDFVVGLGWTTGSSKAITYSAEYSASGSSSYLAVYGWVNYPQAEYYIVEDYGDYNPCSSATSLGTVYSDGSTYQVCTDTRTNEPSITGTSTFTQYFSVRESTRTSGTVTVANHFNFWAQHGFGNSDFNYQVMAVEAWSGAGSASVTISS

SEQ ID NO: 4620 - protein, 225 aa, Aspergillus niger
MLTKNLLLCFAAAKAALAVPHDSVAQRSDALHMLSERSTPSSTGENNGFYYSFWTDGGGDVTYTNGDAGAYTVEWSNVGNFVGGKGWNPGSAQDITYSGTFTPSGNGYLSVYGWTTDPLIEYYIVESYGDYNPGSGGTYKGTVTSDGSVYDIYTATRTNAASIQGTATFTQYWSVRQNKRVGGTVTTSNHFNAWAKLGMNLGTHNYQIVATEGYQSSGSSSITVQ

SEQ ID NO: 4621 - protein, 24 aa, Aspergillus niger
LTNKTARFLVNGTSIPEVDFDVGE

SEQ ID NO: 4622 - protein, 332 aa, Aspergillus niger; identical to SEQ ID NO: 4169

SEQ ID NO: 4623 - protein, 446 aa, Aspergillus niger
MPALPILALALAPLLVNGQLSGSVGPLTSAHSKAATKTCNVLDYGAVADNSTDIGSALSEAWDACSDGGLIYIPPGDYAMDTWVSLSGGKATAIILDGTIYRTGTDGGNMILVENSSDFELYSNSSSGAVQGFGYVYHREGDLDGPRILRLQDVSNFAVHDIILVDAPAFHFVMDDCSDGEVYNMAIRGGNSGGLDGIDVWGSNIWVHDVEVTNKDECVTVKGPANNILVESIYCNWSGGCAMGSLGADTDITDILYRNVYTWSSNQMYMIKSNGGSGTVNNTLLENFIGRGNRYSLDVDSYWSSMTAVDGDGVQLSNITFKNWKGTEADGAERGPIKVVCSDTAPCTDITIEDFAMWTESGDEQTYTCESAYGDGFCLEDSDSTTSYTTTQTVTTAPSGYSATTMAADLTTDFGTTASIPIPTIPTSFYPGLTAISPLASAATTA

SEQ ID NO: 4624 - protein, 558 aa, Aspergillus niger
MLLDKLSVLSFLGLAPIFAAAQLSGSVGPLTSASTKAATKTCNVLDYGAKADKSTDLGAPLASAFADCKSGGLVYVPSGDYALSTWARLSGGEAWALQIDGIIYRTGTDGGNMIYIEHSSDFELFSSTSEGAMQGLGYEFHADDNWSGPRLLRLYEVTDFSVHDFILVDSPSFHFSLDTCTNGEIYNMAIRGGNHGGLDGIDVWSNNIWVHDVEVTNKDECVTVKGPSKNILIESIYCNWSGGCGMGSFGSDTNVSDITYRNIYTWSSNNMMLIKSNGGSGFVENVLLENFIGHGNAYSLDIDSYWASMSAVDGDGVQLSNITVKNWKGTEAYGAERGPVKVVCADGAPCYDITIEDFAMWTEEGDSQWYSCESAYGSGYCLQDSDDHVSYSVTTSTVSSAPSGYSATSMAADLTTDFGSTVSIPIPTIPTSFYPGATPYSALMANSASTAAASSIASHATVHSSSASVAASVPSAVAPSESIPAATSAVVSSAAAIAPSPAVGAQEGSTTSAPSFAAPSGAGNSPQGPTGASGFGEKGQQGEQGEQGEQGEQGVCYV

SEQ ID NO: 4625 - protein, 378 aa, Aspergillus niger
MHYKLLFAAAAASLASAVSAAGVVGAAEGFAHGVTGGGSASPVYPTTTDELVSYLGDNEPRVIILDRTFDFTGTEGTETTTGCAPWGTASQCQVAINLHSWCDNYQASAPKVSVTDKAGILPITVNSNKSIVGQGTKGVIKGKGLRVVSGAKNVIIQNIAVTDINPKYVWGGDAITVDDSDLVWIDHVTTARIGRQHIVLGTSADNRVTISYSLIDGRSDYSATCNGHHYWGVYLDGSNDMVTLKGNYFYNLSGRMPKVQGNTLLHAVNNLFHNFDGHAFEIGTGGYVLAEGNVFQDVNIVVETPISGQLFSSPDANTNQQCASVFGRSCQLNAFGNSGSMSGSDTSIISKFAGKTIAAAHPPGNIAQWTMKNAGQGK

SEQ ID NO: 4626 - protein, 379 aa, Aspergillus niger
MKYSTIFSAAAAVFAGSAAAVGVSGSAEGFAEGVTGGGDATPVYPDTIDELVSYLGDDEARVIVLTKTFDFTDSEGTTTGTGCAPWGTASACQVAIDQDDWCENYEPDAPSVSVEYYNAGVLGITVTSNKSLIGEGSSGAIKGKGLRIVSGAENIIIQNIAVTDINPKYVWGGDAITLDDCDLVWIDHVTTARIGRQHYVLGTSADNRVSLTNNYIDGVSDYSATCDGYHYWGIYLDGDADLVTMKGNYIYHTSGRSPKVQDNTLLHCVNNYFYDISGHAFEIGEGGYVLAEGNVFQNVDTVLETYEGAAFTVPSTTAGEVCSTYLGRDCVINGFGCSGTFSEDSTSFLSDFEGKNIASASAYTSVASRVVANAGQGNL

SEQ ID NO: 4627 - protein, 211 aa, Aspergillus niger
MKVTAAFASLLLTAFAAPAPEPVLVSRSAGINYVQNYNGNLGDFTYDESTGTFSMYWEDGVSSDFVVGLGWTTGSSKSITYSAQYSASSSSSYLAVYGWVNSPQAEYYIVEDYGDYNPCSSATSLGTVYSDGSTYQVCTDTRRTRPSITGTSTFTQYFSVRESTRTSGTVTIANHFNFWAQHGFGNSNFNYQVMAVEAWNGVGSASVTISS

SEQ ID NO: 4628 - protein, 211 aa, Aspergillus niger
MKVTAAFAGLLVTAFAPPVPEPVLVSRSAGINYVQNYNGNLGDFTYDESAGTFSMYWEDGVSSDFVVGLGWTTGSSNAITYSAEYSASGSSSYLAVYGWVNLSQAEYYIVEDYGDYNPCSSATSLGTEYSDGSTYQVCTDTRTNEPSITGTSTFTQYFSVRESTRTSGTVTVAIHFNFWAQHGFGNSDFNYQVMAVEAWSGACSASVTISS

SEQ ID NO: 4629 - protein, 383 aa, Aspergillus niger
MVRQLILISSLLAAVAVRAPADPAHPMVTEAPDVNLVEKRATTCTFSGSEGASKASKSKTSCSTIYLSDVAVPSGTTLDLSDLNDGTHVIFQGETTFGYEEWEGPLVRVSGTDITVEGESDAVLNGDGSRWWDGEGGNGGKTKPKFFYAHDLTSSTIKSIYIENSPVQVFSIDGSTDLTMTDITVDNTDGDTDDLAANTDGFDIGESTYITITGAEIYNQDDCVAINSGENIYFSASVCSGGHGLSIGSVGGRDDNTVKNVTFYDVNVLKSQQAIRIKTIYGDTGSVSEVTYHEIAFSDATDYGIVIEQNYDDTSKTPTTGVPITDFVLENIVGTCEDDDCTEVYIACGDGSCSDWTWTGVSVTGGSVSDDCLNVPSGISCDL

SEQ ID NO: 4630 - protein, 455 aa, Aspergillus niger
MRSILFILFSVFAGLAAGQLIGPVGPTTQLEDKDIECNILDYGGVADNETDVATSIETTFTECVLNNPKSRLVIPEGDYLIKRSVVLSNGTNWAFQLDGLITAAYGGNWTVDPVDFEFYSSNGLGAFQGQGYIYRNLANTDRPRLVRLISPTNASVHDLILVDSPKFHIVFDFAVNLEAYHLTIRGANLGSYDGIDAIGTNYYIHDNEVTNRDECVSVKSPSHHALVENLVCNQAGSGVSIGSLNVSAEISNIEARNISIIQGNNIAFIKTYPGGSGYVKDVTFENFRSLNSLYGLDINQYWQNTWEPDTGSVTLSNLVFKNFSGSVADGALRPPLYLFASDLTFATNVTVEEFSVWTETGTTVVNKISNIFGTGDDSYGENDGIESLQSGESPYTYTSTYTITASPTNWQAPSTPTWALPSTGYGTASPIPVYTPAPLWRPGGIDYNLHYWGSF

SEQ ID NO: 4631 - protein, 450 aa, Aspergillus niger
MTWSTSFLSVHFFAFITTSIHAQLTGSVGPLTSVSDKAAVKTCNVLDYGARSDNTTDVGQPIIDAFADCGSGGLIYIPEGDYLLKNWISLENGSAWAIQLDGVLYRDSSPSSQSYMFEISGGRDFELFSSNATGAIQGSGYLYHRDDTYTGPRMLHISGVSDWSVHDLVLVDSPMFHFVIDGGYNGEVYNMAIRGADHGGLDGIDVYGDNMWIHDIMVTNKDECVTTKTNSHNFLIENIYCNSSGGCAIGSLGSGANVSNIVYRNVYTWDSNQMMMIKSNGGSGDVSNAVFENFIGHGNAYSLDLDSYWSSMDAIDGDGIYYHNITFQNWTGTAVDGETRPPIRVICPEDTPCTEIALVQIDLWVEEGGYDEYICKNAYGSGYCLDSATGTSTPYTTTTYVNSAPTGYEAPTMTDDLATAFGTSASIPIPTIPASFFPGVTPISAVAGSS

SEQ ID NO: 4632 - protein, 455 aa, Aspergillus niger
MRSILFILFSLFAGLAAGQLIGPVGPTTQLEDKDIECNILDYGGVADNETDVATSIETTFTECVLNNPKSRLVIPEGDYLIKRSVVLSNGTNWAFQLDGLITAAYGGNWTVDPVDFEFYSSNGLGAFQGQGYIYRNLANTDRPRLVRLISPTNASVHDLILVDSPKFHIVFDFAVNLEAYHLTIRGANLGSYDGIDAIGTNYYIHDNEVTNRDECVSVKSPSHHALVENLVCNQAGSGVSIGSLNVSAEISNIEARNISIIQGNNIAFIKTYPGGSGYVKDVTFENFRSLNSLYGLDINQYWQNTWEPDTGSVTLSNLVFKNFSGSVADGALRPPLYLFASDLTFATNVTVEEFSVWTETGTTVVNKISNIFGTGDDSYEENDGIESLQSGESPYTYTSTYTITASPTNWQAPSTPTWALPSTGYGTASPIPVYTPAPLWRPGGIDYNLHYWGSF

SEQ ID NO: 4633 - protein, 440 aa, Aspergillus niger
MSVFKASFLFLLSSSLVHGVPHSSRASRSQQCVVPSKYQASNGMADDSVAVSQAFAQCATDSVIIFEEGVNYNIFQPITATNLSNVEIRMHGNLHLPQNITAVQNIVSDGTSTWFTLEGPKVDWIGPEDVNNGWIDSYGQPWWDANPAGSSGIDNRPHLMSFKSSQATMKYFRSRKPIAWNVKLHGQDITVSHAIIDATSTGSFPFNTDGFDVEGTNIQITDSIMYNGDDAIAVGADSHDTLFTRNTIGYQTHGMSIGSLGKDPTDFANISNIRFDDVTVVDGLYAARFKSWSGGTGLVKNVTWNNIRVFNVTFPIFVTQSYSDQGASRSGTVNASSAVMMEDFTWSDFAGSINTYQPGDGSCVSDPCWYNVGLPNLKHTEALIIECHTAQSCKNFVTDNIQLYPQVLEPASVICMNATAALNPDLGFTCKNGTYSPLSN

SEQ ID NO: 4634 - protein, 438 aa, Aspergillus niger
MYLLPLTLFLTAAFGVSIPRSPLIPGAQIVPASSTADLRAIGAQHHKYPDRETVTIRASRNALDDVSSDFLWGLKQANHGGRLLLKQGETYVIGKKLDLTFLDNIEVQLEGEIQFTNNITYWQANNFYYDFQKSITFWRWGGQDIKIFGSGVLNGNGQKWYDEFAGKQILVYNTFYRPILFLTDNATRISVEGITQLNSPCWTNFFVRTNDVSFDNVYIHAFSTNASSDPANTDGMDSLDVDGVSFTNMRIDVGDDCFSPKPNTTNIFVQNMWCNNTHGVSMGSIGQYAGEMDIIENVYIENVTLLNGQNGARLKAWAGQDVGYGRINNVTYKNIQIQNTDAPIVLDQCYFDINATECAKYPSAVNITNILFENIWGSSSGKDGKIVADLVCSPDAVCTNITLSNVNLTSPKGTAEIVCDDIQGGIGVDCVSDESVTR

SEQ ID NO: 4635 - protein, 434 aa, Aspergillus niger
MKLPILVTLFITLPALCVSSKTPSAPTISAYPKSPGNFKPASGRQNSTSNVCEVKPNQTDAAPGILAAAHTCNNGGTVFLPPGDFVVATALDLTFLNNIDFAIWGNITFKKDIDLWTTQAFQYTFQTASLFWRFGGNNVNIYGDGKGVIDGAGQYWWSAMAEDSSVMRPCLLGTDGLHHATISGLTMLNSPNWFNLIANSTDILISNMTMLVESEISDAPAKNTDGWDIYRSSNIVIQDSRIVNTDDCVSFKPNSTQIVIQNLDCTGSHGISVGSLGQYQGETDIVEDLYIYNISMTDASDVARIKVWPGVPADTSGSTSGGGLGRVRNVTYEHMQSENNDHIISVSQCYESKNQTMCDSYPSKLVIEDVLFKDFKGTTSKKYDPEIGELTCSSPDVCHNITVQDINVTPPSGDSPTFTCNNMGNSNLEDITCA

SEQ ID NO: 4636 - protein, 435 aa, Aspergillus niger
MRLTHVLSHTLGLLALGATAEAFSRSREAACSPKKPFRPLPTSSSRDKTCHVRSHGDGSDDSDYILSALHQCNHGGKVVFDEDKEYIIGTALNMTFLKNIDLEVLGTILFTNDTDYWQANSFKQGFQNATTFFQLGGEDVNMYGGGTINGNGQVWYDLYAEDDLILRPILMGIIGLNGGTIGPLKLRYSPQYYHFVANSSNVLFDGIDISGYSKSDNEAKNTDGWDTYRSNNIVIQNSVINNGDDCVSFKPNSTNILVQNLHCNGSHGISVGSLGQYKDEVDIVENVYVYNISMFNASDMARIKVWPGTPSALSADLQGGGGSGSVKNITYDTALIDNVDWAIEITQCYGQKNTTLCNEYPSSLTISDVHIKNFRGTTSGSEDPYVGTIVCSSPDTCSDIYTSNINVTSPDGTNDFVCDNVDESLLSVNCTATSD

SEQ ID NO: 4637 - protein, 438 aa, Aspergillus niger
MRMPSAISIGVFAGLSLAASAVPSLRKNGTTCTVIPLGNGQDDVPNILSAVDECGQTSGGRVVLPAPYTYRINQRMTTHLTDSRLEIGGTLLFSDDIDYWVNNSYRVDFQNQSSAWRITGHDYVVDGGPHRGGVDGNGQLWYTWAKGGSNVFGRPMPVHVFESTRATLRNLAIRQPQFWAVLVDSSSHINLDNFYVNATNHDSSVSPEGEWVQNTDGIDTYRSDHITITNWVYQGGDDAVAFKGNSTNIHVENVTVYGGPGIAFGSLGQYPDRTDIVENVTVRNVRVQPSFQRAMNSGVYFKSWIGVNYGVPPNGGGGGHGYVRNVSVENLRLKDVQLPVYIDTCLSYLFSENITQYCDTSTYEFEDLHFRNISGNGLATVTDYPGKNISFAVALLCSEKAPCTDLTFQDISITLPGNYTGKHVLCENAEVEGLPCNS

SEQ ID NO: 4638 - protein, 726 aa, Aspergillus niger
MGALQWLSITAAAASAVSALTPEQMIGAPRRTEVIPNPSGDTGLFSTSQWSFDTHSESTWWSLIDLESGETTTLTDDSDIEEIIWLGSDSSTLLYINSTNAQVPGGVELWIADSSDFANYKAASLSAGFLGIKSTVTDSGDVHFILRGKSYPNGTAYNDQLAETYPSTARIYDSIFVRHWDTYLTTASHAVFSGTLQSSTSDDGNVQYTSSGGLTNLVNPVKGAESPFPPFGGNDDYDLSPDGKWVTFKSKAPELPLANNTAAYVYLVPHDGSATAFAVNGPDSPATPEGVEGESNNPVFSPDSDKIAYFQMATNTYESDRNVLYVYSIADDTITPLAKDWDRSPSSVTWVDGDNLVVASQDLGRTRLFAIPGDAGTTSSPRTFTDGGSVSAQYVLSNSTLLVTSSAFWTSWSVYTASPDEGVINTLASANEIDPELSGLSSSDFEEFYFDGNWTTLQGWITYPQDFDSSKKYPLAFLIHGGPEDAWADEWNLKWHSKVFADQGYVVVQPNPTGSTGFGQQLTDAIQLNWTAGAAYDDLTKAWQYVHDTYDFIDTDNGVAAGPSFGAFMITWIQGDDFGRKFKALVSHDGPFIGDAWVETDELWFVEHEFNGTFWQARDAFHNTDPSGPSRVLAYSTPQLVIHSDKDYRIPVANGIGLFNTLQERGVPSRFLNFPDEDHWVTGQENSLVWYQQVLGWINRYSGVGGSNPDAIALEDTVNPVVDLNP

SEQ ID NO: 4639 - protein, 378 aa, Aspergillus niger
MKVPFLQLLCLNAALASANVVQGAAQGFAAGVTGGGDITPSYPKTNEELVSLLESDEPQVVVLTKTFDFIGTEGTTTEDGCAPWGTGKSCQLAINSNGWCGKNPVVTITYDNAAKNGIHIKSNKTLVGEGDKGVLSGKGLYFEGGVSNIIVQNIKITNLNPGFVWGGDAFTFFGADLIWIDHCETSLTGRQHYVTGFHPNTRMTWSNNFLNGVTTHSAGCDDHHYWTMELVGPGDEITFQNNYVYHTTGRGPALSGTTLFHAVNSVWSSIPGHAIEGGDKGRGLFEGCFFEDVVEIAPAKPENQLFSASEANAASCKSALGRACQANGYSKSGAFGSSETGFFKDFAGLTIAPAGSATDALAYVPKNCGIGRLESCDA

SEQ ID NO: 4640 - protein, 211 aa, Aspergillus niger
MKVTAAFAGLLVTALAAPAPEPVLVSRSAGINYVQNYNGNLGDFTYDESAGTFSMYWEDGVSSDFVVGLGWTTGSSNPITYSADYSASGSSSYLAVYGWDNYPQAEYYIVEDYGDYNPCSSATSLGTVYSDGSTYQVCTDTRTNEPSITGTSTFTQYFSVRESTRTSGTVTVANHFNFWAQHGFGNSDFNYQVVAVEAWSGAGSASVTISS

SEQ ID NO: 4641 - protein, 499 aa, Aspergillus niger
MLSKTSLLSLLSLAAGVVNADFGITTSDSYVINANSPNSLVFTVDRGSCDITSIVHYGTELQYSGKGSHIGSGLGTATVSATKSGDYIKVTCETDTLTQYMGVHDGDRIIHMATYITEEPSIGELRFIARLNSDVLPNEEPFGDVSNTADGEPIEGSDVFLVDGETRSKFYSSQRFIDDQRHCIAGDEHRVCMILNQYETSSGGPFHRDINSNNGGDYNSLYWYMNSGHVQLESYRMGLHGPYSMYFSRSGTPSTDIDTSFFADLDIEGYVAESGRGTVSGTASGADSSFDWVVHWYNDDAQYWTYTSSSGSFTSPAMKPGTYTMVYYQGEYVVATSEVTVSAGSSTSKDISGSVETGTTIFKIGDWDGQPTGFRNAENQLRMHPSDSRMSDWGPLTYTVGSSSLTDFPMAIFKSVNSPVTIKFTATSDQTGAATLRIRTTLSFAGGRPQATINDYEGSAPSAPTNLDSRGVTRGAYRGYGDVYDVSVPEGTIVEGENT

SEQ ID NO: 4642 - protein, 476 aa, Aspergillus niger
MTLLRHLLTATALLGASVQAAQGVTGSPFGFASGTTGGGDATPAAPSDISQLKTWLSDSTPRVILIDKEFNFLGSEGKCTNCECCKPASNTCGSSGQNAVKQNGSDWCGSYPTLTCTYDNAGIEGLEVASNKSIVGVGSSGVLRGKGLRLVNGVSNIIIQNIHITELNPEFIWGGDAITLDGTNNVWIDHVKINLIGRQMFVAGYEASHSVTISNSEFDGETSWSATCDGHHYWTVLGYGHNDKITFANNYIHHTSGRSPKLEFNSFWHAYNNYWYNNTGHAFDVGKNTRALIEGNVMVQVDTPLLADSNPGAVFAVNTSDVSTCTSTLGRTCVPNTLISSGTLSGSDSSVISSWPSGESDVTVMAASKVASYVKANAGIGKLGNGSGSSSTVGAAATSAVAKRADSDDAPFVPAYSEAGPGASAVPTQPSWSWRTVTNGPAPTGAPSDSPSAPQGLGAPVQASNKHHHQGHGRGY

SEQ ID NO: 4643 - protein, 857 aa, Aspergillus niger
MRRTFAALVAGYLLDSVHAAASQAYTWKNVVTGGGGGFTPGIVFNPSAKGVAYARTDIGGAYRLNSDDTWTPLMDWANNSNWHDWGIDAIATDPVDTDRVYVAVGMYTNDWDPNDGSILRSTDQGDTWEETKLPFKVGGNMPGRGVGERLAVDPNDNSILYFGARSGNGLWKSTDYGETWSNVTAFKWTGTYFQDSSSTYTSDPVGIAWVTFDSTSGSSGSPTPRIFVGVVDTGESVFVSEDAGETWTWVSGEPMYGFLPHKGILSPSEHTLYISYSNGAGPYDGTNGTVHKYNITSGVWTDISPTSMTDTYYGYGGLAVDLQVPGTVMVAALNCWWPDELIWRSTDSGGTWSPIWAWNGYPSINYYYSYDISNAPWLQDDTSTDEFPVRVGWMVEALAIDPFDSDHWLYGTGETIYGGHDLQNWDSEHNVTIESLAVGIEEMAVLGLITPPGGPALLSAVGDDGGFYHTSLTTAPSQYYHTPTYSSTNGIDYAGNKPANIVRSGSSDSDPTLALSSSFGESWYADYAASSSTATGQVALSADADTILLMNSDGAYRSANSATLSAVSSLPSGAVIASDKANNTYFYGASGSSFYLSSDTAATFTVTTTLGSSTTANAIRAQPSLAGDVWVSTDTGLFHSTNYGKSFTQIGSGCTEGWSFGFGKPSSDGDYPVLFGFFTVDGVTGLFKTEDQGVNWQIISDAEHGFGSASANVVNGDLQNYGRVFVGTNGRGIFYGDPSGTLPSATATASSASSTAVKSSTSTSTSKVGSSTTVSSSTATTITTSSIKSTTLTTTTKSSSSTTSTSSTATGTASAYGQCGGSGFTGPTQCPSGWTCTYENEYYSQCKSIPGIATDRG

SEQ ID NO: 4644 - protein, 521 aa, Aspergillus niger
MKVASLLSLALPGAALAATDPFQSRCNEFQNKIDIANVTVRSVAYVAAGQNISQAEVASVCKASVQASVDLCRVTMNISTSDRSHLWAEAWLPRNYTGRFVSTGNGGLAGCVQETDLNFAANFGFATVGTNGGHDGDTAKYFLNNSEVLADFAYRSVHEGTVVGKQLTQLFYDEGYNYSYYLGCSTGGRQGYQQVQRFPDDYDGVIAGSAAMNFINLISWGAFLWKATGLADDPDFISANLWSVIHQEIVRQCDLVDGALDGIIEDPDFCAPVIERLICDGTTNGTSCITGAQAAKVNRALSDFYGPDGTVYYPRLNYGGEADSASLYFTGSMYSRTEEWYKYVVYNDTNWNSSQWTLESAKLALEQNPFNIQAFDPNITAFRDRGGKLLSYHGTQDPIISSTDSKLYYRRVANALNAAPSELDEFYRFFQISGMGHCGDGTGASYIGQGYGTYTSKAPQVNLLRTMVDWVENGKAPEYMPGNKLNANGSIEYMRKHCRYPKHNIHTGPGNYTDPNSWTCV

SEQ ID NO: 4645 - protein, 350 aa, Aspergillus niger
MIYPLLLSALPLLSSAALTYRGADISSLLIEEDAGISYKNLNGETQALEDILVNNGVNSIRQRVWVDPSDGSYDLDYNLKLAKRVQAAGMSIYLDLHLSDTWADPSDQTTPTGWSTTDIDTLTWQLYNYTLDVCNTFAENDIDIEIVSIGNEISSGLLWPLGKTSNYDNIAKLLHSGAWGVKDSNQATTPKIMIHLDNGWDWEEQEYFYKTVLATGSLLSTDFDLMGVSYYPFYNSEATLSALQTSLTNMQSNYDKSVVVVETNWPVSCPDPEYSFPSDLSSIPFSAAGQEEFLEKLAEVVEGVTDGLGIYYWEPAWVDNAALGSSCADNLMVDIDTDEVLESVTVFEDL

SEQ ID NO: 4646 - protein, 841 aa, Aspergillus niger
MRGLNLFQLILALLLSMVAAEDGYDGWLRYAPVSCDLRCRQALPSHVVLLNSTKGSPIETAGRELKAGFQSILSTNLTSRPFQCNSSTSILVATLDEYRQRCRDINVPELDPDGFWLQSEGDTVRILGKDARGALYGAYEYLAMVAQRNFSRVAYATSPHAPIRWVNQWDNMDGSIERGYGGASIFFKDGTVVEDMAPVEQYARLLASIRINAIVVNNVNANATLLLPENMKGLGRIADACRPYGVQIGISLNFASPEDLGGLNTYDPLDPGVIAWWQNITDSLYTYVPDMAGYLVKADSEGQPGPDTYNRTLSQGANLFARALQPYGGVLMYRAFVYDDNLNESDWKADRAKAAVEYFKDLDGQFEENVVIQIKYGPIDFQVREPTSPLFANLYHTNTAIELEVSQEYLGQQCHLVYLPPLWKTVLDFDLRVDHKPSMVRDIISGQRFNRTLGGWAAVVNVGTNRTWLGSHLAMSNLYAYGRLAWSPTDESEQILEDWTRLTFGQNHHVINTISDMSMTSWPAYENYTGNLGIQTLTDILYTHYGPNPATQDNNGWGQWTRADHDSVGMDRTIRNGTGYTGQYPEEVARVYESLESTPDDLVLWFHHVPWTHRLHSGVTVIQHFYNAHYAGAEAAHGFVRQWESLEGLIDRERYEAMRSRLVYQAGHSIVWRDAINNFYYNMTGIPDVAGRVGHHPWRIEAESMRLDGYQTYTVSPFEAASNTTAIITTSNSTTGTARTSIKAPSGVYDIGVNYYDLYGGQSKWTLSVGDKVVGQWLGDMEHNSLGHTPSIYLDGHSATRITFHGVGIRQGDQLKIVGEANGVEPAPLDYIVLLPPGLVD

SEQ ID NO: 4647 - protein, 323 aa, Aspergillus niger
MTNFKWIVAAAGLLFGQVLAAPTATSTHAKRATVSDAAFGYASLNGGTTGGAGGTTTTVSSYAAFTSAVSGDDAKVVYVDGTIKQTADQVKIGSNTSIIGKDANAILEGFGVLVKEKENVIIRNLGVSKVLADNGDAIGVQYSNNVWIDHCDVSSDRDHDKDYYDGLIDITHGSDYVTVSNTFIHDHWKASLVGHSDSNEDEDSGHLTVTYANNYWYNVNSRAPSFRFGTGHVYNSYYLDVSDGINTRDGAQLLVESNQFVDSKKALYSTDDGYAVSNDNDFGDSENTAEEGTLTSMPYDYTLLGSANVKAAVVGTAGQTLTF

SEQ ID NO: 4648 - protein, 495 aa, Aspergillus niger; identical to SEQ ID NO: 4224

SEQ ID NO: 4649 - protein, 362 aa, Aspergillus niger; identical to SEQ ID NO: 4155

SEQ ID NO: 4650 - protein, 370 aa, Aspergillus niger; identical to SEQ ID NO: 4262

SEQ ID NO: 4651 - protein, 536 aa, Aspergillus niger
MSSFQIYRAALLLSILATANAQQVGTYTTETHPSLTWQTCTSDGSCTTNDGEVVIDANWRWVHSTSSATNCYTGNEWDTSICTDDVTCAANCALDGATYEATYGVTTSGSELRLNFVTQGSSKNIGSRLYLMSDDSNYELFKLLGQEFTFDVDVSNLPCGLNGALYFVAMDADGGTSEYSGNKAGAKYGTGYCDSQCPRDLKFINGEANCDGWEPSSNNVNTGVGDHGSCCAEMDVWEANSISNAFTAHPCDSVSQTMCDGDSCGGTYSASGDRYSGTCDPDGCDYNPYRLGNTDFYGPGLTVDTNSPFTVVTQFITDDGTSSGTLTEIKRLYVQNGEVIANGASTYSSVNGSSITSAFCESEKTLFGDENVFDKHGGLEGMGEAMAKGMVLVLSLWDDYAADMLWLDSDYPVNSSASTPGVARGTCSTDSGVPATVEAESPNAYVTYSNIKFGPIGSTYSSGSSSGSGSSSSSSSTTTKATSTTLKTTSTTSSGSSSTSAAQAYGQCGGQGWTGPTTCVSGYTCTYENAYYSQCL

SEQ ID NO: 4652 - protein, 452 aa, Aspergillus niger
MHQRALLFSALLTAVRAQQAGTLTEEVHPSLTWQKCTSEGSCTEQSGSVVIDSNWRWTHSVNDSTNCYTGNTWDATLCPDDETCAANCALDGADYESTYGVTTDGDSLTLKFVTGSNVGSRLYLMDTSDEGYQTFNLLDAEFTFDVDVSNLPCGLNGALYFTAMDADGGVSKYPANKAGAKYGTGYCDSQCPRDLKFIDGQANVDGWEPSSNNDNTGIGNHGSCCPEMDIWEANKISTALTPHPCDSSEQTMCEGNDCGGTYSDDRYGGTCDPDGCDFNPYRMGNDSFYGPGKTIDTGSKMTVVTQFITDGSGSLSEIKRYYVQNGNVIANADSNISGVTGNSITTDFCTAQKKAFGDEDIFAEHNGLAGISDAMSSMVLILSLWDDYYASMEWLDSDYPENATATDPGVARGTCDSESGVPATVEGAHPDSSVTFSNIKFGPINSTFSASA

SEQ ID NO: 4653 - protein, 443 aa, Aspergillus niger
MRWLLTSSALLVPAAALVRPDGVGLTPALGWNSWNAYSCDIDADKIVTAANEVVNLGLKDLGYEYINIDDCWSVKSGRNTTTKRIIPDPDKFPNGISGVADQVHALGLKLGIYSSAGLTTCAGYPASLGYEEIDAQSFAEWGIDYLKYDNCGVPTNLTDQYTYCVPDSTDGSNYPNGTCVNLTDAAPQGYDWATSTTAKRYQRMRDALLSVNRTILYSLCDWGQADVNAWGNATGNSWRMSGDITATWSRIAEIANENSFLMNYANFWGYPDPDMLEVGNGNLTLPENRAHFALWAMMKAPLIIGTPLDSIDTSHLTILSNKPLLTFHQDAVIGRPAYPYKWGYNPDWTFDPEHPAEYWSGPTSSGEVFVLMLNSEGEVKTRSAVWEEVPELKDRGTKKNSKEKKGFKVTDAWTGKDLGCVKDKYEVKLQAHDVAVLVVGGQC

SEQ ID NO: 4654 - protein, 496 aa, Aspergillus niger
  strain ATCC 1015 / CBS 113.46 / FGSC A1144 / LSHB Ac4 / NCTC 3858a / NRRL 328 / USDA 3528.7
MMKRSALLASFLPLALGCDSAETHSCASAFSVSSAAAASFCATFTASTVTATTGVPDVFLSNCDYKTKHLSSACSCLGTADGSAPASTPAAPAVSSSSKVGKAPAVAATRTSAIPTTFHTTAVRVPLSTSAAAAVTSQAVLPAQSSVAGNGGTTCTVTEYASISSAVASCSNILLSNINAPASSTIDLTGLQTGAAVIFAGETTFGDTYDSDFDPIVISGTDVTITGEEGHVINGNGEAYWDGEGSNGGQDKPDHFIVVKDMYNSKIENLNILNWPVHCFEIENTEYLTISGLILNNTAGDAANSKSDGDPAAHNTDGFDIKQSDFLTLSNSWVHNQDDCVAVTSGSSIVVDNLYCYGGHGLSIGSIGGKSNNTVDGVTFSNSQVINSENGCRIKSNADTTGEVYNVKYENITLSGISDYGIDIQQDYENGGATGDPTNGVKIENISFVNVKGTMSDGKDYYILCGDGSCSNFVFTDVDITGGSDDSCNYPSSGCP

SEQ ID NO: 4655 - protein, 841 aa, Aspergillus niger; identical to SEQ ID NO: 4646
  strain ATCC 1015 / CBS 113.46 / FGSC A1144 / LSHB Ac4 / NCTC 3858a / NRRL 328 / USDA 3528.7

SEQ ID NO: 4656 - protein, 267 aa, Aspergillus niger
  strain ATCC 1015 / CBS 113.46 / FGSC A1144 / LSHB Ac4 / NCTC 3858a / NRRL 328 / USDA 3528.7
MAPLKSLLLGASLATLALSTPLATDAENLYARQFGTGSTANELEQGSCKDVTLIFARGSTELGNMGTVIGPPLCDNLKSKLGSDKVACQGVGGQYSAGLVQNALPQNTDPGSISAAKQMFEEANSKCPNTKIVAGGYRCWGNSQGSAVIDNAVQELSTTVKDQVKGVVLFGFTRNVQDHGQIPNYPKDDVKVYCAVGDLVCDDTLVVTAMHLTYGMDAGDAASFLAEKVQSSSSSTTSSSSDAASSSSAAGTSSSGLSGLSSFFGGL

SEQ ID NO: 4657 - protein, 341 aa, Aspergillus niger
  strain ATCC 1015 / CBS 113.46 / FGSC A1144 / LSHB Ac4 / NCTC 3858a / NRRL 328 / USDA 3528.7
MRQAQSASLLAALLSATQVAAHGHVTNLVVDGVYYEGFDISVFPYESDPPKVAAWTTPNTGNGFISPDEYRNPNIICHENATNAQAHVVVGAGEKINIQWTAWPDSHHGPVLDYLARCDGSCETVDKTDLEFFKIDGVGLVSDTEVPGTWGTDQLINNNNSWMVEIPPSIAAGNYVLRHELIALHGAEEQDGAQNYPQCFNLQVTGTGTATPSGVKGTELYTATEGGILVNIYSSLSTYTMPGPTAYSGDVSITQTTSAVTSTGTAVVGSASAPTTSVQPEPAQSTITPAPAVSSAASGSSGSQSLYGQCGGINWTGATQCASGSSCHSYNPYYYQCIASA

SEQ ID NO: 4658 - protein, 354 aa, Aspergillus niger
  strain ATCC 1015 / CBS 113.46 / FGSC A1144 / LSHB Ac4 / NCTC 3858a / NRRL 328 / USDA 3528.7
MHSYQLLGLAAVGSLVSAAPAPSRVSEFAKKASTCTFTSASEASESISSCSDVVLSSIEVPAGETLDLSDAADGSTITFEGTTSFGYKEWKGPLIRFGGKDLTVTMADGAVIDGDGSRWWDSKGTNGGKTKPKFMYIHDVEDSTFKGINIKNTPVQAISVQATNVHLNDFTIDNSDGDDNGGHNTDGFDISESTGVYISGATSISFTGGTCSGGHGLSIGSVGGRDDNTVKNVTISDSTVSNSANGVRIKTIYKETGDVSEITYSNIQLSGITDYGIVIEQDYENGSPTGTPSTGIPITDVTVDGVTGTLEDDATQVYILCGDGSCSDWTWSGVDLSGGKTSDKCENVPSGASC

SEQ ID NO: 4659 - protein, 493 aa, Aspergillus niger
  strain ATCC 1015 / CBS 113.46 / FGSC A1144 / LSHB Ac4 / NCTC 3858a / NRRL 328 / USDA 3528.7
MSSFQIYRAALLLSILATANAQQVGTYTTETHPSLTWQTCTSDGSCTTNDGEVVIDANWRWVHSTSSATNCYTGNEWDTSICTDDVTCAANCALDGATYEATYGVTTSGSELRLNFVTQGSSKNIGSRLYLMSDDSNYELFKLLGGTGYCDSQCPRDLKFINGEANCDGWEPSSNNVNTGVGDHGSCCAEMDVWEANSISNAFTAHPCDSVSQTMCDGDSCGGTYSASGDRYSGTCDPDGCDYNPYRLGNTDFYGPGLTVDTNSPFTVVTQFITDDGTSSGTLTEIKRLYVQNGEVIANGASTYSSVNGSSITSAFCESEKTLFGDENVFDKHGGLEGMGEAMAKGMVLVLSLWDDYAADMLWLDSDYPVNSSASTPGVARGTCSTDSGVPATVEAESPNAYVTYSNIKFGPIGSTYSSGSSSGSGSSSSSSSTTTKATSTTLKTTSTTSSGSSSTSAAQAYGQCGGQGWTGPTTCVSGYTCTYENAYYSQCL

SEQ ID NO: 4660 - protein, 410 aa, Aspergillus niger
  strain ATCC 1015 / CBS 113.46 / FGSC A1144 / LSHB Ac4 / NCTC 3858a / NRRL 328 / USDA 3528.7
MKTLSLAAVLLVQAWTANSSPRAKRSSGFQWFGSNESGAEFGSGNIPGTLGTDYIWPDATAIATLHSAGMNIFRVPFLMERLVPDELTGAADATYMADLKATVQTITDLGAYAVVDPHNFGRYYGNIITSTSDFAAFWTTVASEFTDNDLVIFDTNNEFHDEDQTLVLDLNQAAITAIRATGATTQYIFVEGNSYTGAWTWTTTNTNLVNLTDPNDHLIYEMHQYLDSDGSGTSSTCVSSTIGAERIADATTWLKENGKQAVLGEFAGGANSVCEEAVTGMLDAMVDASDVWLGGMWWSAGPWWGDYIFSLEPDDGIAYEYYLGVLEGYTPGSSSGSSGGSTTSAVASASSTSSAGSTTSKVTTTTAATATSTAVAAHYAQCGGEGWTGATTCADGYTCTVENEWYSQCL

SEQ ID NO: 4661 - protein, 857 aa, Aspergillus niger
  strain ATCC 1015 / CBS 113.46 / FGSC A1144 / LSHB Ac4 / NCTC 3858a / NRRL 328 / USDA 3528.7
MRRTFAALVAGYLLDSVHAAASQAYTWKNVVTGGGGGFTPGIVFNPSAKGVAYARTDIGGAYRLNSDDTWTPLMDWANNSNWHDWGIDAIATDPVDTDRVYVAVGMYTNDWDPNDGSILRSTDQGDTWEETKLPFKVGGNMPGRGVGERLAVDPNDNSILYFGARSGNGLWKSTDYGETWSNVTAFKWTGTYFQDSSSTYTSDPVGIAWVTFDSTSGSSGSPTPRIFVGVVDTGESVFVSEDAGETWTWVSGEPMYGFLPHKGILSPSEHTLYISYSNGAGPYDGTNGTVHKYNITSGVWTDISPTSMTDTYYGYGGLAVDLQVPGTVMVAALNCWWPDELIWRSTDSGATWSPIWAWNGYPSINYYYSYDISNAPWLQDDTSTDEFPVRVGWMVEALAIDPFDSDHWLYGTGETIYGGHDLQNWDSEHNVTIESLAVGIEEMAVLGLITPPGGPALLSAVGDDGGFYHTSLTTAPSQYYHTPTYSSTNGIDYAGNKPANIVRSGSSDSDPTLALSSSFGESWYADYAASSSTATGQVALSADADTILLMNSDGAYRSANSATLSAVSSLPSGAVIASDKANNTYFYGASGSSFYLSSDTAATFTVTTTLGSSTTANAIRAHPSLAGDVWVSTDTGLFHSTNYGKSFTQIGSGCTEGWSFGFGKPSSDGDYPVLFGFFTVDGVTGLFKTEDQGVNWQIISDAEHGFGSASANVVNGDLQNYGRVFVGTNGRGIFYGDPSGTLPSATATASSASSTAVKSSTSTSTSKVGSSTTVSSSTATTITTSSIKSTTLTTTTKSSSSTTSTSSTATGTASAYGQCGGSGFTGPTQCPSGWTCTYENEYYSQCKSIPGIATDRG

SEQ ID NO: 4662 - protein, 629 aa, Aspergillus niger
  strain ATCC 1015 / CBS 113.46 / FGSC A1144 / LSHB Ac4 / NCTC 3858a / NRRL 328 / USDA 3528.7
MHGLRLVCSIGALPLAILAYPAASLHTNPVSADLDSLRLTSNSEYVNSVHVNMNLSVAVSAEEHYTDTAARLLQNIVPGASFRLIDDHFVGDNGVAHVYLRQTLHGNDIDNADFNIGKDGLVLSFGHSFFTGALPSSYLDNPNVLGPGAALRGARDALQLPLTIDNVSTEAADGRNEYIFREVVGAVSDPKAKLVYLVKPEGTLALTWRIETDMYEHWLLTYIDAENTTVHGVVDYVADATYQVYPWGINDPAEGHRTIVTDPWDLSASAYTWISDGRDNYTTTRGNNAIAHWNPTGGGSYLYNLRPSDPNLNFQWPYSPNMSPPRSYINASIVQLFYTANTYHDLLYTLGFTESAGNFQWNNSAHGGRDKDYVILNAQDGSGFSNANFATPPDGIPGRMRMYIWIESTPSRDGSFDAGIVIHEYTHGVSNRLTGGSHNAGCLSTLESGGMGEGWGDFMATAIRIKPNDTRTTSYTMGAWADNDKRGVRDYPYSTSFAENPLNYTSVNTMNGVHAIGTVWATMMYEVLWNLIDKYGKNDGSRPVFRNGVPTDGKYLMMKLVMDGMALQPCNPNFVQARDAILDADIVLTGGKNRCEIWRGFAKRGLGQGAAHSSLNWMRRGSTLLPKGC

SEQ ID NO: 4663 - protein, 436 aa, Aspergillus niger
  strain ATCC 1015 / CBS 113.46 / FGSC A1144 / LSHB Ac4 / NCTC 3858a / NRRL 328 / USDA 3528.7
MPSAISIGVFAGLSLAASAVPSLRKNGTTCTVIPLGNGQDDVPNILSAVDECGQTSGGRVVLPAPYTYRINQRMTTHLTDSRLEIGGTLLFSDDIDYWVNNSYRVDFQNQSSAWRITGHDYVVDGGPHRGGVDGNGQLWYTWAKGGSNVFGRPMPVHVFESTRATLRNLAIRQPQFWAVLVDSSSHINLDNFYVNATNHDSSVSPEGEWVQNTDGIDTYRSDHITITNWVYQGGDDAVAFKGNSTNIHVENVTVYGGPGIAFGSLGQYPDRTDIVENVTVRNVRVQPSFQRAMNSGVYFKSWIGVNYGVPPNGGGGGHGYVRNVSVENLRLKDVQLPVYIDTCLSYLFSENITQYCDTSTYEFEDLHFRNISGNGLATVTDYPGKNISFAVALLCSEKAPCTDLTFQDISITLPGNYTGKHVLCENAEVEGLPCNS

SEQ ID NO: 4664 - protein, 378 aa, Aspergillus niger
  strain ATCC 1015 / CBS 113.46 / FGSC A1144 / LSHB Ac4 / NCTC 3858a / NRRL 328 / USDA 3528.7
MVTSSSVIGLTLWAALVSASPVADPLVTPAPKLEDLEKRATSCTFSGSEGASSASKSKTSCSTIVLSDVAVPSGTTLDLTDLNDGTHVIFEGETTFGYEEWSGPLVSVSGTDITVTGADGAYLNGDGSRWWDGEGSNGGKTKPKFFYAHDLTSSTISGIYIQNSPVQVFSIDGSTYLTMEDITIDNTDGDDGEAANTDGFDIGDSTYITITGANVYNQDDCVAVNSGENIYFSGGVCSGGHGLSIGSVGGRSDNTVKNVTFYDSDIKSSQNGVRIKTIYGDTGSVSEVTYKEITLSDITDYGIVVEQNYDDTSESPTDGITIEDFVLDNVQGSVESSGTNIYIVCGSDSCTDWTWTDVDVTGGKTSSDCENVPDDISC

SEQ ID NO: 4665 - protein, 128 aa, Aspergillus niger
  strain ATCC 1015 / CBS 113.46 / FGSC A1144 / LSHB Ac4 / NCTC 3858a / NRRL 328 / USDA 3528.7
QQPKSTVIITIIAPPTTTQQPPSYTSPALFQSSILDVSNTYRKAHNASNLIWNTTLTQYALDWAQGCKWQHSNGPYGENLAFGYPNVSSAVAAWGDEVQKYNFQEPTGFTEETGHFTQLVWRETREVG

SEQ ID NO: 4666 - protein, 384 aa, Aspergillus niger
  strain ATCC 1015 / CBS 113.46 / FGSC A1144 / LSHB Ac4 / NCTC 3858a / NRRL 328 / USDA 3528.7
MVRQLILISSLLAAVAVRAAPADPAHPMVTEAPDVNLVEKRATTCTFSGSEGASKASKSKTSCSTIYLSDVAVPSGTTLDLSDLNDGTHVIFQGETTFGYEEWEGPLVRVSGTDITVEGESDAVLNGDGSRWWDGEGGNGGKTKPKFFYAHDLTSSTIKSIYIENSPVQVFSIDGSTDLTMTDITVDNTDGDTDDLAANTDGFDIGESTYITITGAEIYNQDDCVAINSGENIYFSASVCSGGHGLSIGSVGGRDDNTVKNVTFYDVNVLKSQQAIRIKTIYGDTGSVSEVTYHEIAFSDATDYGIVIEQNYDDTSKTPTTGVPITDFVLENIVGTCEDDDCTEVYIACGDGSCSDWTWTGVSVTGGSVSDDCLNVPSGISCDL

SEQ ID NO: 4667 - protein, 459 aa, Aspergillus niger
  strain ATCC 1015 / CBS 113.46 / FGSC A1144 / LSHB Ac4 / NCTC 3858a / NRRL 328 / USDA 3528.7
MHYPLSLALAFLPFGIQAQQTLWGQCGGQGYSGATSCVAGATCATVNEYYAQCTPAAGTSSATTLKTTTSSTTAAVTTTTTTQSPTGSASPTTTASASGNPFSGYQLYVNPYYSSEVASLAIPSLTGSLSSLQAAATAAAKVPSFVWLDTAAKVPTMGDYLADIQSQNAAGANPPIAGQFVVYDLPDRDCAALASNGEYSIADNGVEHYKSYIDSIREILVQYSDVHTLLVIEPDSLANLVTNLNVAKCANAESAYLECTNYALTQLNLPNVAMYLDAGHAGWLGWPANQQPAADLFASVYKNASSPAAVRGLATNVANYNAWTISSCPSYTQGNSVCDEQQYINAIAPLLQAQGFDAHFIVDTGRNGKQPTGQQAWGDWCNVINTGFGERPTTDTGDALVDAFVWVKPGGESDGTSDSSATRYDAHCGYSDALQPAPEAGTWFQAYFVQLLTNANPAF

SEQ ID NO: 4668 - protein, 250 aa, Aspergillus niger
  strain ATCC 1015 / CBS 113.46 / FGSC A1144 / LSHB Ac4 / NCTC 3858a / NRRL 328 / USDA 3528.7
LSLLSAALADIEFIDPAAGTVIRAGDEFTAHWRDSGTLPRLASLVQYDLYLCAGGDTVGSHEDIALLAKNALFAKGNSVTFKIDSEVGGNDANAYFLRIAASGPDASVVNYSDRFTLTNMTGSFSPTVINGIPSAMYPTDSFPPAHMDESHEELRKRQVAGPFTIPYQLQTGPTRYAPMAKKPGSTIPVGTPTPQYPTSAYSVATTYLPQATVQMTLSASETYSVISIENTASPAPHAGDTKMKRFLERW

SEQ ID NO: 4669 - protein, 303 aa, Aspergillus niger
  strain ATCC 1015 / CBS 113.46 / FGSC A1144 / LSHB Ac4 / NCTC 3858a / NRRL 328 / USDA 3528.7
MLSTHLLFLATTLLTSLFHPIAAHVAKRSGSLQQITDFGDNPTGVGMYIYVPNNLASNPGIVVAIHYCTGTGPGYYSNSPYATLSEQYGFIVIYPSSPYSGGCWDVSSQATLTHNGGGNSNSIANMVTWTISEYGADSKKVFVTGSSSGAMMTNVMAATYPELFAAGTVYSGVSAGCFYSDTNQVDGWNSTCAQGDVITTPEHWASIAEAMYPGYSGSRPKMQIYHGSVDTTLYPQNYYETCKQWAGVFGYDYSAPESTEANTPQTNYETTIWGDNLQGIFATGVGHTVPIHGDKDMEWFGFA

SEQ ID NO: 4670 - protein, 435 aa, Aspergillus niger
  strain ATCC 1015 / CBS 113.46 / FGSC A1144 / LSHB Ac4 / NCTC 3858a / NRRL 328 / USDA 3528.7
MRLTHVLSHTLGLLALGATAEAFSRSREAACSPKKPFRPLPTSSSRDKTCHVRSHGDGSDDSDYILSALHQCNHGGKVVFDEDKEYIIGTALNMTFLKNIDLEVLGTILFTNDTDYWQANSFKQGFQNATTFFQLGGEDVNMYGGGTINGNGQVWYDLYAEDDLILRPILMGIIGLNGGTIGPLKLRYSPQYYHFVANSSNVLFDGIDISGYSKSDNEAKNTDGWDTYRSNNIVIQNSVINNGDDCVSFKPNSTNILVQNLHCNGSHGISVGSLGQYKDEVDIVENVYVYNISMFNASDMARIKVWPGTPSALSADLQGGGGSGSVKNITYDTALIDNVDWAIEITQCYGQKNTTLCNEYPSSLTISDVHIKNFRGTTSGSEDPYVGTIVCSSPDTCSDIYTSNINVTSPDGTNDFVCDNVDESLLSVNCTATSN

SEQ ID NO: 4671 - protein, 88 aa, Aspergillus niger
  strain ATCC 1015 / CBS 113.46 / FGSC A1144 / LSHB Ac4 / NCTC 3858a / NRRL 328 / USDA 3528.7
MRFTYQALAVFISSLLVNSAAAHACESSAVWPDPADCHHFYQCNPGTEPAHKVCGAGTAFNPKISACDYEQNVPSCFKDPHHPRPFHA

SEQ ID NO: 4672 - protein, 340 aa, Aspergillus niger; identical to SEQ ID NO: 4231
  strain ATCC 1015 / CBS 113.46 / FGSC A1144 / LSHB Ac4 / NCTC 3858a / NRRL 328 / USDA 3528.7

SEQ ID NO: 4673 - protein, 356 aa, Aspergillus niger
  strain ATCC 1015 / CBS 113.46 / FGSC A1144 / LSHB Ac4 / NCTC 3858a / NRRL 328 / USDA 3528.7
MKTTTYSLLALAAASKLASAHTTVQAVWINGEDQGLGNSADGYIRSPPSNSPVTDVTSTDMTCNVNGDQAASKTLSVKAGDVVTFEWHHSDRSDSDDIIASSHKGPVQVYMAPTAKGSNGNNWVKIAEDGYHKSSDEWATDILIANKGKHNITVPDVPAGNYLFRPEIIALHEGNREGGAQFYMECVQFKVTSDGSSELPSGVSIPGVYTATDPGILFDIYNSFDSYPIPGPDVWDGSSSGSSSGSSSAAAAATTPATQAAVAVSSSAAAVVESTSSAAAAAAATTEAAAPVAVVAPAPTSSVVPAVSASASASAGGVAKKYERCGGISHTGPTTCESGSVCKKWNPYYYQCVESQ

SEQ ID NO: 4674 - protein, 362 aa, Aspergillus niger; identical to SEQ ID NO: 4615
  strain ATCC 1015 / CBS 113.46 / FGSC A1144 / LSHB Ac4 / NCTC 3858a / NRRL 328 / USDA 3528.7

SEQ ID NO: 4675 - protein, 300 aa, Aspergillus niger
  strain ATCC 1015 / CBS 113.46 / FGSC A1144 / LSHB Ac4 / NCTC 3858a / NRRL 328 / USDA 3528.7
MKSFITLSLLATALGAPTATHQARQFDLSSLTSGLSALTSGSAASSGSTGSTGSETTTGSSGLSALASLFPSSSTSSTTGSTSGSGSSSSSSDGLSSLMSMFSSSGSGMPPITPLRLRSSTENGVTQHSGSCKKLTFIFARGTTEIGNMGTVVGPEVASELATLTGNQVTVQGVNYPADWEGNVSLGSSGGPTMASYVKEALQQCPNTKVVLGGYSQGSMVVHYAANQLSADQLSGAVLFGDPLKMEGVGKLSSSKVKEFCASGDPVCENGMNVMAHLTYGSDAKEAAQFLVQAAGVSSS

SEQ ID NO: 4676 - protein, 440 aa, Aspergillus niger
  strain ATCC 1015 / CBS 113.46 / FGSC A1144 / LSHB Ac4 / NCTC 3858a / NRRL 328 / USDA 3528.7
MSVFKASFLFLLSSSLVHGVPHSSRASRSQQCVVPSKYQASNGTADDSAAVSQAFAQCATDSVIIFEEGVNYNIFQPITATNLSNVEIRMHGNLHLPQNITAVQNIVSDGTSTWFTLEGPKVDWIGPEDVNNGWIDSYGQPWWDANPAGSSGIDNRPHLMSFKSSQATMKYFRSRKPIAWNVKLHGQDITVSHAIIDATSTGSFPFNTDGFDVEGTNIQITDSIMYNGDDAIAVGADSHDILFTRNTIGYQTHGMSIGSLGKDPTDFANISNIRFDDVTVVDGLYAARFKSWSGGTGLVKNVTWNNIRVFNVTFPIFVTQSYSDQGASRSGTVNASSAVMMEDFTWSDFAGSINTYQPGDGSCVSDPCWYNVGLPNLKHTEALIIECHTAQSCKNFVTDNIQLYPQVLEPASVICMNATAALNPDLGFTCKNGTYSPLSN

SEQ ID NO: 4677 - protein, 362 aa, Aspergillus niger; identical to SEQ ID NO: 4155
  strain ATCC 1015 / CBS 113.46 / FGSC A1144 / LSHB Ac4 / NCTC 3858a / NRRL 328 / USDA 3528.7

SEQ ID NO: 4678 - protein, 488 aa, Aspergillus niger
  strain ATCC 1015 / CBS 113.46 / FGSC A1144 / LSHB Ac4 / NCTC 3858a / NRRL 328 / USDA 3528.7
MRISNLIVAASAASMVSALPSRQMKKRDSGFKWVGTSESGAEFGSALPGTLGTDYTWPETSKIQVLRNKGMNIFRIPFLMERLTPDGLTSSFASTYLSDLKSTVEFVTNSGAYAVLDPHNYGRFDGSIITSTSDFKTWWKNVATEFADNDKVIFDTNNEYHDMEQSLVLDLNQAAINGIRAAGATTQYIFVEGNAYTGAWDWTTYNDNLSGLTDSEDKIIYEMHQYLDSDSSGTSETCVSSTIGQERLEKATEWLKTNNKQGIVGEFAGGVNSVCEEAVEGMLAYMSENSDVWVGASWWSAGPWWGTYMYSLEPTDGTAYSTYLPILEKYFPSGDASASSSASVSVAAATSTASTTTAAFEQTTTPATQVEIASSSSSSSANAASQTTLSKVKSKSKSPCKLSSATSSAVAATTPVVVATTPAVAPTSSSVAFVTTSVYVPTTTAAVAPSQVNQYYQCGGINWTGPTVCASPYTCKVQNDYYYQCVAE

SEQ ID NO: 4679 - protein, 370 aa, Aspergillus niger; identical to SEQ ID NO: 4262
  strain ATCC 1015 / CBS 113.46 / FGSC A1144 / LSHB Ac4 / NCTC 3858a / NRRL 328 / USDA 3528.7

SEQ ID NO: 4680 - protein, 439 aa, Aspergillus niger
  strain ATCC 1015 / CBS 113.46 / FGSC A1144 / LSHB Ac4 / NCTC 3858a / NRRL 328 / USDA 3528.7
MYLLPLTLFLTAAFGVSIPRSPLIPGAQIVPASSTADLRAIGAQHHKYPDRETVTIRASRNALDDVSSDFLWGLKQANHGGRLLLKQGETYVIGKKLDLTFLDNIEVQLEGEIQFTNNITYWQANNFYYDFQKSITFWRWGGQDIKIFGSGVLNGNGQKWYDEFAGKQILDSDNTFYRPILFLTDNATRISVEGITQLNSPCWTNFFVRTNDVSFDNVYIHAFSTNASSDPANTDGMDSLDVDGVSFTNMRIDVGDDCFSPKPNTTNIFVQNMWCNNTHGVSMGSIGQYAGEMDIIENVYIENVTLLNGQNGARLKAWAGQDVGYGRINNVTYKNIQIQNTDAPIVLDQCYFDINATECAKYPSAVNITNILFENIWGSSSGKDGKIVADLVCSPDAVCTNITLSNVNLTSPKGTAEIVCDDIQGGIGVDCVSDESVTR

SEQ ID NO: 4681 - protein, 454 aa, Aspergillus niger
  strain ATCC 1015 / CBS 113.46 / FGSC A1144 / LSHB Ac4 / NCTC 3858a / NRRL 328 / USDA 3528.7
MSWSSPAAQYIYVLVIQLHLWFILKTAFSPSNQAMAPIALKILLFTSLIVPSISLSDQARNGHARTICEVKPGGSSEIDDVPAIVDALTTCGSGGRVIFSNNTYHINSVMNTIWLDDVEIDLQGTLLWSTNISYWLNHSLPVGYQNQSTAWILGGKDITFEGHGYGTFNGSGQTWYKYVGSTSNYPRRPNQLTVSGAMGAVFKGLRFVQSQMWTMSIIHTSNSWFDSIYVNNLYDDGDSARYKNITFTNWEVVNGDDSISTKANSTDITIANCTFTSGLGIAIGSIGQYNGAFETVERLKISNITYEKTTHAVYFKTWTGDQVGYPPNGGGGGLGYASDIVATNLKTNNLKGAPFTISQCTTFSGASGNCTNSKFQIRDLVFTDISGTTDSSDVASFQCSAVAPCEDITIENVSLRIAGNTTHAEEYLCGNVDGTVGFNCTGDVCVGSSATGGC

SEQ ID NO: 4682 - protein, 406 aa, Aspergillus niger
  strain ATCC 1015 / CBS 113.46 / FGSC A1144 / LSHB Ac4 / NCTC 3858a / NRRL 328 / USDA 3528.7
MTLYRNLLLLASLGLSYAAPSKVQRAPDSSLHARAVCTPTAGGDSSTDDVPAITEALSSCGNGGTIVFPEGSTYYLNSVLDLGNCSNCDIQVEGLLKFASDTDYWSGRTAMISVSDVDGLKLRSLTGSGVIDGNGQDAWDLFASDSSYSRPTLLYITGGSNLEISGLRQKNPPNVFNSVKGGATNVVFSNLKMDANSKSDNPPKNTDGFDIGESTYVTITEVTVVNDDDCVAFKPSSNYVTVDTISCTGSHGISVGSLGKSSDDSVKNIYVTGATMINSTKAAGIKTYPSGGDHGTSTVSNVTFTDFTVDNSDYAFQIQSCYGEDDDYCEENPGNAKLTDIVVSSFSGTTSDKYDPVVANIDCGADGTCDISISGFDVKAPSGKSEVLCANTPSDLGVTCTSGASG

SEQ ID NO: 4683 - protein, 271 aa, Aspergillus niger
  strain ATCC 1015 / CBS 113.46 / FGSC A1144 / LSHB Ac4 / NCTC 3858a / NRRL 328 / USDA 3528.7
MKLPYFLLGLAGLAAASPMGLAERQLSDGNELREGSCKPIIFIFARASTEPGLLGISTGPAVCNDLKMAKAGQVLCQGVGPAYTADLMSNALPDNTSPAAISESESLFKLAASKCPNSQILAGGYSQGTAVMDDSIKQLPDDVKDKIKGVVLFGYTRNAQEGGQIGNFPKDKVKIYCAMGDLVCDGTLIVTAAHFTYVMNTGEASQWLESKLSDTTTSSLTGSSSSDTSSSTSTGDSSSESSSAAGLGGLSGLTGLGSSTSGGFPSLASLF

SEQ ID NO: 4684 - protein, 631 aa, Aspergillus niger
  strain ATCC 1015 / CBS 113.46 / FGSC A1144 / LSHB Ac4 / NCTC 3858a / NRRL 328 / USDA 3528.7
SVRICVCGDEGTGKSSLITSLVKGVFVTNKIQPILPQITIPPTIGTPENVTTTTVVDTSALPQERNNLAREIRKSNVILLVYSDHYSYERVALFWLPYFRSLGVNVPVVLCANKSDLAADHTEAQVIEEEMLPLMAEFKEIDSCIRTSAREHRNVNEAFFLCQKAVTHPIAPLFDSKESSLKPAAIAALQRIFYLCDKDRDGYLSDKEIKDFQMRCFEKPLSEEDLVHIKETIQRTHPHSVTPSGIDCRGFLQLNKMYAEKGRHETVWIILRAFQYTDNLSLQENFLHPRFDVPPYASAELSPEGYRFFVNLFLLSDKDNDGGLNDAELASLFAPTPGLPASWADGSFPSSTVRNEAGHVTLQGWLAQWSMTTFTSPKTTLEYLAYLGFESSDRSNPSTTAALKVTRPRKRRKRPGRVGRNVVLGHVLGAAGSGKSALLDAFLSRGFSTTYRPTIQPRTAVNTVELPGGKQCYLILDELGELEPALLENQVKLLDQCDVIVYTYDSSDPDSFAYIPALRAKYPHLEELPSVFIALKADLDRTTQRAEYQPHEYTAMLNMPSPPLHVSATWSSIQEVFVHIAEAAMEPSTAFPRSEEDVEGKWMAWGIALGAVVCAGAAAVMIWRRVSGSGV

SEQ ID NO: 4685 - protein, 434 aa, Aspergillus niger
  strain ATCC 1015 / CBS 113.46 / FGSC A1144 / LSHB Ac4 / NCTC 3858a / NRRL 328 / USDA 3528.7
MKLPILVTLFITLPALCVSSKTPSPPTISAYPKSLGNFKPASGRQNSTSNVCEVKPNQTDAAPGILAAAHTCNNGGTVFLPPGDFVVATALDLTFLNNIDFAIWGNITFKEDLDLWTTQAFQYTFQTASLFWRFGGNNVNIYGDGKGVIDGAGQYWWSAMAEDSSVVRPCLLGTDGLHHATISGLKMLNSPNWFNLIANSTDILISNMTMLVKSEISDAPAKNTDGWDIYRSSNIVIQDSRIVNTDDCVSFKPNSTQIVIQNLECTGSHGISVGSLGQYQGETDIVEDLYIYNISMTDASDVARIKVWPGVPPDTSGSTSGGGLGRVRNVTYEYMQSENNDHVISVSQCYESKNQTMCDSYPSKLVIEDVLFKDFKGTTSKKYDPEIGELTCSSPDVCHNITVQDISVTPPSGNSPTFTCNNMGNSNLEDITCA

SEQ ID NO: 4686 - protein, 436 aa, Aspergillus niger
  strain ATCC 1015 / CBS 113.46 / FGSC A1144 / LSHB Ac4 / NCTC 3858a / NRRL 328 / USDA 3528.7
MLVTPLIALLPAIAAAQVSGTVGPRTSASAKAAEKVCNVLDYGASANSTNDIGPPLKEAFQDCQTGGLVYIPEGNYLLSSWVSLVYGSGWALQLDGIIYRDKNVTDGGNMIFIEHTNDIEIFSNNSAGAIQGYGYLFHEQDEYGPRILRLNNVTDFSVHDLILVDSPAYFLNLVESYNGEVYNMVIRGASMGGLDGIDISGANYWIHDVEVTNGDECVTVKSPSANVRVENVFCNHSGGCAMGSLGTDTNISNIEYENIYTYNSTQMYMIKSNGGNGTVTNCSFKNFIGYSNAYMLDLDTYWGDQSDGDGIKYENIGFENWKGTSSNGIQRSPIRILCPDENPCTNITLTAVELWTDECSSAYGEGECLRQQNGTLASYSFTTTITSVPVTAYSPTTTMPGLISTSMDTTTSIPIPTIPTSFFPGASAYSTLMANM

SEQ ID NO: 4687 - protein, 423 aa, Aspergillus niger
  strain ATCC 1015 / CBS 113.46 / FGSC A1144 / LSHB Ac4 / NCTC 3858a / NRRL 328 / USDA 3528.7
MQLRASVLLSFLGLASVGHAGNVENNHNVCTVRANGGHQDDVPNIMAAFKECGNGGTIIFPEDQSYWIATRLHPTLKDVAIEWRGKWTFSDNLTYWRNNSYPIAFQNHHAGFIISGDNITINGYGTGGIDGNGNTWYTAEKGDTQPGRPMPFVFWNVSEVIVDSFYVKDPPLWSVNIMNGTNMRFNNIYCNATAVDAPWGDNWVQNTDGFDTMDATNIQLTNFVYQGGDDCIAIKPRSYNIDIQNVTCRGGNGIAIGSLGQYLEDSSVANIRVDKVNIIRYNEDMHNSAYLKTWVGALVPQSSYESAGVPRGDGWGSIRNVLFSNFNVQGASAGPSISQDSGDNGSYAGTSKMSISNVAFVNFTGWVDTEKSVVSTVSCSEVHPCYNIDYDNVVLYPGKNATTAGTGSCKYTADGGVHGLSGC

SEQ ID NO: 4688 - protein, 437 aa, Aspergillus niger
  strain ATCC 1015 / CBS 113.46 / FGSC A1144 / LSHB Ac4 / NCTC 3858a / NRRL 328 / USDA 3528.7
MRASILPLTLFLATLAGAQLSGPVGPLVDYSTKARNQTCNIIDYGAVADGKTDISQALLDAWGNCSVGGLVYIPPGNYSLAEDIELKHGQSSAIQLDGVVMRGHRGSYQMILIRDCNDFEFFSGNSRGAIQGFGYEYLQNDTYGERLLRIQEVNNFSVHGFALIDSPSYYIVFDTVTSGEVYNILIRGVTSVGATDAIDVWGENMWFHDIEVSNGDECVTVKSPAHNYLIENIYCNLSGGTAIGSLGTGTNISDIHYRNLYMNQADACFLKSNNGDGIVKNIIWENVIVHGGPYPLAIDEAWGDDRGSVGVQVSNLTFRNWHGESVSASRPVIRLQCDSDVPCYDITIENVNLWANDSNYVVWQCENAYGDGACLSSAEGTKDLKTFTSKQTITATPSYAAPTMAADFTSNLPSTSPFTIPPMPTSFYPGATPISTL

SEQ ID NO: 4689 - protein, 300 aa, Aspergillus niger
  strain ATCC 1015 / CBS 113.46 / FGSC A1144 / LSHB Ac4 / NCTC 3858a / NRRL 328 / USDA 3528.7
MRYSLALGALCAAGALANNVDKRSYVTDWTIVTLTTTITEYPTPTVYENVAAQEASAASSSSAAAASTSSVVTPVVETTAAATTAAAATTAAAEEVATSWTSAWTSAWTSSWSSAAAPTTTLATSTSSSASSTATNAYQSAVLYNHNVHRSNHSASSLEWSSDLESSAYTLAAKCVYEHDTSIDGGGYGQNIGYGVESSEIGVMITNLMYNDEMGYYTDLYGEADPDMTYFDNWGHFSQIVWAATTHVGCATVTCDSLGNVDASEALPFTVCNYSPAGNYEGEYGTNVKRPLGQAVYVAS

SEQ ID NO: 4690 - protein, 628 aa, Aspergillus niger
  strain CBS 513.88 / FGSC A1513
MVAFSALSGVSAVSLLLSLVQNAHGISLKVSTQGGNSSSPILYGFMFEDINHSGDGGIYGQMLQNPGLQGTAPNLTAWAAVGDATIAIDGDSPLTSAIPSTIKLNIADDATGAVGLTNEGYWGIPVDGSEFHSSFWIKGDYSGDITVRLVGNYTGTEYGSTTITHTSTADNFTQASVKFPTTKAPDGNVLYELTVDGSVAAGSSLNFGYLTLFGETYKSRENGLKPQLANVLDDMKGSFLRFPGGNNLEGNSAENRWKWNETIGDLWDRPGREGTWTYYNTDGLGLHEYFYWCEDLGLVPVLGVWDGFALESGGNTPLTGDALTPYIDDVLNELEYILGDTSTTYGAWRAANGQEEPWNLTMVEIGNEDMLGGGCESYAERFTAFYDAIHAAYPDLILIASTSEADCLPESMPEGSWVDYHDYSTPDGLVGQFNYFDNLNRSVPYFIGEYSRWEIDWPNMKGSVAEAVFMIGFERNSDVVKMAAYAPLLQLINSTQWTPDLIGYTQSPGDIFLSTSYYVQEMFSRNRGDTIKEVTSDSDFGPLYWVASSAGDSYYMKLANYGSETQDLTVSIPGTSTGKLTVLADSDPDAYNSDTQTLVTPSESTVQASNGTFTFSLPAWAVAVLAAN

SEQ ID NO: 4691 - protein, 225 aa, Aspergillus niger; identical to SEQ ID NO: 4620
  strain CBS 513.88 / FGSC A1513

SEQ ID NO: 4692 - protein, 861 aa, Aspergillus niger
  strain CBS 513.88 / FGSC A1513
MRRTFAALVAGYLLDSVHAAASQAYTWKNVVTGGGGGFTPGIVFNPSAKGVAYARTDIGGAYRLNSDDTWTPLMDWANNSNWHDWGIDAIATDPVDTDRVYVAVGMYTNDWDPNDGSILRSTDQGDTWEETKLPFKVGGNMPGRGVGERLAVDPNDNSILYFGARSGNGLWKSTDYGETWSNVTAFKWTGTYFQDSSSTYTSDPVGIAWVTFDSTSGSSGSPTPRIFVGVVDTGESVFVSEDAGETWTWVSGEPMYGFLPHKGILSPSEHTLYISYSNGAGPYDGTNGTVHKYNITSGVWTDISPTSMTDTYYGYGGLAVDLQVPGTVMVAALNCWWPDELIWRSTDSGATWSPIWAWNGYPSINYYYSYDISNAPWLQDDTSTDEFPVRVGWMVEALAIDPFDSDHWLYGTGETIYGGHDLQNWDSEHNVTIESLAVGIEEMAVLGLITPPGGPALLSAVGDDGGFYHTSLTTAPSQYYHTPTYSSTNGIDYAGNKPANIVRSGSSDSDPTLALSSSFGESWYADYAASSSTATGQVALSADADTILLMNSDGAYRSANSATLSAVSSLPSGAVIASDKANNTYFYGASGSSFYLSSDTAATFTVTTTLGSSTTANAIRAHPSLAGDVWVSTDTGLFHSTNYGKSFTHIGSGCTEGWSFGFGKPSSDGDYPVLFGFFTVDGVTGLFKTEDQGVNWQIISDAEHGFGSASANVVNGDLQNYGRVFVGTNGRGIFYGDPSGTLPSATATASSASSTAVKSSTSASTSKVGSSTTVSSSTATTITTSSIKSTTLTTTTKSSSSTTSTSSTATGTASAYGQCGGSGFTGPTQCPSGWTCTYENEYYSQWADICRSGGMSESRAV

SEQ ID NO: 4693 - protein, 631 aa, Aspergillus niger
  strain CBS 513.88 / FGSC A1513
MHGLRLVCSIGTLPLVILAYPAASLHTTSAAVDLDSLRLTSNSEYVNSVHVDTNRSVAVSAEEHYTDTAARLVQNIVPGASFRLIDDHFVGDNGVAHVYFRQTLHGIDIDNADFNVNIGKDGLVLSFGHSFFTGALPSSHLDNTNVLSPEAALRGARDAIQLPLTIDNVSTEAAEGRNEYIFREAVGAVSDPKAKLVYLVKPEGTLALTWRIETDMYEHWLLTYIDAETTTVHGVVDYVADATYQVYPWGTNDPAEGHRTIVTDPWDLSASAYTWISDGRDNYTTTRGNNAIAHWNPTGGGSYLYNLRPSDPNLNFQWPYSPNMSPPRSYINASIVQLFYTANAYHDLLYTLGFTESAGNFQWNNSAHGGRDKDYVILNAQDGSGFSNANFATPPDGIPGRMRMYIWIESTPSRDGSFDAGIVIHEYTHGVSNRLTGGSHNAGCLSALESGGMGEGWGDFMATAIRIKPNDTRTTSYTMGAWADNDKCGVRDYPYSTSFTENPLNYTSVNTMNGVHAIGTVWATMLYEVLWNLIDKYGKNDGSRPVFRNGVPTDGKYLMMKLVVDGMALQPCNPNFVQARDAILDADIVLTGGKNRCEIWRGFAKRGLGQGAAHSSLNWMRRGSTLLPTGC

SEQ ID NO: 4694 - protein, 241 aa, Aspergillus niger
  strain CBS 513.88 / FGSC A1513
MKVLALSALLSLASAASISRRSDFCGQWDTATAGDFILYNDLWGEDNASSGSQCTGVDSASGNEIAWHTSWSWEGGSSDVKSYANAALQFTGTQLSSISSIPSTWKWTYSGSDIVADVAYDMFLGSTADASSDEYEIMVWLAALGGAGPISSTGSTIATPTINGVTWDLYTGPNGDTTVYSFVAQSTTEDFSGDLNDFFTYLVDNEGVSDSLYLTTLEAGTEPFTGSDAELKVSEYSVSIE

SEQ ID NO: 4695 - protein, 322 aa, Aspergillus niger
  strain CBS 513.88 / FGSC A1513
MFARQAFRCAQPLKQGFRKYSTEAPKGKSSLAPIYAAVGITGVGVGLYRYNSATAEAPAAVDRPKVFKGGDQGWFDLKLSEIEVLNHNTKRLRFEFEDKEALSGLQVASALLTKFKPADAKAVIRPYTPTSDEETPGYIDLVVKVYPNGPMSEHLHSMNVGQRLDFKGPIVKYPWETNKHNHICLIAGGTGITPMYQLAREIFKNPEDQTKVTLVFGNVKEEDILLKKEFEELENTYPRRFRAFYVLDNPPKEWTGGKGYISKELLKTVLPEPKEENIKIFVCGPPGMYKAISGTKNSPTDQGELSGILKELGYSKEQVFKF

SEQ ID NO: 4696 - protein, 149 aa, Aspergillus niger
  strain CBS 513.88 / FGSC A1513
  MOD_RES (139)..(139): Any amino acid
LISNVQNGPYGENLAFGYPNVSSAVAAWGDEVQKYNFQEPTGFTEETGHFTQLVWRETREVGCAAIDCGGINGTERPQGWYVVCEYSPRGNIIGGNKKLGDKEFFKINVQPSSTYSGPYNTGSAGNGAARVECIMGLCXGNWDMDSGIN

SEQ ID NO: 4697 - protein, 804 aa, Aspergillus niger; identical to SEQ ID NO: 4608
  strain CBS 513.88 / FGSC A1513

SEQ ID NO: 4698 - protein, 368 aa, Aspergillus niger; identical to SEQ ID NO: 4614
  strain CBS 513.88 / FGSC A1513

SEQ ID NO: 4699 - protein, 410 aa, Aspergillus niger
  strain CBS 513.88 / FGSC A1513
MKTLSLAAVLLVQAWTANSSPRAKRSSGFQWFGSNESGAEFGSGNIPGTLGTDYIWPDATAIATLHSAGMNIFRVPFLMERLVPDELTGAADATYMADLKATVQTITDLGAYAVVDPHNFGRYYGNIITSTSDFAAFWTTVASEFTDNDLVIFDTNNEFHDEDQTLVLDLNQAAITAIRATAATTQYIFVEGNSYTGAWTWTTTNTNLVNLTDPNDHLIYEMHQYLDSDGSGTSSTCVSSTIGAERIADATTWLKENGKQAVLGEFAGGANSVCEEAVTGMLDAMVDASDVWLGGMWWSAGPWWGDYIFSLEPDDGIAYEYYLGVLEGYTPGSSSGSSGGSTTSAVASASSTSSAGSTTSKVTTTTAATATSTAVAAHYAQCGGEGWTGATTCADGYTCTVENEWYSQCL

SEQ ID NO: 4700 - protein, 435 aa, Aspergillus niger
  strain CBS 513.88 / FGSC A1513
MSIEVDWGAATSGPDGEALAERIRSFIHDKFQQVALPRFIRSVQVHSFDFGTIPPELEIKDLCEPFADFYEEDEDDEASDVSEGLVSRHGSPWHGTHPELNESSFRDDNAINHSLRDPFTEGFQPSALRSPIALSDHLNPHFRSGTPGIPGGTSTLGYHLMSLGGLSGTQTPLAAVAGGSPFAGGWNDSGMMGPGNRGRPPPPIFTAHQSRPEADIDSSNPTSRPSTSSTLPSHPSGSNKNNGDGAGGPDHGSHPEEHGHLDDPTSEEPLRFPRMRERRPEDFQVLCHAKYAGDVRLSLTAEILLDYPMPSFVGLPLKLNVTGITFDGVAVVAYIRKRVHFCFLSSEDADALIGSDQPDVGAQTEYSRSGGDATVSAKRQGGLLQEIRVESEIGRKEDGKQVLKNVGKVERFVLAQVRRIFEEELVYPSFWTFLV

SEQ ID NO: 4701 - protein, 438 aa, Aspergillus niger
  strain CBS 513.88 / FGSC A1513
MRMPSAISIGVIAGLSVAASAVPSLQKNGTTCTVIPLGNGQDDVPNILSAVDECGQTSGGRVVLPAPYTYRINQRMTTHLTDSRLEIGGTLLFSDDIDYWVNNSYRVDFQNQSSAWRITGHDYVVDGGPRQGGVDGNGQLWYTWAKGGSNVFGRPMPVHVFESTRATLRNLAIRQPQFWAVLVDSSSHINLDNFYVNATNHDSSVSPEGEWVQNTDGIDTYRSDHITVTNWVYQGGDDAVAFKGNSTNIHVENVTVYGGPGIAFGSLGQYPDRTDIVENVTVRNVRVQPSFQRAMNSGVYFKSWIGVNYGVPPNGGGGGHGYVRNVSVENLRLKDVQLPVYIDTCLSYLFSENITQYCDTSTYEFEDLHFRNISGNGLATVTDYPGKNISFAVALLCSEKAPCTDLTFQDISITLPGNYTGKHVLCENAEAEGLPCNS

SEQ ID NO: 4702 - protein, 378 aa, Aspergillus niger
  strain CBS 513.88 / FGSC A1513
MVTSSSVIVLTLWAALVSASPVADPLVTPAPKLEDLEKRATSCTFSGSEGASSASKSKTSCSTIVLSDVAVPSGTTLDLTDLNDGTHVIFEGETTFGYEEWSGPLVSVSGTDITVTGADGAYLNGDGSRWWDGEGSNGGKTKPKFFYAHDLTSSTISGIYIQNSPVQVFSIDGSTYLTMEDITIDNTDGDDGEAANTDGFDIGDSTYITITGANVYNQDDCVAVNSGENIYFSGGVCSGGHGLSIGSVGGRSDNTVKNVTFYDSEIKSSQNGVRIKTIYGDTGSVSEVTYKEITLSDITDYGIVVEQNYDDTSKSPTDGITIEDFVLDNVQGSVESSGTNIYIVCGSDSCTDWTWTDVDVSGGKTSSDCENVPDDISC

SEQ ID NO: 4703 - protein, 289 aa, Aspergillus niger
  strain CBS 513.88 / FGSC A1513
MKSFIALSLLATALGAPTATHQARQFDLSSLTSGLSALTSGSAASSGSTGSTGSETTTGSSGLSALASLFPSSSTSSTTGSTSGSGSSSSSDGLSSLMSMFSSSGSGSSTENGVTQHSGSCKKLTFIFARGTTEIGNMGTVVGPEVASELATLTGNQVTVQGVNYPADWEGNVSLGSSGGPTMASYVKEALQQCPNTKVVLGGYSQGSMVVHYAANQLSADQLSGAVLFGDPLKMEGVGKLSSSKVKEFCASGDPVCENGMNVMAHLTYGSDAKEAAQFLVQAAGVSSS

SEQ ID NO: 4704 - protein, 305 aa, Aspergillus niger
  strain CBS 513.88 / FGSC A1513
MSAFSPENITGAFIPSALFVAGTFFFKQELTPFAVALAAVLVGWKVFSNKPRKVLNPGDFQHFTLKEKNDISHNVTVYRFALPRPTDILGLPIGQHISLAATIGGKEVVRSYTPISSDNEAGYFDLLVKAYPQGNISKYLTTLEVGQTMKVRGPKGAMVYTPNMCRHIGMIAGGTGITPMYQIIKAIIRNRPRNGGNDTTQVDLIFANVNPDDILMKDELEQLAKEDDGFRIYYVLNNPPEGWTGGVGFVTPDMIKERLPAPSSDIKVLLCGPPPMVSAMKKATESLGYTKARPVSKLEDQVFCF

SEQ ID NO: 4705 - protein, 324 aa, Aspergillus niger
  strain CBS 513.88 / FGSC A1513
MAPSFVTIDTTPDFDMAPAPSFQPMSTGSPSKRTLLLAPPSIATQEEKLRDLFTAFDRSTTDLQMLDRISAGFVSLPANTYDHILVLTDTDGTRRSEALHLLTRDVYTALVPCMKAGAKLQTQDNFFGEAEEREAVLAGLIKTDAGFEKMDQPKSFAIPLRRNGKKKDAAKTETFAPAPAPAPPVQPVTVGMINNDDDYENDDDLIDEDTLLSDEDLKRPIQPPECQPKPGRRRRACKDCTCGLAARLEAEEQAEREKADKALNVMKLETEDLNELDFTVQGKTGSCGNCALGDAFRCAGCPFIGLPAFKPGQEVQILENVAQL

SEQ ID NO: 4706 - protein, 440 aa, Aspergillus niger; identical to SEQ ID NO: 4633
  strain CBS 513.88 / FGSC A1513

SEQ ID NO: 4707 - protein, 228 aa, Aspergillus niger
  strain CBS 513.88 / FGSC A1513
MIYYIHLFAITAYLFLPASAQDNSSGSPAGPIGDIVCATAVQEVANMPYPGDCSKWIKCDTEYAGTATVYTCDEGLWFSFDVQTCVWPDQSGCVDGMGIRCSSPSLLLYGIQGIWLFSTIDSVAQALSASKDSNSDEHKSNTQPYTEYYSPTLTTLLLYYSSHSYNSSYHLMSLLRIDYPCKITGSLSTTVLNSVKVLISLTFYTSHTSISKFVSNISKRHDKMLLSL

SEQ ID NO: 4708 - protein, 379 aa, Aspergillus niger
  strain CBS 513.88 / FGSC A1513
MHYKLLFAAAAASLASAVSAAGVVGAAEGFAHGVTGGGSASPVYPTTTDELVSYLGDNEPRVIILDRTFDFTGTEGTETTTGCAPWGTASQCQVAINLHSWCDNYQASAPKVSVTYDKAGILPITVNSNKSIVGQGTKGVIKGKGLRVVSGAKNVIIQNIAVTDINPKYVWGGDAITVDDSDLVWIDHVTTARIGRQHIVLGTSADNRVTISYSLIDGRSDYSATCNGHHYWGVYLDGSNDMVTLKGNYFYNLSGRMPKVQGNTLLHAVNNLFHNFDGHAFEIGTGGYVLAEGNVFQDVNTVVETPISGQLFSSPDANTNQQCASVFGRSCQLNAFGNSGSMSGSDTSIISKFAGKTIAAAHPPGNIAQWTMKNAGQGK

SEQ ID NO: 4709 - protein, 429 aa, Aspergillus niger
  strain CBS 513.88 / FGSC A1513
MAPIALKILLFTSLIVPSISLSDQARNGHARTICEVKPGGSSEIDDVPAIVDALTTCGSGGRVIFSNNTYHINSVMNTTWLDDVEIDLQGTLLWSTNISYWLNHSLPVGYQNQSTAWILGGKDIVFEGHGYGTFNGSGQTWYRYVGSTSNYPRRPNQLTVSGAMGAVFKGLRFVQSQMWTMSIIHTSNSWFDSIYVNNLYDDGGSAQNTDGANTIYSKNITLTNWEVVNGDDSISTKANSTDITIANCTFTSGLGIAIGSIGQYNGAFETVERLKISNITYEKTTHAVYFKTWTGDQVGYPPNGGGGGLGYASDIVATNLKTNNLKGAPFTISQCTTFSGASGNCTNSKFQIRDLVFTDISGTTDSSDVASFQCSAVAPCEDITIENVSLRIAGNTTHAEEYLCGNVDGTVGFNCTGDVCVGSSATGGC

SEQ ID NO: 4710 - protein, 438 aa, Aspergillus niger; identical to SEQ ID NO: 4634
  strain CBS 513.88 / FGSC A1513

SEQ ID NO: 4711 - protein, 563 aa, Aspergillus niger
  strain CBS 513.88 / FGSC A1513
MAFNFNWSPLMADASFYTRAQELLTAALNKSPKPPIIVDDIHVTELNLGSIPPELEILEIGDLAEDRFRGIFKMSYTGDAFLTLKTRVQANPLNTYLLTRPSFATPLPVAAATPLTIPLQITLSDFKLSGFVILVFSKQKGITVVFRNDPLESLKVSSTFDSIPFVRDFLQREIEGQLRVLFMDELPAIIHRLSLRLWVPEYRAGEEMANRATNTAGEGPGQDPLASPPQDPVDAQGNALDESEIASLSLDSSVETHSLFSQKNLLRLAALTDSQRTLSLFTPSIQEVVYRAWTSPSDAGEVSGGVMSPLSPVLSRTQSQVGGMSSFHDTASMVSSQTRSSTNTHTFSSYGLSLGAGRHSKSNARRRKKRVVDLRRPKTTEDAVSVSGESTYTETTSAPSICSAPLPVVSEQTDDPVTPPLSPDSELHLPTVPERHRLSISRQMPRRDIATEMLRETGESSAQPVNHSAVDVNATPRVAVHPYIAAQHESEKEEASAPRQLPSKALPLSDAKPTSSIVDQALVERLAGEIARRMREEKLTPGNSCSSFWDRLSHDDAPPAYGQ

SEQ ID NO: 4712 - protein, 327 aa, Aspergillus niger
  strain CBS 513.88 / FGSC A1513
MHTPYLLGALAALAATAVGAPAEHIKKRESRTSAPSGCLTVGSDGTYSTIGDALDALGSSTSSACIYVASGTYEEQLTIDYAGNLTLYGETTDTSTYKDNVVTITHTISSSDAGSLDKSATVNVVSDGFSMYNINVENGYGEGAQAVALVGNADQLGFYGCQFSGYQDTLYVKAGTQYYSNCMIEGAVDYIFGDASVWFGECDIVSNGAGAITASSRETSSDSGWYAIDNCNIKAASGVSLTEEVYLGRPWRVLARVIYQNSVLSDIINPKGWTTMADGATPLYYEYNNSGAGSDTSDREYETSISAAVDKTTVLGETWGDWIDRSY

SEQ ID NO: 4713 - protein, 263 aa, Aspergillus niger
  strain CBS 513.88 / FGSC A1513
MMRLARTVYLVLSLLSAALADIEFIDPAAGTVIRAGDEFTAHWRDSGTLPRLASLVQYDLYLCAGGDTVGSHEDIALLAKNALFAKGNSVTFKIDSEVGGNDANAYFLRIAASGPDASVVNYSDRFTLTNMTGSFSPTVINGIPSAMYPTDSFPPAHMDESHEELRKRQVAGPFTIPYQLQTGPTRYAPMAKKPGSTIPVGTPTPQYPTSAYSVATTYLPQATVQMTLSASETYSVISIENTASPAPHAGDTKMKRFLERWKD

SEQ ID NO: 4714 - protein, 383 aa, Aspergillus niger
  strain CBS 513.88 / FGSC A1513
MKLSNALLTLASLALANVSTALPKASPAPSTSSSAASTSFASTSGLQFTIDGETGYFAGTNSYWIGFLTDNADVDLVMGHLKSSGLKILRVWGFNDVTSQPSSGTVWYQLHQDGKSTINTGADGLQRLDYVVSSAEQHDIKLIINFVNYWTDYGGMSAYVSAYGGSGETDFYTSDTMQSAYQTYIKTVVERYSNSSAVFAWELANEPRCPSCDTSVLYNWIEKTSKFIKGLDADRMVCIGDEGFGLNIDSDGSYPYQFSEGLNFTMNLGIDTIDFGTLHLYPDSWGTSDDWGNGWITAHGAACKAAGKPCLLEEYGVTSNHCSVEGSWQKTALSTTGVGADLFWQYGDDLSTGKSPDDGNTIYYGTSDYQCLVTDHVAAIGSA

SEQ ID NO: 4715 - protein, 384 aa, Aspergillus niger; identical to SEQ ID NO: 4666
  strain CBS 513.88 / FGSC A1513

SEQ ID NO: 4716 - protein, 537 aa, Aspergillus niger
  strain CBS 513.88 / FGSC A1513
MNQGTKSILLAATLAAIPWQVYGSIEQSSLLPIPPMGFNNWARFMCDLNETLFTETADAMAANGLRDAGYNRINLDDCWMAYQRSDNGSLQWNTTKFPHGLPWLAQYVKAKGFHFGIYEDSGNMTCGGYPGSYNHEEQDANTFALWGIDYLKLDGCNVYATQGRTLEEEYKQRYGHWHQVLSKMQHPLIFSESAPAYFAGTDNNTDWYTVMDWVPIYGELARHSTDILVYSGAGSAWDSIMNNYNYNTLLARYQRPGYFNDPDFLIPDHPGLTADEKRSHFALWASFSAPLIISAYIPALSKDEIAFLTNEALIAVNQDPLAQQATFASRDNTLDILTRNLANGDRLLTVLNKGNTTVTRDIPVQWLGLTETDCTYTAEDLWDGKTQKISDHIKIELASHATAVFRLGLPQGCSSVVPTGLVFNTASGNCLTAASNSSVAFQSCNGETSQIWQVTLSGVIRPVSQTTQCLAADGNSVKLQACDSTDSDGQNWTYAVTGNLKNAKTDGCLTEGSVQMKSCLYERDGQVFGLPSGVQLS

SEQ ID NO: 4717 - protein, 994 aa, Aspergillus niger
  strain CBS 513.88 / FGSC A1513
MKLQSILSCWAILVAQIWATTDGLTDLVAWDPYSLTVNGNRLFVYSGEFHYPRLPVPEMWLDVFQKMRAHGFNAVSLYFFWDYHSPINGTYDFETGAHNIQRLFDYAQEAGIYIIARAGPYCNAEFNGGGLALYLSDGSGGELRTSDATYHQAWTPWIERIGKIIADNSITNGGPVILNQIENELQETTHSASNTLVEYMEQIEEAFRAAGVDVPFTSNEKGQRSRSWSTDYEDVGGAVNVYGLDSYPGGLSCTNPSTGFSVLRNYYQWFQNTSYTQPEYLPEFEGGWFSAWGADSFYDQCTSELSPQFADVYYKNNIGQRVTLQNLYMLYGGTNWGHLAAPVVYTSYDYSAPLRETRQIRDKLSQTKLVGLFTRVSSGLLGVEMEGNGTSYTSTTSAYTWVLRNPNTTAGFYVVQQDTTSSQTDITFSLNVNTSAGAFTLPNINLQGRQSKVISTDYPLGHSTLLYVSTDIATYGTFGDTDVVVLYARSGQVVSFAFKNTTKLTFEEYGDSVNLTSSSGNRTITSYTYTQGSGTSVVKFSNGAIFYLVETETAFRFWAPPTTTDPYVTAEQQIFVLGPYLVRNVSISGSVVDLVGDNDNATTVEVFAGSPAKAVKWNGKEITVTKTDYGSLVGSIGGADSSSITIPSLTGWKVRDSLPEIQSSYDDSKWTVCNKTTTLSPVDPLSLPVLFASDYGYYTGIKIYRGRFDGTNVTGANLTAQGGLAFGWNVWLNGDLVASLPGDADETSSNAAIDFSNHTLKQTDNLLTVVIDYTGHDETSTGDGVENPRGLLGATLNGGSFTSWKIQGNAGGAAGAYELDPVRAPMNEGGLLAERQGWHLPGYKAKSSDGWTDGSPLDGLNKSGVAFYLTTFTLDLPKKYDVPLGIQFTSPSTVDPVRIQLFINGYQYGKYVPYLGPQTTFPIPPGIINNRDKNTIGLSLWAQTDAGAKLENIELISYGAYESGFDAGNGTGFDLNGAKLGYQPEWTEARAKYT

SEQ ID NO: 4718 - protein, 459 aa, Aspergillus niger
  strain CBS 513.88 / FGSC A1513
MRASILPLTLFLATLAGAQLSGPVGPLVDYSTKARNQTCNIIDYGAVADGKTDISQALLDAWGNCSVGGLVYIPPGNYSLAEDIELKHGQSSAIQLDGVVMRGHRGSYQMILIRDCNDFEFFSGNSRGAIQGFGYEYLQNDTYGERLLRIQEVNNFSVHGFALIDSPSYYIVFDTVTSGEVYNILIRGVTSVGATDAIDVWGENMWFHDIEVSNGDECVTVKSPAHNYLIENIYCNLSGGTAIGSLGTGTNISDIHYRNLYMNQADACFLKSNNGDGIVKNIIWENVIVHGGPYPLAIDEAWGDDRGSVGVQVSNLTFRNWHGESVSASRPVIRLQCDSDVPCYDITIENVNLWANDSNYVVWQCENAYGDGACLSSAEGTKDLETFTSKQTITATPSYAAPTMAADFTFNLPSTSPFTIPPMPTSFYPGATPISTLLHLHGAGGLPSASPISHHRRHQ

SEQ ID NO: 4719 - protein, 474 aa, Aspergillus niger
  strain CBS 513.88 / FGSC A1513
MRSILFILFSVFAGLAAGQLIGPVGPTTQLEDKDIECNILDYGGVADNETDVATSIETTFTECVLNNPKSRLVIPEGDYLIKRSVVLSNGTNWAFQLDGLITAAYGGNWTVDPVDFEFYSSNGLGAFQGQGYIYRNLANTDRPRLVRLISPTNASVHDLILVDSPKFHIVFDFAVNLEAYHLTIRGANLGSYDGIDAIGTNYYIHDNEAITNRDECVSVKSPSHHALVENLVCNQAGSGVSIGSLNVSAEISNIEARNISIIQGNNIAFIKTYPGGSGYVKDVTFENFRSLNSLYGLDINQYWQNTWEPDTGSVTLSNLVFKNFSGSVADGALRPPLYLFASDLTFATNVTVEEFSVWTETGTTVVNKISNIFGTGDDSYGENDGIESLQSGESPYTYTSTYTITASPTNWQAPSTPTWALPSTGYGSKFNENCSGYFYIANLSTAASPIPVYTPAPLWRPGGIDYNLHYWGSF

SEQ ID NO: 4720 - protein, 331 aa, Aspergillus niger; identical to SEQ ID NO: 4612
  strain CBS 513.88 / FGSC A1513

SEQ ID NO: 4721 - protein, 827 aa, Aspergillus niger
  strain CBS 513.88 / FGSC A1513
MDTRQAKRKRQNSSSSGQKPQEPQEPPTPVSIRRTRRTEYYITSATSCETPHQSKKVRFSDPGPGRQHGSAHSTGLTPAMLRSSFEERAEDDPLIRSPSRGQRRRSTPLPRSRRSMDAPDAASTAFSEHVVQFTPLRQLLDARTKRRIRRIGLSDEINHLEREKRESAQYEKTLQSLLRERDSLKNELDSVKRNQDVSKSLATSEETTWLSPQSMIEQVLSENVRLREQLSFPSPGATTDHDTISNSEGETMVINESAWDCDTMLISNSPDIRALDARLSVPDNISLLSQGHANTDASTQASIPDHRQEAEIIALSADLAAARKEKRDLFDACRARVASFGGTAIEGLLRQSSPPPDFLDQVLPTLTQTLRRASDAAQALDNVKEELSGLGFPGNNAEEIISTMRDHFRAARLQLERAVPGETANASLSDGKATLGALVKRVEVLVKSLGDEQERLQGSVGRENAIRGQFDTLLARYEGASKKIQDLEESIASSAGDMLHTRMRMQELEREGKEQAVSIQRLNAALDKYHEEVKGLEALVTELEDDKAKNNESHKQEVDELQQKLEEQARSLRTTESTVVERETRIRELEEDLQQNRTRVCDLATKIESLEAERQQTIQSLEQEAKEEQQRLEQEVGSMNVLVSELNTSLAEAKSDIDRLRRSNTGLEEQLRQEVEARDSLLDKWAAEQARSFAFMKETVNSERRKARVRTANWELRSDEIQSSDGLNIGSEPITPVSMTRFVDVEAGRGKHLLVSQRVTQLEGVPEFIRSTSINTNAASTYGTTTPGSVAFDLELSQQEALTDTPGGADKASSHYDTSSRRKTKFS

SEQ ID NO: 4722 - protein, 452 aa, Aspergillus niger
  strain CBS 513.88 / FGSC A1513
MHQRALLFSALLTAVRAQQAGTLTEEVHPSLTWQKCTSEGSCTEQSGSVVIDSNWRWTHSVNDSTNCYTGNTWDATLCPDDETCATNCALDGADYESTYGVTTDGDSLTLKFVTGSNVGSRLYLMDTSDEGYQTFNLLDAEFTFDVDVSNLPCGLNGALYFTAMDADGGASKYPANKAGAKYGTGYCDSQCPRDLKFIDGQANVDGWEPSSNNDNTGIGNHGSCCPEMDIWEANKISTALTPHPCDSSEQTMCEGNDCGGTYSDDRYGGTCDPDGCDFNPYRMGNDSFYGPGKTIDTGSKMTVVTQFITDGSGSLSEIKRYYVQNGNVIANADSNISGVTGNSITTDFCTAQKKAFGDDDIFAEHNGLAGISDAMSSMVLILSLWDDYYASMEWLDSDYPENATATDPGVARGTCDSESGVPATVEGAHPDSSVTFSNIKFGPINSTFSASA

SEQ ID NO: 4723 - protein, 754 aa, Aspergillus niger
  strain CBS 513.88 / FGSC A1513
MKVLSFIVAAALLGLTGASSNSSPGLLKSDGVVLGDWESAYQKASSFVAGLTTDQKLALITGSSVNSTNGSFSGLTFLDGDMGLQNFFYVSAFSLSSALAMTWDRDAIYAQAKAVGSEFYNKGIQVVAGPTSQPLGRTPWGGRIVEGFGPDPYLNGLASGLTAKGYIDAGVIPGAKHFLLYEQETNRTGGGGGGGGDSGSAPYSSNADDKTLHETYLWPFYDAVKHGLGAVMCAMTKVNGTLSCQNSDLLMKHLKTELGFPGLVWPDTNGQSSALESAVNGEDYGSSSIWSTSTMETLLSNGSLSEARLDDMAVRNLMGYYYVNLDNGLQPEEQSEDAYVDVRGNHSKLIRENGAKSMALLKNKNALPLRKPRVMSVFGAHAGPVLGGPNTAMDIEGSGPTYQGHLATGTGSAQASLPYLVPPYVALTNRIIEDGTMMRWVLNDTYSSSSTSGLITEGTDSTAVDPSFADYATNSDACLVFLNALSGEGADRTELYNDDQDTMVNTVADNCNNTIVIINTVGPRLMDQWIEHDNVTAVLYGSLLGQESGNSIVDILYGDVNPSGRLIHTIAKNESDYNVKICYTAQCNFTEGVYLDYRYFDAHNVTPRYPFGHGLSYTTFSYSDLNIEKPSTLSKYPTGEKAVGGNSDLWDIVGNVSVKVANTGSLDGAEVPQLYLGFPTAAQQPVRQLRGFERVEIASGKQSQVTFQLRRRDISYWDVPAQQWLVASGDYKVYVGASSRDLKLNGTFTVQTSS

SEQ ID NO: 4724 - protein, 258 aa, Aspergillus niger
  strain CBS 513.88 / FGSC A1513
MAPITDEVVNGLKDTIGKLEARVEELEGRLSNQVKPKSVAEQMRIILMGPPGAGKGTQAPRLKEKYCVCHLATGDMLRSQVAKKTALGKEAKKIMDQGGLVSDEIMVNMIQSELDNNAECKNGFILDGFPRTVAQAERLDDMLNARQQKLQHAVELQIDDALLVARITGRLVHPASGRSYHKIFNPPKEEMKDDVTGEPLIQRSDDNADTLKKRLGTYHAQTAPVVEYYKKTGIWRGIDASQEPGQVWKSLLGVFRQN

SEQ ID NO: 4725 - protein, 505 aa, Aspergillus niger
  strain CBS 513.88 / FGSC A1513
MTTFTKLSDQDAPSISIHPARRLSKINPNIYAGFTEHMGRCIYGGIYDPGNSLSDENGFRKDVLEALKELNIPVVRYPGGNFMATYHWIDGVGPKEKRPARPELAWLGTETNQFGTDEFLKWCEVLGTEPYFCLNFGTGTLDEALAWVEYCNGTKDTYYANLRRKNGREEPYNVKYWALGNETWGPWQVEQMTKEAYAHKAYQWAKALKLLDPSLILILCGQDGTASWDYYTLKQCLLPAHSPLSTSTVPLIDMHSIHLYTSSPSHLPNVTAPLAAERAIEITSSLIDLARIENGVPPDQHRPTICFDEWNVWDPIRAEGSKGAEESYTLSDALAVAVFLNVFVRKSKDLGMACIAQSVNVISPLMTSKDGITKQTTYWPLYLFSKYMRGWTISVHLSCASYEGETSPKWVRGVKDTPWLDVSATLGEDGYVNVAVVNIHEEKDIRSSIDGPSGTVSVFTVTGERVQACNMNGKEEVAVTESTWEAREQFVFPKHSLTLLRWKLA

SEQ ID NO: 4726 - protein, 692 aa, Aspergillus niger
  strain CBS 513.88 / FGSC A1513
MFRVGSWLYGKKPASTQSLDSLSELRDLEDAMRAATLILNDDVDGAEDGLSEGTSSFHNLGRGVVAFIRATLGFEQEIMRQASERLNAAETSAANDQHRAQHNSHAPNTYHSQIYAPGTEFALCQAMAQLMSAVVGVLNESLTESIKGFYRLRKAYITLDAILKMEQKFIMQARNSGNSTSTESLPRGAGQGAGSKSVPASPVEPIDLKKELSDLSISADSEASASGPSDMLSHDPDSDIFKNQIDVFVHSGANFCFGILLLLISMVPPAFSKLLGIIGFHGDKERGLRMLWQASKFHNLIGALAAFSILGYSNGFVRYCDIMPDPVPGDDVQGYPQERLEALLALMRKRFPKSQLWLLEESRMNGANKKLDVALELLCGEDRSPLKQVEALRVFERSLNAMYLHRYELCAESFLECVELNSWSRSLYYYIAGSAHLSLYRNIAGTDATAAAKHAEKAVEYFRKAPPLAGKKKFMARQLPFDVFVSRKIAKWEARAKEWKVPLVDAVGVDPIEEMIFFWNGHSRMTQEQLEESMTKLAWSESEANKTWSREGPEEKAILQLLRAAVLRAMRRHDEAKEMIRTSIFSQDKSQFTGHLKDDWIYPVAHFEMAANLWMERPTYSAIHGGPASSSEKPSTDSDMQLERRQVRECKEHLEKAAKWESYELDARVGLKVTAALEAVEKWESAHATTSG

SEQ ID NO: 4727 - protein, 549 aa, Aspergillus niger
  strain CBS 513.88 / FGSC A1513
MSGRLMAVHSIVVILSISHSPASATLSGPNIVSGLRDVEVRDPGPGRFLGLVDQLIVDDPLCYSSTKIPTVYPTPPFPNSGYALVKLAGQRMLACLLTRDRPPSMTHRDVEIRPEPTQIADPTGYTPPAGVALLSVIKLPPQLQLLFCSLQTILSLHARSPFVLYRWLFPPFPSTFLLPFAFIFGCTCFHSFKKVFPLPEGYKPTTPHSIMRYSLALGALCAAGALANNVDKRSYVTDWTIVTLTTTITEYPTPTVYENVAAQEASAAASSSSAAAVAAAAESSSSAAAAAAAAASASAEASSSAAAAAAAAAEASTSSVVTPVVETTAAATTAAAATTAAAEEVATSWTSAWTSAWTSSWSSAAAPTTTLATSTSSSASSTATNAYQSAVLYNHNVHRSNHSASSLEWSSDLESSAYTLAAKCVYEHDTSIDGGGYGQNIGYGVESSEIGVMITNLMYNDEMGYYTDLYGEADPDMTYFDNWGHFSQIVWAATTHVGCATVTCDSLGNVDASEALPFTVCNYSPAGNYEGEYGTNVKRPLGQAVYVAS

SEQ ID NO: 4728 - protein, 281 aa, Aspergillus niger
  strain CBS 513.88 / FGSC A1513
MKQFSAKYALILLATAGQALAASTQGISEDLYNRLVEMATISQAAYADLCNIPSTIIKGEKIYNAQTDINGWILRDDTSKEIITVFRGTGSDTNLQLDTNYTLTPFDTLPQCNDCEVHGGYYIGWISVQDQVESLVKQQASQYPDYALTVTGHSLGASMAALTAAQLSATYDNVRLYTFGEPRSGNQAFASYMNDAFQVSSPETTQYFRVTHSNDGIPNLPPAEQGYAHGGVEYWSVDPYSAQNTFVCTGDEVQCCEAQGGQGVNDAHTTYFGMTSGACTW

SEQ ID NO: 4729 - protein, 321 aa, Aspergillus niger
  strain CBS 513.88 / FGSC A1513
MYRLLSVASVPLLASLVHGYADPGACSGVCTTHDPGLIRRESDGTYFLFSTGNKISYVSASSIEGPWTSVGSMLPDGSSIDLDGNDDLWAPDVSYVDGLYYVYYAVSTFGSQDSAIGLATSETMEYGSWTDHGSTGIASSSAKIYNAIDPNLIYADGTYYINFGSFWDDIYQVPMKSTPTAAASSSYNLAYDPSGTHAEEGSYMFQYGDYYYLFYSAGICCGYDTSMPASGEEYHIKVCRSTSPTGDFVDSDGTACTDGGGTMVLESHGEVYGPGGQGVYDDPNLGPVLYYHYMNTTIGYADSDAQFGWNTIDFSSGWPVV

SEQ ID NO: 4730 - protein, 323 aa, Aspergillus niger
  strain CBS 513.88 / FGSC A1513
MTNFKWIVAAAGLLSGQVLAAPTATSTHAKRATVSDAAFGYASLNGGTTGGAGGTTTTVSSYAAFTSAVSGDDAKVVYVDGTIKQTADQVKIGSNTSIIGKDANAILEGFGVLVKEKENVIIRNLGVSKVLADNGDAIGVQYSNNVWIDHCDVSSDRDHDKDYYDGLIDITHGSDYVTVSNTFIHDHWKASLVGHSDSNEDEDSGHLTVTYANNYWYNINSRAPSFRFGTGHVYNSYYLDVSDGINTRDGAQLLVESNQFVDSKKALYSTDDGYAVSNDNDFGDSENTAEEGTLTSMPYDYTLLGSANVKAAVVGTAGQTLTF

SEQ ID NO: 4731 - protein, 633 aa, Aspergillus niger
  strain CBS 513.88 / FGSC A1513
MATVRICVCGDEGTGKSSLITSLVKGVFVTNKIQPILPQITIPPTIGTPENVTTTTVVDTSALPQERNNLAREIRKSNVILLVYSDHYSYERVALFWLPYFRSLGVNVPVVLCANKSDLAADHTEAQVIEEEMLPLMAEFKEIDSCIRTSAREHRNVNEAFFLCQKAVTHPIAPLFDSKESSLKPAAIAALQRIFYLCDKDRDGYLSDKEIKDFQMRCFEKPLSEEDLVHIKETIQRTHPHSVTPSGIDCRGFLQLNKMYAEKGRHETVWIILRAFQYTDNLSLQENFLHPRFDVPPYASAELSPEGYRFFVNLFLLSDKDNDGGLNDAELASLFAPTPGLPASWADGSFPSSTVRNEAGHVTLQGWLAQWSMTTFTSPKTTLEYLAYLGFESSDRSNPSTTAALKVTRPRKRRKRPGRVGRNVVLGHVLGAAGSGKSALLDAFLSRGFSTTYRPTIQPRTAVNTVELPGGKQCYLILDELGELEPALLENQVKLLDQCDVIVYTYDSSDPDSFAYIPALRAKYPHLEELPSVFIALKADLDRTTQRAEYQPHEYTAMLNMPSPPLHVSATWSSIQEVFVHIAEAAMEPSTAFPRSEEDVEGKWMAWGIALGAVVCAGAAAVMIWRRVSGSGV

SEQ ID NO: 4732 - protein, 373 aa, Aspergillus niger
  strain CBS 513.88 / FGSC A1513
MKVPFLQLLCLNAALASANVVKGAAQGFAAGVTGGGDITPSYPKTNEELVSLLESDEPQVVVLTKTFEFIGTEGTTTENGCAPWGTGKSCQLAINSNGWCGKNPVVTITYDNAAKNGIHIKSNKTLVGEGDKGVLSGKGLYFEGGVSNIIVQNIKITNLNPGFVWGGDAFTFFGADLIWIDHCETSLTGRQHYVTGFHPNTRMTWSNNFLNGVTTHSAGCDDHHYWTMELVGPGDQITFQNNYVYHTTGRGPALSGTTLFHAVNSVWSSIPGHAIEGGDKGRGLFEGCFFEDVVEIAPAKPENQLFSASEANAASCKSALGRACQANSYSKSGAFGSSETGFFKDFAGLTIAPAGSATDALAYVPKNCGIGRL

SEQ ID NO: 4733 - protein, 434 aa, Aspergillus niger; identical to SEQ ID NO: 4635
  strain CBS 513.88 / FGSC A1513

SEQ ID NO: 4734 - protein, 443 aa, Aspergillus niger
  strain CBS 513.88 / FGSC A1513
MLVTSLIALLPAIAAAQVSGTVGPRTSASAKAAEKVCNVLDYGASANSTIDIGPPLKEAFQDCQTGGLVYIPEGDYLLSSWVSLVYGSGWALQLDGIIYRDKNVTDGGNMIFIEHTSDIEIFSNNSAGAIQGYGYLFHEQDEYGPRILRLNNVTDFSVHDLILVDSPAYFLNLVESYNGEVYNMVIRGASMGGLDGIDISGANYWIHDVEVTNGDECVTVKSPSANVRVENVFCNHSGGCAMGSLGTDTNISNIEFENIYTYNSTQMYMIKSNGGNGTVTNCSFKNFIGYSNAYMLDLDTYWGDESDGDGIKYENIGFENWKGTSSNGIQRSPIRILCPDANPCTNITLTAVELWTDTGDYVKQECSSAYGEGECLRQQNGTLASYSFTTTITSVPVTAYSPTTTMPGLISTSMDTTTSIPIPTIPTSFFPGASAYSTLMANM

SEQ ID NO: 4735 - protein, 931 aa, Aspergillus niger
  strain CBS 513.88 / FGSC A1513
MRHSIGLAAALLAPTLPVALGQYIRDLSTEKWTLSSRALNRTVPAQFPSQVHLDLLRAGVIGEYHGLNDFNLRWIAAANWTYTSQPIKGLLDNYDSTWLVFDGLDTFATISFCGQQIASTDNQFRQYAFDVSTALGSCKGDPVLSINFGSAPNIVDAIAQDSNSQKWPDDVQLTYEYPNRWFMRKEQSDFGWDWGPAFAPAGPWKPAYIVQLDKKESVYVLNTDLDIYRKGQINYLPPDQSQPWVVNASIDILGPLPTKPTMSIEVRDTHSGTILTSRTLNNVSVAGNAITGVTVLDGLTPKLWWPQGLGDQNLYNVSITVQSRGNQTVASVNKRTGFRTIFLNQRNITEAQRAQGIAPGANWHFEVNGHEFYAKGSNLIPPDSFWTRVTEEKMSRLFDAVVVGNQNMLRVWSSGAYLHDYIYDLADEKGILLWSEFEFSDALYPSDDAFLENVAAEIVYNVRRVNHHPSLALWAGGNEIESLMLPRVKDAAPSSYSYYVGEYEKMYISLFLPLVYENTRSISYSPSSTTEGYLYIDLSAPVPMAERYDNTTSGSYYGDTDHYDYDTSVAFDYGSYPVGRFANEFGFHSMPSLQTWQQAVDTEDLYFNSSVVMLRNHHDPAGGLMTDNYANSATGMGEMTMGVVSYYPIPSKSDHISNFSAWCHATQLFQADMYKSQIQFYRRGSGMPERQLGSLYWQLEDIWQAPSWAGIEYGGRWKVLHHVMRDIYQPVIVSPFWNYTTGSLDVYVTSDLWSPAAGTVDLTWLDLSGRPIAGNAGTPKSVPFTVGGLNSTRIYGTNVSSLGLPDTKDAVLILSLSAHGRLPNSDRTTNLTHENYATLSWPKDLKIVDPGLKIGHSSKKTTVTVEATSGVSLYTWLDYPEGVVGYFEENAFVLAPGEKKEISFTVLEDTTDGAWVRNITVQSLWDQKVRG

SEQ ID NO: 4736 - protein, 234 aa, Aspergillus niger
  strain CBS 513.88 / FGSC A1513
MANVALLGCTGMVGSHILTHLLGNSSVARIDTISRRTPQPATAAPQEKLTTFVSDDSSKWASQLSSLTPTPDIFISAFGTTRGAAGGFENQYKIEHGLNVEMARAARDAGTKVYVLISSTGADKNSSFGYPRMKGEIEEEVKAMGFDRTIILRPGLISGERQESRPAEAVMRGFAGLVGKIHSGLKDGWAQDADVIAKAAVNAGVKALNGEVPAGSEKVWVMYGKDIIQYGKGQ

SEQ ID NO: 4737 - protein, 448 aa, Aspergillus niger
  strain CBS 513.88 / FGSC A1513
MTWSTSFLVATSLLSIINSVHAQLTGSVGPLTSVIDKAAVKTCNVCDYGASSDNTTGVGQPIIDAFTDCGSGGLIHVPEGDYLLKDWVSSENGSAWSIQLDGVLHWDSSPSAQSYIFAITGGSDSELSSSNATGAIQGSGYLYHRHNTYTSPRMLYISGVSDWTVHDLVLVNSPMPHFVIDGGYNGEAYNMAICGGDHGGLDGIDLYGGNIWIHLMVTNKDECVTSKTNSHNFLIENIYCNPSGGCAIGSLGSSVNVTNILYRNVYTWDSNQMMMIKTNGGLGNVSNIVFENFIGHGNVNSLDLDSYWSSMNAIDGVGIYYHNITIYNWTGTAIDGETRPPIRVICPEDMPCTEITLVQIDLLVEEGRYDEYYCAIACGGYCLDSATSTLTTYTTTTYGNSASTGYEAPTMADDLATAFGTTASIPTPTTPASFFPGVAPVSAVAGSS

SEQ ID NO: 4738 - protein, 446 aa, Aspergillus niger
  strain CBS 513.88 / FGSC A1513
MPALPILALALAPLLVNGQLSGSVGPLTSAHSKAATKTCNVLDYGAVADNSTDIGSALSEAWDACSDGGLIYIPPGDYAMDTWVSLSGGKATAIILDGTIYRTGTDGGNMILVENSSDFELYSNSSSGAVQGFGYVYHREGDLDGPRILRLQDVSNFAVHDIILVDAPAFHFVMDDCSDGEVYNMAIRGGNSGGLDGIDVWGSNIWVHDVEVTNKDECVTVKSPANNILVESIYCNWSGGCAMGSLGADTDITDILYRNVYTWSSNQMYMIKSNGGSGTVNNTVLENFIGHGNAYSLDVDSYWSSMTAVDGDGVQLSNITFKNWKGTEADGAERGPIKVVCSDTAPCTDITIEDFAMWTESGDEQTYTCESAYGDGFCLEDSDSTTSYTTTQTVTTAPSGYSATTMAADLTTDFGTTASIPIPTIPTSFYPGLTAISPLASAATTA

SEQ ID NO: 4739 - protein, 844 aa, Aspergillus niger
  strain CBS 513.88 / FGSC A1513
MAAFAQYTLSTGWYFKDRDELASEAWMPVPVVPSVVHQDLQANGKLKNPYVGFNELDARWVNEKSWTYRKILQKPTVLAGSRIVLAFDGLDTFAKVKLDNNIILESSNMFQAYRVDVTKALDCGDEHVLEIEFDCAMLRAQELRKQDPNHNWASFNGDPARMSVRKAQYHWGWDWGPVLMTAGIWRAVRLEVYSTRLADLWTEINLDPTHKTASISAFTELESVDLDPSYKVKFTITLHGKQIAQAEATPQEGRAKVEFNIDQPCLWWPHGYGDSTLYEVSASLNADQLELHRVTKKIGIRTAEVVQRPDKHGKSFFFRINGVDIFCGGSCWIPADNLLPNISPQRYRKWIQLMVAGRQAMIRVWGGGCYEDDSFYEACDELGVLVWQDFMFGCGNYPTWPELLKSIEQEAIYNVRRLRHHPSIVVYVGNNEDYQVQEQAGLEYNYEDKNPENWLKTNFPARYIYEELLPSVVERCSPKTFYHPGSPWGDGKITSDPTVGDMHQWNVWHGTQEKYQIFDTLGGRFNSEFGMEAFPHLSTIEYFVENEKDKYPQSHVLDFHNKADGHERRIATYLVENLRTATDLETYIYLTQVVQAETMMFGYRGWRRQWGDERHCGGALLWQLNDCWPTISWAIVDYFLRPKPAYYAVARVLNPVAVGVRREHHDWSITHAQPPKTSKYELWVVSSLQKPASGKVELRFLSVDTGREIRERIVRENVDIVPNGTTNLITDGLIDHTVDAEPHVLAARLWVDGEIVARDVDWPQPFKYLDFADRGLEVKRVSEASDQQVFQISTEKPVKCLVFEERDGVKFSDSAMDIVPGDVQTVKVTGLRADEKLKYKFLGQ

SEQ ID NO: 4740 - protein, 459 aa, Aspergillus niger; identical to SEQ ID NO: 4667
  strain CBS 513.88 / FGSC A1513

SEQ ID NO: 4741 - protein, 270 aa, Aspergillus niger
  strain CBS 513.88 / FGSC A1513
MTRSIFIHTLLALSALTSVHGANSPGCGKNPTLANGVHQINGREYTLKIPDDYDANNPYHLIFGLHWRGGNMDNVVSGDSIQPWYGLESRAQGSAIFIAPNGLNAGWANTNGEDVAFIDAIMEQVESDLCVDQSSRFATGFSWGGGMSYSLACSRAKEFRAVSVLSGGVISGCDGGNDPIAYLGIHGINDPVLPFDGGVELAERFVGNNGCQPASIEKPQSGSNGWKRTDFYGCSKPVSFIAYDGGHDGAPLGVQSSLAPDATWEFFMAA

SEQ ID NO: 4742 - protein, 726 aa, Aspergillus niger
  strain CBS 513.88 / FGSC A1513
MGALQWLSITAAAASAVSALTPEQMIGAPRRTEVIPNPSGDTGLFSTSQWSFDTHSESTWWSLIDLQSGKTTTLTDDSDIEEIIWLGSDNSTLLYINSTNAQVPGGVELWIADSSDFANAYKAASLSAGFLGIKSTVTDSGDVHFILRGKSYPNGTAYNDQLAETYPSTARIYDSIFVRHWDTYLTTASHAVFSGTLQSSTSDDGNVQYTSSGGLTNLVNPVKGAESPFPPFGGNDDYDLSPDGKWVTFKSKAPELPLANNTAAYVYLVPHDGSATAFAVNGPDSPATPEGVEGESNNPVFSPDSDKIAYFQMATNTYESDRNVLYVYSIADDTITPLAKDWDRSPSSVTWVDGDNLVVASQDLGRTRLFAIPGDAGDDFKPTNFTDGGSVSAQYVLSNSTLLVTSSAFWTSWSVYTASPDEGVINTLASANEIDPELSGLSSSDFEEFYFDGNWTTLQGWITYPQDFDSSKKYPLAFLIHGGPEDAWADEWNLKWHSKVFADQGYVVVQPNPTGSTGFGQQLTDAIQLNWTGAAYDDLTKAWQYVHDTYDFIDTDNGVAAGPSFGAFMITWIQGDDFGRKFKALVSHDGPFIGDAWVETDELWFVEHEFNGTFWQARDAFHNTDPSGPSRVLAYSTPQLVIHSDKDYRIPVANGIGLFNTLQERGVPSRFLNFPDEDHWVTGQENSLVWYQQVLGWINRYSGVGGSNPDAIALEDTVNPVVDLNP

SEQ ID NO: 4743 - protein, 303 aa, Aspergillus niger
  strain CBS 513.88 / FGSC A1513
MLSTHLLFLATTLLTSLFHPIAAHVAKRSGSLQQITDFGDNPTGVGMYIYVPNNLASNPGIVVAIHYCTGTGPGYYSNSFYATLSEQYGFIVIYPSSPYSGGCWDVSSQATLTHNGGGNSNSIANMVTWTISEYGADSKKVFVTGSSSGAMMTNVMAATYPELFAAGTVYSGVSAGCFYSDTNQVDGWNSTCAQGDVITTPEHWASIAEAMYPGYSGSRPKMQIYHGSVDTTLYPQNYYETCKQWAGVFGYDYSAPESTEANTPQTNYETTIWGDNLQGIFATGVGHTVPIHGDKDMEWFGFA

SEQ ID NO: 4744 - protein, 435 aa, Aspergillus niger; identical to SEQ ID NO: 4636
  strain CBS 513.88 / FGSC A1513

SEQ ID NO: 4745 - protein, 391 aa, Aspergillus niger
  strain CBS 513.88 / FGSC A1513
MKLSIALALGATASTGVLAAVVPQQEPLITPQDPPTHHHQEKFLIELAPYQTRWVTEEEKWDLKLDGVNFIDITEERNTGFYPTLHAGSYVHYPPTMKHAEKVVPLLRGLSKDNMEQNLNKFTSFHTRYYRSSTGIESAKWLYSRVSDVIEQSGAAEYGATVEQFAHSWGQFSIIARIPGQTNKTVVLGAHQDSINLFLPSILAAPGADDDGSGTVTILEALRGLLQSDAIVRGNASNTIEFHWYSAEEGGMLGSQAIFSQYKRDKRDIKAMLQQDMTGYTQGALDAGRQEAIGIMVDYVDEGLTQFLKDVTTEYCGIGYIETRCGYACSDHTSASKYGYPAAMATESEMENSNKRIHTTDDSIRYLSFDHMLEHARLTLGFAYELAFAQF

SEQ ID NO: 4746 - protein, 531 aa, Aspergillus niger
  strain CBS 513.88 / FGSC A1513
MLSKTSLLSLLSLAAGVVNADFGITTNDDSYVINANSPNSLVFTVDRGSCDITSIVHYGTELQYSGKGSHIGSGLGTATVSATKSGDYIKVTCETDTLTQYMVVHDGDPIIHMATYITEEPSIGELRFIARLNSDVLPNEEPFGDVSNTADGEAIEGSDVFLVDGETRSKFYSSQRFIDDQRHCIAGDEHRVCMILNQYETSSGGPFHRDINSNNGGDYNSLYWYMNSGHVQLESYRMGLHGPYSMYFSRSGTPSTDIDTSFFADLDIEGYVAESGRGTVSGTASGADSSFDWVVHWYNDDAQYWTYTSSSGSFTSPAMKPGTYTMVYYQGEYVVATSEVTVSAGSSTSKDISGSVETGTTIFKIGDWDGQPTGFRNAENQLRMHPSDSRMSDWGPLTYTVGSSSLTDFPMAIFKSVNSPVTIKFTATSDQTGAATLRIGTTLSFAGGRPQATINDYEGSAPSAPTNLDSRGVTRGAYRGYGDVYDVSVPEGTIVEGENTITISVISGSSGDDFLSPNFLDAVFIIALVDN

SEQ ID NO: 4747 - protein, 660 aa, Aspergillus niger
  strain CBS 513.88 / FGSC A1513
MLLHFILYAALSSVVTSVSLQPRLQDGLALTPQMGWNTYNHYSCSPNETIVQSNAQALVDLGLSSLGYRYVTTDCGWTVADRLPDGSLTWNDTLFPQGFPAMGDFLHDLGLLFGVYQDSGILLCGSPPNETGSLYHEEQDARTFASWNVDSLKYDNCYSDAATGYPNVNYAPSTSPEPRFANMSHALLQQNRTILFQICEWGISFPANWAPALGHSWRIGNDIIPDWRTIFRIINQAAPQTDVAGPGQWPDLDMLEVGNNIFSLPEEQTHFSLWAILKSPLIIGAALKDELTAINDASLAVLKQKDVIAFNQDALGKSASLRRRWTEEGYEVWSGPLSNGRTVAAVINWHNESKDLTLDLPDVGLQHAGTVKNIWDGTTARDVLTSYTATVAGHGTMLLELQNTTAVGVYPRGVFGVSSGQTTTFQNIYAVTTSAKYIISVYFSQPASSTETITIGSNANQSMISAQVPASSTLVSAEIPLTAGSSNTITINTSIPIDAIHVTPPNGTYYPCTNFTLAGSTTLTTCGSGYCQPVGSKVGYISPSGTAKATISATTSGSKYLEIDWINNDIAFDSSWGWGSNSRNLTVTVNSEDPVRIEVPLSGRHSELFGPGLGWWDTSTLGLLTSGWKEGLNEVVVGNVGGDEGFQSYGADFVGIRVLD

SEQ ID NO: 4748 - protein, 262 aa, Aspergillus niger
  strain CBS 513.88 / FGSC A1513
MAPLKSLLLGASLATLALSTPLATDAENLYARQFGTGSTANELEQGSCKDVTLIFARGSTELGNMGTVIGPPLCDNLKSKLGSDKVACQGVGGQYSAGLVQNALPQNTDPGSISAAKQMFEEANSKCPNTKIVAGGYSQGSAVIDNAVQELSTTVKDQVKGVVLFGFTRNVQDHGQIPNYPKDDVKVYCAVGDLVCDDTLVVTAMHLTYGMDAGDAASFLAEKVQSSSSSTTSSSSDAASSSSAAGTSSSGLSGLSSFFGGL

SEQ ID NO: 4749 - protein, 349 aa, Aspergillus niger
  strain CBS 513.88 / FGSC A1513
MRQAQSASLLAALLSATQVAAHGHVTNLVVDGVYYEGFDISVFPYESDPPKVAAWTTPNTGNGFISPDEYRNPNIICHENATNAQAHVVVGAGEKINIQWTAWPDSHHGPVLDYLARCDGSCETVDKTDLEFFKIDGVGLVSDTEVPGTWGTDQLINNNNSWMVEIPPSIAAGNYVLRHELIALHGAEEQDGAQNYPQCFNLQVTGTGTATPSGVKGTELYTATEGGILVNIYSSLSTYTMPGPTAYSGDVSITQTTSAVTSTGTAVVGSASAVASASSTAAAATSAAAVTSSTITPAPAVSSAASGSSGSQSLYGQCGGINWTGATQCASGSSCHSYNPYYYQCIASA

SEQ ID NO: 4750 - protein, 379 aa, Aspergillus niger
  strain CBS 513.88 / FGSC A1513
MKYSTIFSAAAAVFAGSAAAVGVSGSAEGFAEGVTGGGDATPVYPDTIDELVSYLGDDEARVIVLTKTFDFTDSEGTTTGTGCAPWGTASACQVAIDQDDWCENYEPDAPSISVEYYNAGVLGITVTSNKSLIGEGSSGAIKGKGLRIVSGAENIIIQNIAVTDINPKYVWGGDAITLDDCDLVWIDHVTTARIGRQHYVLGTSADNRVSLTNNYIDGVSDYSATCDGYHYWGIYLDGDADLVTMKGNYIYHTSGRSPKVQDNTLLHCVNNYFYDISGHAFEIGEGGYVLAEGNVFQNVDTVLETYEGAAFTVPSTTAGEVCSTYLGRDCVINGFGSSGTFSEDSTSFLSDFEGKNIASASAYTSVASSVVANAGQGNL

SEQ ID NO: 4751 - protein, 434 aa, Aspergillus niger
  strain CBS 513.88 / FGSC A1513
MLDFMDYIQLAFAEATNWNRDNSYSSLTATAQSLLDFSTPERLRVHLSSLSTPHFATSYTLGTVGLIDGSVSYLFSTVPLDKFPSRSALIPLRKLSPGYRQVQAPIAPIAETILINDDLNDASAYTTIGKKATLFHATLHLPPPTTLNALFLRRISPTMQLSLAVCSTRGPPLSKSAPQASLLAQLSHNTGKYNNEYLFSTDNALFGWRGLWNFGPDPRDPVASGSSPRLSLLSAGAEAYYSPVSSLIGMSTGLRFSTANANTPISTFPYTLTLTLTPLTGSLSTTYSLRASPNLAFSSRFGFNVYSWESEMVAGCELWRKSKSRYRDDGDGVEWARRKIRESLFPHPHPHLSTSTPNDIKDLAGHALEKSGKGEEEENESVLKIRVDQSWNVRLLWEGRVKELLVLIDRVVEVYSNERCLRELRLMVVFNLDL

SEQ ID NO: 4752 - protein, 841 aa, Aspergillus niger
  strain CBS 513.88 / FGSC A1513
MRGLNLFQLILALLLSMVAAEDGYDGWLRYAPVSCDLHCQQALPSHVVLLNSTKGSPIETAGRELKAGFQSILSTNLTSRPFQCNSSASILVATLDEYRQRCRDINVPELDPDGFWLQSEGDTVRILGKDARGALYGAYEYLAMVAQRNFSRVAYATSPHAPIRWVNQWDNMDGSIERGYGGASIFFKDGTVVEDMAPVEQYARLLASIRINAIVVNNVNANATLLLPENMKGLSRIADACRPYGVQIGISLNFASPEALGGLNTYDPLDPGVIAWWQNITDSLYTYVPDMAGYLVKADSEGQPGPDTYNRTLSQGANLFARALQPYGGVLMYRAFVYDDNLNESDWKADRAKAAVEYFKDLDGQFEENVVIQIKYGPIDFQVREPTSPLFANLYHTNTAIELEVSQEYLGQQCHLVYLPPLWKTVLDFDLRVDHKPSMVRDIISGQRFNRTLGGWAAVVNVGTNRTWLGSHLAMSNLYAYGRLAWSPTDESEQILEDWTRLTFGQNHHVINTISDMSMTSWPAYENYTGNLGIQTLTDILYTHYGPNPATQDNNGWGQWTRADHDSVGMDRTIWNGTGYTGQYPEEVARVYESLESTPDDLVLWFHHVPWTHRLHSGVTVIQHFYNAHYAGAEAAHGFVRQWESLEGLIDRERYEAMRSRLVYQAGHSIVWRDAINNFYYNMTGIPDVAGRVGHHPWRIEAESMGLDGYQTYTVSPFEAASNTTAIITTSNSTTGTARTSIKAPSGVYDIGVNYYDLYGGQSKWTLSVGDKVVGQWLGDMEHNSLGHTPSIYLGGHSATRITFHGVGIRQGDQLKIVGEANGVEPAPLDYIVLLPPGLVD

SEQ ID NO: 4753 - protein, 657 aa, Aspergillus niger
  strain CBS 513.88 / FGSC A1513
MDKHRRRDESPSGLSDIVEPDGLLGTGITSRHIEAFGRKVTSTAGHLMGPAPDSSTGGHYHTAMADIQRELRHPNTQRKVFSLTQTTPTDLVRSKLSTTEIQSRAISSLPDELLANIPDDSSSYSLFQGFQASQDDIEYRRAHRRRSSKSKKLLKDGETRGALPSAPSDLKKERDLLSRRMELMGVRKNMCSSEIHDIDNKIANLHNMRKIVLDRLAGLEMEEADLEHELNEIENKLEDIQEEQQEAEVPPPATPKSSEANDDSIVSEDPAMGASFMSESIYQKIPSPKSVKQRSIRKRSMPVLHEHFAPGSEIKEMPAHSDMVTAIDFDYPFGTMISAALDDTVRVWDLNVGRCVGFLEGHNASVRCLQIEDNIVATGSMDASVKLWDLSRARTTTRDNRVTRREDDEESAQADDASMASHSTTLEDCYVYSLDAHVDEVTALHFKGDTLISGSADKTLRQWDLVKGRCVQTLDVLWAAAQASTLGSETTWRPSGRLPDASADFVGAVQCFDAALACGTADGMVRLWDLRSGQVHRSLVGHTGPITCLQFDDVHLVTGSQDRSIRIWDLRTGSIFDAYAYDKPITSMMFDTKRIVAAAGENVVKVYDKADGHHWDCGAGVGVDDSGPQPATVERVRLKDGFLVEGRKDGIVAAWTC

SEQ ID NO: 4754 - protein, 211 aa, Aspergillus niger
  strain CBS 513.88 / FGSC A1513
MKVTAAFASLLLTAFAAPAPEPVLVSRSAGINYVQNYNGNLGDFTYDESTGTFSMYWEDGVSSDFVVGLGWTTGSSKSITYSAQYSASSSSSYLAVYGWVNSPQAEYYIVEDYGDYNPCSSATSLGTVYSDGSTYQVCTDTRTNAPSITGTSTFTQYFSVRESTRTSGTVTIANHFNFWAQHGFGNSNFNYQVMAVEAWNGAGSASVTISS

SEQ ID NO: 4755 - protein, 412 aa, Aspergillus niger
  strain CBS 513.88 / FGSC A1513
MKTTTYSLLALAAASKLASAHTTVQAVWINGEDQGLGNSADGYIRSPPSNSPVTDVTSTDMTCNVNGDQAASKTLSVKAGDVVTFEWHHSDRSDSDDIIASSHKGPVQVYMAPTAKGSNGNNWVKIAEDGYHKSSDEWATDILIANKGKHNITVPDVPAGNYLFRPEIIALHEGNREGGAQFYMECVQFKVTSDGSSELPSGVSIPGVYTATDPGILFDIYNSFDSYPIPGPDVWDGSSSGSSSGSSSAAAAATTSAAVAATTPATQAAVEVSSSAAAVVESTSSAAAATTEAAAPVVSSAAPVQQATSAVTSQAQAPTTFATSSKSSKTACKNKTKSKSKVAASSTEAVVAPAPTSSVVPAVSASASASAGGVAKMYERCGGINHTGPTTCESGSVCKKWNPYYYQCVASQ

SEQ ID NO: 4756 - protein, 362 aa, Aspergillus niger; identical to SEQ ID NO: 4615
  strain CBS 513.88 / FGSC A1513

SEQ ID NO: 4757 - protein, 476 aa, Aspergillus niger; identical to SEQ ID NO: 4642
  strain CBS 513.88 / FGSC A1513

SEQ ID NO: 4758 - protein, 88 aa, Aspergillus niger
  strain CBS 513.88 / FGSC A1513
MRFTYQALAVFISSLLVNSAAAHACESSAVWPDPADCHHFYQCIPGTEPAHKVCGAGTAFNPKISACDYEQNVPSCFKDPHHPRPFHA

SEQ ID NO: 4759 - protein, 793 aa, Aspergillus niger
  strain CBS 513.88 / FGSC A1513
MLISGSSAALCALALPFAAAKSLWSDSPGNYSSFITTAFPLGNGRLGAMPIGSYDKEIVNLNVDSLWRGGPFESPTYSGGNPNVSKAGALPGIREWIFQNGTGNVSALLGEYPYYGSYQVLANLTIDMGELSDIDGYRRNLDLDSAVYSDHFSTGETYIEREAFCSYPDNVCVYRLSSNSSLPEITFGLENQLTSPAPNVSCHGNSISLYGQTYPVIGMIYNARVTVVVPGSSNTTDLCSSSTVKVPEGEKEVFLVFAADTNYEASNGNSKASFSFKGENPYMKVLQTATNAAKKSYSALKSSHVKDYQGVFNKFTLTLPDPNGSADRPTTELLSSYSQPGDPYVENLLFDYGRYLFISSSRPGSLPPNLQGLWTESYSPAWSGDYHANINLQMNHWAVDQTGLGELTEPLWTYMAETWMPRGAETAELLYGTSEGWVTHDEMNTFGHTAMKDVAQWADYPATNAWMSHHVWDHFDYSQDSAWYRETGYPILKGAAQFWLSQLVKDEYFKDGTLVVNPCNSPEHGPTLTPQTFGCTHYQQLIWELFDHVLQGWTASGDDDTSFKNAITSKFSTLDPGIHIGSWGQIQEWKLDIDVKNDTHRHLSNLYGWYPGYIISSVHGSNKTITDAVETTLYSRGTGVEDSNTGWAKVWRSACWALLNVTDEAYSELSLAIQDNFAENGFDMYSGSPPFQIDANFGLVGAMVQMLIRDSDRSSADASAGKTQDVLLGPAIPAAWGGGSVGGLRLRGGGVVSFSWNDSGVVDSCKADLSARGSDVSQVKFYVAGGRAIDCSS

SEQ ID NO: 4760 - protein, 818 aa, Aspergillus niger
  strain CBS 513.88 / FGSC A1513
MARVDFWHTASIPRLNIPALRMSDGPNGVRGTRFFNGIPAACFPCATALGATWDAHLLHEVGQLMGDESIAKGSHIVLGPTINIQRSPLGGRGFESFAEDGVLSGILAGNYCKGLQEKGVAATLKHFVCNDQEHERLAVSSIVTMRALREIYLLPFQLAMRICPTACVMTAYNKVNGTHVSENKELITDILRKEWNWDGLVMSDWFGTYTTSDAINAGLDLEMPGKTRWRGSALAHAVSSNKVAEFVLDDRVRNILNLVNWVEPLGIPEHAPEKALNRPQDRDLLRRAAAESVVLMKNEDNILPLRKDKPILVIGPNAQIAAYCGGGSASLDPYYTVSPFEGVTAKATSEVQFSQGVYSHKELPLLGPLLKTQDGKPGFTFRVYNEPPSHKDRTLVDELHLLRSSGFLMDYINPKIHSFTFFVDMEGYFTPTESGVYDFGVTVVGTGRLLIDNETVVDNTKNQRQGTAFFGNATVEERGSKHLNAGQTYKVVLEFGSAPTSDLDTRGIVVFGPGGFRFGAARQVSQEELISNAVSQASQASQVIIFAGLTSEWETEGNDREHMDLPPGTDEMISRVLDANPDNTVVCLQSGTPVTMPWVHKAKALVHAWFGGNECGNGIADVLFGDVNPSAKLPVTFPVRLQDNPSYLNFRSERGRVLYGEDVYVGYRYYEKTNVKPLYPFGHGLSYTTFSRSDLKITTSPEKSTLTDGEPITATVQVKNTGTVAGAEIVQLWVLPPKTEVNRPVRELKGFTKVFLQPGEEKQVEIVVEKKLATSWWDEQRGKWASEKGTYGVSVTGTGEEELSGEFGVERTRYWVGL

SEQ ID NO: 4761 - protein, 860 aa, Aspergillus niger
  strain CBS 513.88 / FGSC A1513
MRFTSIEAVALTAVSLASADELAYSPPYYPSPWANGQGDWAEAYQRAVDIVSQMTLAEKVNLTTGTGWELELCVGQTGGVPRLGIPGMCAQDSPLGVRDSDYNSAFPAGVNVAATWDKNLAYLRGQAMGQEFSDKGADIQLGPAAGPLGRSPDGGRNWEGFSPDPALSGVLFAETIKGIQDAGVVATAKHYIAYEQEHFRQAPEAQGYGFNITESGSANLDDKTMHELYLWPFADAIRAGAGAVMCSYNQINNSYGCQNSYTLNKLLKAELGFQGFVMSDWAAHHAGVSGALAGLDMSMPGDVDYDSGTSYWGTNLTISVLNGTVPQWRVDDMAVRIMAAYYKVGRDRLWTPPNFSSWTRDEYGFKYYYVSEGPYEKVNQFVNVQRNHSELIRRIGADSTVLLKNDGALPLTGKERLVALIGEDAGSNPYGANGCSDRGCDNGTLAMGWGSGTANFPYLVTPEQAISNEVLKNKNGVFTATDNWAIDQIEALAKTASVSLVFVNADSGEGYINVDGNLGDRRNLTLWRNGDNVIKAAASNCNNTIVIIHSVGPVLVNEWYDNPNVTAILWGGLPGQESGNSLADVLYGRVNPGAKSPFTWGKTREAYQDYLYTEPNNGNGAPQEDFVEGVFIDYRGFDKRNETPIYEFGYGLSYTTFNYSNLQVEVLSAPAYEPASGETEAAPTFGEVGNASDYLYPDGLQRITKFIYPWLNSTDLEASSGDASYGQDASDYLPEGATDGSAQPILPAGGGAGGNPRLYDELIRVSVTIKNTGKVAGDEVPQLYVSLGGPNEPKIVLRQFERITLQPSKETQWSTTLTRRDLANWNVETQDWEITSYPKMVFAGSSSRKLPLRASLPTVH

SEQ ID NO: 4762 - protein, 423 aa, Aspergillus niger; identical to SEQ ID NO: 4687
  strain CBS 513.88 / FGSC A1513

SEQ ID NO: 4763 - protein, 350 aa, Aspergillus niger
  strain CBS 513.88 / FGSC A1513
MIYSLLLSALPLLSSAALTYRGADISSLLIEEDAGISYKNLNGETQALEDILVNNGVNSIRQRVWVDPSDGSYDLDYNLKLAKRVQAAGMSIYLDLHLSDTWADPSDQTTPTGWSTTDIDTLTWQLYNYTLDVCNTFAENDIDIEIVSIGNEISSGLLWPLGKTSNYDNIAKLLHSGAWGVKDSNQATTPKIMIHLDNGWDWEEQEYFYKTVLATGSLLSTDFDLMGVSYYPFYSSEATLSALQTSLTNMQSNYDKSVVVVETNWPVSCPDPEYSFPSDLSSIPFSAAGQEEFLEKLAEVVEGVTDGLGIYYWEPAWVDNAALGSSCADNLMVDIDTDEVLESVTVFEDL

SEQ ID NO: 4764 - protein, 416 aa, Aspergillus niger
  strain CBS 513.88 / FGSC A1513
MKSPISLLAAVGVASAASPQTLLSLASTASDIIDASPFLSFHRDIVQIPSISGNETAVGTFVAEFLESHNFTVIKQPVPSSSNGDPNRFNIFAYPSTSPSQGRPDILLTSHIDTVPPFIPYGLHDDANNNSNILISGRGTVDAKASVAAQIFAVLDTLESNPTASLGLLFVVDEEVGGLGMRTFSDNSTLNPSPSPYHTVIFGEPTEQALVAGHKGMLEFPIIATGQAAHSGYPWLGSSAISALLPALSRVDRLGKIPEAEGGLPASEKYGETTVNIGRVDAGVAANVVPSSAIAEVAIRLAAGTPDEAREIVARAVRNATGGDEHVYCDFAAYAGGYAPQDLDTDVPGFEVTTVNYGTDVPNLKVSEGVKRYLYGPGSIHVAHGDNEAITVGQLEEAVRGYKQLIEAAVQRARRT

SEQ ID NO: 4765 - protein, 373 aa, Aspergillus niger
  strain CBS 513.88 / FGSC A1513
MKYAAALTAVAALAARAAAVGVSGTPVGFASSATGGGDATPVYPTTTDELVSYLGDDEARVIVLSKTFDFTDTEGTTTTTGCAPWGTASGCQLAINKDDWCTNYEPDAPTTTVTYNTAGELGITVNSNKSLIGEGTSGVIKGRGLRMVSGVSNIIIQNIAVTDINPEYVWGGDAITLDEADLVWIDHVTTARIGRQHYVLGTDADSRVSITNNYINGESDYSATCDGHHYWNVYLDGSSDKVTFSGNYLYKTSGRAPKVQDNTYLHIYNNYWENNSGHAFEIGSGGYVLAEGNYFSNVDTVLETDTFEGALFSSDSASSTCESYIGRSCVANVNGGDLTGTSTTVLSNLSGDTLPSADAASTSPASNAGQGNL

SEQ ID NO: 4766 - protein, 271 aa, Aspergillus niger
  strain CBS 513.88 / FGSC A1513
MKLPYFLLGLAGLAAASPMGLAERQLSDGNELRDGSCKPIIFIFARASTEPGLLGISTGPAVCNDLKMAKAGQVLCQGVGPAYTADLMSNALPDNTSPAAISESESLFKLAASKCPNSQILAGGYSQGTAVMDDSIKQLPDDVKDKIKGVVLFGYTRNAQEGGQIGNFPKDKVKIYCAMGDLVCDGTLIVTAAHFTYVMNTGEASQWLESKLSDTTTSSLTGSSSSDTSSSTSTGDSSSESSSAAGLGGLSGLTGLGSSTSGGFPSLASLF

SEQ ID NO: 4767 - protein, 765 aa, Aspergillus niger
  strain CBS 513.88 / FGSC A1513
MHSISALLSLLGGLALSSAAPTQNITSDAYFYGQSPAVYPSPEGTGTGSWASAYEKAKAFVAQLTDDEKVNLTAGVSSKTGCSGFIAEIPRLNFTGLCVSDASNGLRGTDYVNGWSSGIHVGASWNRTLARDRAKYMGQEFHRKGVNLLLGPVVGPLGRVAEGGRNWEGFSNDPYLTGALVYETVQGVQSSGVGVSTKHYIGNEQETNRNPETVNGVDVASVSSNIDDKTIHELYLWPFQDAVLAGSVAIMCSYERINNSYACQNSKTLNGLLKTELGFQGYVITDWGAQHGGIASANAGLDMVMPETTLWGSNLTTAIANGTMEASRLDDMATRIIATWYQLNQDTDFPTPGVGMPASAQSEHQVVVGTAPDEKSTLLESAIEGHVLVKNTNNALPLQTPQLVSVFGYDAKVTDSFDLASTVLGTSPLFQNYTLWVGGGSGSNSPAYVIAPLNAIQQQAYEDGTSVLWDVSAQDPEVDPTSEACLVFINSFATEGYDRSALTDDYSDTLVTNVASKCNNTIVVVHNAGIRLVYNWIDHENVTAVVLAHLPGQDTGHALVDILYGRANPSGKLPYTIAKQASDYGSLLHPSEPQTPYGLFPQSDFSEGVYIDYRAFDKDNITPQFEFGFGLSYTTFAYSGLSIEKTNETTSEYPPSAAIQEGGNPRLWDDLVTVTAEVQNSGSVDGAEVAQLYVGIPNGPVRQLRGFDKVLLSAGETAQVSFSLNRRDLSTWNVEAQQWQLQSGTYQVYVGRSSRDLPLTGEFSI

SEQ ID NO: 4768 - protein, 706 aa, Aspergillus niger
  strain CBS 513.88 / FGSC A1513
MRLLHPLIPASLLLTLTSATLHTSQTNTTITLTNNRLTANFSKSQGRITDLYLDNQDLLGPQSGDTGVGPYLDCYCIPSGFYTPGSTSPTLQLFTGTDKSGTSYAGVLMDETYPPTGQHFQQYWFLRDGETGLHTFSRLAYYNETTPYLRNLQEFRTLFRPNTELWTHLSSSEVQTAPLPSKKAVEEEVVVQDATWTFNNTPTDEYYVQFADYFTKYTFSNAWRDNSVHGMYADGSTSNGSTFGAWLVMNTKDTYYGGPLHSDLTVDGIVYNYLVSNHHGEGTPNITYGFDRTFGPQYYHFNGGKGSTASLQELKSDAETLADPSWNVDFYDSIAKHVVGYTPSSQRGSVQGKIKLPKGATRPIAVLTVDGQYFQDNSVNSSSYQYWAEIDDSGHFSVDHVKEGPYRLTVYADGIFGDFVRDGVQVKAGKKTTIQETWEAESAGTEIWRLGTPDKSSGEFRHGVARDPTHPLHPPEYLIYWGAYDWQSDFPDGINYTIGTSDPATDLNTVHWSVFGPTPNDPRVEYDTTHDWTINFPLSEDDLAERSKATLTIQLAGAKAASGNTDVYNASEPYTNLALESYINDQAEPLTLLIGFNQSSSCIVRSAVSCYQVRSRMEFPADWLKVGNNVLTLHLPYNATDTETAILPATVTGRLILPPQPIYGQTPVILSVIGSEKLEPLPAASILIFEIIRHQSEPLWSVPRSA

SEQ ID NO: 4769 - protein, 93 aa, Aspergillus niger
  strain CBS 513.88 / FGSC A1513
  MOD_RES (35)..(35): Any amino acid
MKTFISTDLLFLIASSSSFAVAQSSICPKGTSPKXCADDVLGSAADSICNDPPRQPTDGADLSTICGDIGQEASCCYPPAYGQQGICSLVADA

SEQ ID NO: 4770 - protein, 640 aa, Aspergillus niger; identical to SEQ ID NO: 4301
  strain CBS 513.88 / FGSC A1513

SEQ ID NO: 4771 - protein, 261 aa, Aspergillus oryzae
GGGNDYVILNAQDGSGTNNANFATPPDGQPGRMRMYIWTESQPYRDGSFEAGIVIHEYTHGLSNRLTGGPANSRCLNALESGGMGEGWGDFMATAIRLKAGDTHPTDYTMGEWAANKKGGIRAYPFSTSLETNPLTYTSLNELDEVHAIGAVWANVLYELLWNLIDKHGKNDGPKPEFKDGVPTDGKYLAMKLVIDGMALQPCNPNCVQARDAILDADKALTDGANKCEIWKAFAKRGLGEGAEYHASRRVGSDKVPSDAC

SEQ ID NO: 4772 - protein, 254 aa, Aspergillus oryzae
MHLAIKSLFVSLLGASVLASPLPSNALVERNAPLNEFLSALLSHLPAIDGTIDAVSGVITDFDQLLADLTGARTTQNGYIGVCTDYTVLFARGTSEPGNVGVLVGPPLSEAFEQAVGAKALSFQGVNGYNADVAGYLAGGDAAGSKSMASLASEVLSKCPDTKLVMSGYSQGCQIVHNAVEQLPAADASKISSVLLFGDPYAGKAFPNVDASRVHTVCHAGDTICNNSVVILPPHLTYAVDVTNAVQFAVAAAN

SEQ ID NO: 4773 - protein, 612 aa, Aspergillus oryzae
MVSFSSCLRALALGSSVLAVQPVLRQATGLDTWLSTEANFSRQAILNNIGADGQSAQGASPGVVIASPSKSDPDYFYTWTRDSGLVMKTLVDLFRGGDADLLPIIEEFISSQARIQGISNPSGALSSGGLGEPKFNVDETAFTGAWGRPQRDGPALRATAMISFGEWLVENGHTSIATDLVWPVVRNDLSYVAQYWSQSGFDLWEEVQGTSFFTVAVSHRALVEGSSFAKTVGSSCPYCDSQAPQVRCYLQSFWTGSYIQANFGGGRSGKDINTVLGSIHTFDPQATCDDATFQPCSARALANHKVVTDSFRSIYAINSGRAENQAVAVGRYPEDSYYNGNPWFLTTLAAAEQLYDALYQWDKIGSLAITDVSLPFFKALYSSAATGTYASSTTVYKDIVSAVKAYADGYVQIVQTYAASTGSMAEQYTKTDGSQTSARDLTWSYAALLTANNRRNAVVPAPWGETAATSIPSACSTTSASGTYSSVVITSWPTISGYPGAPDSPCQVPTTVSVTFAVKATTVYGESIKIVGSISQLGSWNPSSATALNADSYTTDNPLWTGTINLPAGQSFEYKFIRVQNGAVTWESDPNRKYTVPSTCGVKSAVQSDVWR

SEQ ID NO: 4774 - protein, 327 aa, Aspergillus oryzae
  strain ATCC 42149 / RIB 40
MVHLKALASGTLFASLASSAVISRQAAASINDAFVAHGKKYFGTCSDQALLQNSQNEAIVRADFGQLTPENSMKWDALEPSQGSFSFAGADFLADYAKTNNKLVRGHTLVWHSQLPSWVQGITDKDTLTEVIKNHITTIMQRYKGQIYAWDVVNEIFDEDGTLRDSVFSQVLGEDFVRIAFETAREADPNAKLYINDYNLDSADYAKTKGMVSYVKKWLDAGVPIDGIGSQSHYSANGFPVSGAKGALTALASTGVSEVAVTELDIEGASSESYLEVVNACLDVSSCVGITVWGVSDKDSWRSSTSPLLFDSNYQAKDAYNAIIDAL

SEQ ID NO: 4775 - protein, 403 aa, Aspergillus oryzae; identical to SEQ ID NO: 4462
  strain ATCC 42149 / RIB 40

SEQ ID NO: 4776 - protein, 363 aa, Aspergillus oryzae
  strain ATCC 42149 / RIB 40
MQLLQSSVIAATVGAALVAAVPVELKARDSCTFTSAADAKSGKTSCSTITLSNIEVPAGETLDLTGLNDGTTVIFSGETTFGYKEWEGPLISVSGTNIKVQQASGAKIDGDGSRWWDGKGGNGGKTKPKFFYAHKLDSSSITGLQIYNTPVQGFSIQSDNLNITDVTIDNSAGTAEGHNTDAFDVGSSTYINIDGATVYNQDDCLAINSGSHITFTNGYCDGGHGLSIGSVGGRSDNTVEDVTISNSKVVNSQNGVRIKTVYDATGTVSNVKFEDITLSGITKYGLIVEQDYENGSPTGTPTNGIKVSDITFDKVTGTVESDATDIYILCGSGSCTDWTWSGVSITGGKTSSKCENVSTGASC

SEQ ID NO: 4777 - protein, 213 aa, Aspergillus oryzae; identical to SEQ ID NO: 4449
  strain ATCC 42149 / RIB 40

SEQ ID NO: 4778 - protein, 221 aa, Aspergillus oryzae; identical to SEQ ID NO: 4511
  strain ATCC 42149 / RIB 40

SEQ ID NO: 4779 - protein, 404 aa, Aspergillus oryzae; identical to SEQ ID NO: 4523
  strain ATCC 42149 / RIB 40

SEQ ID NO: 4780 - protein, 387 aa, Aspergillus oryzae; identical to SEQ ID NO: 4555
  strain ATCC 42149 / RIB 40

SEQ ID NO: 4781 - protein, 435 aa, Aspergillus oryzae
  strain ATCC 42149 / RIB 40
MKFFLATLFASAVSSIAVDRLIPGAQIIPESDTRALLRVGGHHDKYHDRRTITIRPSRNDTDDVSRDFLWGIKHANHGGRLLLKKGEKYVIGRKLDLTFLDDIEVQLDGELKFTDDVSYWQENNFYYDFQKSITFWRWGGKDIKIFGTGLLNGNGQRWYNEFAGQEILDPDNEYYRPILFLTENATRISVEGITQLNSPCWTNFFIQSKDVSFDDVYIHAFSTNKSALPKNSDGFDSLNVDGLTVTNTRVDVGDDCFSPKPNTTNIFVQNLLCNNTHGVSMGSIGQYPGVMDIIEHAYIENVTLLNGQNGARLKAWAGQDVGYGRINNITYKNIRIENTDAPVVLDQCYFDIEAAECAQYPSQVNVTNILFENISGTSSGKNGKVVADLVCSPNAVCSDIQLKNINLTSPAGSPPEIICEGVQGDIGVECQASAD

SEQ ID NO: 4782 - protein, 257 aa, Aspergillus oryzae; identical to SEQ ID NO: 4549
  strain ATCC 42149 / RIB 40

SEQ ID NO: 4783 - protein, 751 aa, Aspergillus oryzae
  strain ATCC 42149 / RIB 40
MFGSPKRAALAAASLLAVFGNGPSVMAQETSSNNAVVADGKTFALNGENVSYRFRVNETTGDLVSDHFGGSITGNLFPGFGAEALGGWVGLAGRFRREFPDHGRGDFRIPAVRIRQEAGYTVTDLQYQSYSVIPGKPALPGLPSTFGSEEDVTTLVVHLYDNYSSIAVDLSYSIFPKYDAIVRSANVTNKGTQNITVEALSSFSFDFPYEDLEMISLRGDWAREAHRQRRKVEYGLQGFGSSTGFSSHLHNPFLAIVHPSTTESQGEAWGFNLVYTGSFSVDVEKGSQGLTRALLGFNPSQLSWQLGAGETLTSPECVSVYSSDGIGGMSRSFHRLYRNHLIKSKFATSDRPPLLNSWEGLYFDYNESTIYRLAEESAALGVKLFVMDDGWFGDKYPRVSDNAGLGDWVPNPDRFPDGLTPLVEDVTKLKAGNSSTDLRFGLWVEPEMANPNSTLYHEHPDWVLHAGQYPRTLQRNQLVLNLALPEVQDYIIDEITNILNSSAISYVKWDFNRAMHETPSPSNDHEYILGMYRVFDTLTTRFPDVLWEGCASGGGRFDPGVLEYFPQIWTSDNTDALMRITIQLGTSLAYPPSAMGAHLSAVPNAQTGRTIPVKFRGHVAMMGGSFGLELDPAELQEDEKAEVPGLIALAEKVNPIILTGDMWRLRLPEESNWPAVLFISEDGNQAVLFYFQLGPNVNHATPWLRLQGLDPKATYSVDGNGSYSGATLMNMGLQYKFESDYDSKVVFLQKQ

SEQ ID NO: 4784 - protein, 381 aa, Aspergillus oryzae
  strain ATCC 42149 / RIB 40
MKYASFIAAAAAALASAVSAAGVSGSAEGFAKGVTGGGSATPVYPSTTDELVSYLGDSEARVIILTKTFDFTNTEGTETSSGCAPWGTASGCQLAINKDNWCTNYEPNAPTVSSITYNKAGVLGITVNSNKSIVGQGSAGVIKGRGLRIVSGAKNVIIQNIAITDINPKYVWGGDAITLNEADLVWIDHVTTARIARQHIVLGTQADNRVTISNSLIDGRTDYSATCNGHHYWGVYLDGSNDMVTMMGNYFYYTSGRMPKVQGNTLLHAVNNYFHNIEGHAFEIGSGGYVLAEGNAFQNVDAPVESPISGQLFSAPDATTNEQCKSVFGRACQINAFGSSGSFSQADTAVISKFSGKNIATAHLAQNIPKWVMANAGQGKL

SEQ ID NO: 4785 - protein, 532 aa, Aspergillus oryzae
  strain ATCC 42149 / RIB 40
MRINTLSLFSLVSLVPTLALASLSGSVGPLTSASTKAATKTCNVLDYGAKADKTTDLGPPLASAFADCKSGGLVYVPSGDYALSTWAKLSGGKAWALQIDGTIYRTGTDGGNMIFIEHSSDFELFSSTSSGAMQGLGYEYHKDNKWSGPRLLRLYDVTDFSVHDFILVDAPAFHFSLDTCTNGEVYNMAIRGGNHGGLDGVDVWSTNVWIHDIEVTNKDECVTVKSPSKNILVENIYCNWSGGCGMGSLGKDTDISDITYRNIYTWNSNNMMFIKSNGGSGSATNLLFENFIGHGNAYSFDIDSYWASMSSQGGNGVELSNITLRNWKGTEENGASRGPIKIVCPDGAPCYDITIEDFAMWTEDSSRQRQWYSCRNAYGTGFCLKSGSNHVAYEATTTTVSSAPSGYSAATMAADLKTDFGITASIPIPTIPTSFYPGATPYSALMANKGSTAKVRAVVAPSKPTTVAAATSTPAEQQTSTSTPAPAVEQPSQQSPGQSAGEVGGCPFGNGRSVPTGPPRAGHRHHQRHGHH

SEQ ID NO: 4786 - protein, 416 aa, Aspergillus oryzae; identical to SEQ ID NO: 4546
  strain ATCC 42149 / RIB 40

SEQ ID NO: 4787 - protein, 833 aa, Aspergillus oryzae
  strain ATCC 42149 / RIB 40
MAAFSQYPLSTGWSFKDSDDQSPEAWMPVPVVPSVAHQDLQANQKLKNPYIGFNELDARWVNDKSWTYRTVFQKPAVAAGSSIILAFDGLDTFATVKLDGSVILQSDNMFLAHRVDVTKALEAEGDHVLEIDFDCAMRRARELREKDTKHNWASFNGDPARMAVRKAQYHWGWDWGPLLSTAGIWREVRLEVYSAKISDLWTEVELASDHQTARVSAFAEVDAADSVDSYKASFLLSLHGKEVAREVATLKDKVANVTFDVTQPSLWWPNGYGDPALYEISVSLEKEDCEIHSVSKKIGIRTAELIQQPDRHGKSFFFRINGVDVFCGGSCWIPADNLLPSITAERYRKWIELMVAGRQVMIRVWGGGCYEDDSFYQACDELGVLVWQDFMFGCGNYPTWPELLESIEKEANYNVRRLRHHPSIVVYVGNNEDYQVQESAGLVYDYEDKNPENWLKTDFPARYIYEKLLPSVVEKLSPKTVYHPGSPWGDGKITSDPTVGDMHQWNVWHGTQEKYQIFDTLGGRFNSEFGMEAFPHMSTIEYFVENEADKYPQSHVLDFHNKADGHERRIATYLTYVYLTQVVQAETMMFGYRGWRRQWGDERHCGGALLWQLNDCWPTISWAIVDYFLRPKPAFYAVARVLKPIAVGVRREHHDWSVTHAQPPKTSKYELWIASSLQKETVGTIELRFLSVNTGLDVRAPILRDNVKIVPNGTTNILEGVIDHKAQPEPHVLAARLWVDGEVTARDVDWPQPFKYLDLSDRGLEVNKVSESGNEQKLLITAKKPVKCLVFEERDGIRVSDSAMDIVPGDGQTVTVTGLKAGDAPLKYKYLGQ

SEQ ID NO: 4788 - protein, 229 aa, Aspergillus oryzae
  strain ATCC 42149 / RIB 40
MTTAAVFGSTGAVGGQILATLLASDAFSSVKTVSRRLPNAQSPKLQTLEEGDITKWGGLIASLSPKPSIVFNAVGTTRAAAGGIANQWKIDHDLCIENAKAAKEAGVKTYVFISSGGTRGFFSRYVPYSKMKIGVEDAIKELDFEQAIILRPGLILQREKPKAALLENIVQNLNKLGQGVQDMIGQDQTVIGRAAVAAARMAEEGKAPSKYWVLEQADIVRLGRDEWKQ

SEQ ID NO: 4789 - protein, 386 aa, Aspergillus oryzae
  strain ATCC 42149 / RIB 40
MKLNPSLLTAAGLVSAQLASALPQASSSTVSPSPSPSATPGSFVTTSGLNFVIDGKTGYFAGSNSYWIGFQKNNDDVDLVFSHLQESGLKILRVWGFNDVNQKPTDGSVYYHLLADGTATVNEGEDGLQRLDYVVSSAEKHGIKLIINFVNFWDDYGGINAYVKAFGGSKEGFYTNDAMQAAYRAYIKAVISRYSDSTAIFAWELANEPRCQGCETTVLYNWIESTSQYIKSLDSKHLVCIGDEGFGLDTGSDGSYPYQYSEGSDFAKNLAIPTIDFGTFHLYPSSWGTTNDWGNGWVTSHGAACKAAGKPCLFEEYGVTSDHCAVEKPWQNTALNTTAISGDLYWQYGDQLSGGPSPDDGNTFYYGTDDFKCLVTDHIAAINSRK

SEQ ID NO: 4790 - protein, 379 aa, Aspergillus oryzae
  strain ATCC 42149 / RIB 40
MKFALLSGVAAGLLPVVSAVSVSGAAEGFAKGVTGGGSAAAVYPTTTDELVSYLGDSSPRVIVLDRTFDFTGTEGTTTATGCAPWGTAAACQLAINQNDWCTNYQPDAPSVSVTYDNAGILGITVASDKTILGSGSSGVIKGKGLRIVSGASNIIIQNIAITDLNPKYVWGGDAITLNDADMVWIDHVTTARIGRQHLVLGNDADNRVTVSNSYFNGVSDYSATCDGYAYWGIYFAGSSDLITFKGNYIHHFSGRSPKVQENTLLHAVNNYWYDSTGHAFEIGAGGYVLAEGNVFQNIDTPVQSPIEGQLFTSPDTNTNTVCATYLGRNCEVNGFGSSGTFSQADTAFLVNFEGKNIASASPYADAQSSVPSSAGQGNL

SEQ ID NO: 4791 - protein, 375 aa, Aspergillus oryzae; identical to SEQ ID NO: 4543
  strain ATCC 42149 / RIB 40

SEQ ID NO: 4792 - protein, 797 aa, Aspergillus oryzae
  strain ATCC 42149 / RIB 40
MPLICIVYFLQYLDKIAISYASVTGLRESANLHGNQFNWVSTSTESIFPDCSTGPLSKNNVCDTSLDPVSRAKSLVAAMTLEEKINNTKYDSSGAPRLGLPAYNWWNEALHGVAEGHGVSFSDSGNFSYATSFPMPILLGAAFDDDLVKQVATVISTEARAFANGGHAGLDYWTPNINPFRDPRWGRGQETPGEDPLHLSRYVYHLVDGLQDGIGPERPKVVATCKHFAAYDLENWEGIERYAFDAVVSPQDLSEYYLPSFKTCTRDAKVDAVMCSYNSLNGIPTCADRWLLQTLLREHWGWEQTGHWVTGDCGAIDNIYADHHYVADGAHAAAAALNAGTDLDCGSVFPEYLGSALQQGLYNNQTLNNALIRLYSSLVKLGYFDPADDQPYRSIGWNEVFTPAAEELAHKATVEGIVMLKNDGTLPLKSNGTVAIIGPFANATTQLQGNYEGPPKYIRTLIWAAVHNGYKVKFSQGTDINSNSSAGFAEAISAAKEADTVIYAGGIDNTIEKESQDRTTIVWPGNQLDLIEQLSDLEKPLIVVQFGGGQVDDSSLLANAGVGALLWAGYPSQAGGAAVFDILTGKSAPAGRLPVTQYPASYVDEVPMTDMTLRPGSNNPGRTYRWYDKAVLPFGFGLHYTTFNVSWNHAEYGPYNTDSVASGTTNAPVDTELFDTFSITVTNTGNVASDYIALLFLTADGVGPEPYPIKTLVGYSRAKGIEPGQSQQVKLDVSVGSVARTAENGDLVLYPGSYKLEVDVGQDFPTATFTVSGKEKVLDEFPEPQQNATSAVTRRGR

SEQ ID NO: 4793 - protein, 328 aa, Aspergillus oryzae; identical to SEQ ID NO: 4554
  strain ATCC 42149 / RIB 40

SEQ ID NO: 4794 - protein, 222 aa, Aspergillus oryzae
  strain ATCC 42149 / RIB 40
MKAGDVVTAHWKDSGESPRISELVQYDLYLCAGGDTLGSQENLAILIKDGVFARGNSVSFKIDPAVGGNEPNAYFLKMVASGPDAHVINFSDRFTLTDMAGAFSSNLEDGIGLLSEGHGQQELRRRQAAGAYTIPYQLQTGPTRYAPMAKKPGSTIPADKSPTPQFPTSAYEIATAYLSAPTIQTTVSASLTYSVSSIENTASPAPHPHDKKMKRFLERWKD

SEQ ID NO: 4795 - protein, 406 aa, Aspergillus oryzae
  strain ATCC 42149 / RIB 40
MKVTRLAVLNTLATLTVAWLPTTDKTITSSNGTDLFKASHGKIRGVNLGSQFVFEPWIATKAWSELGCEGQESEFDCVMKLGQDAANKAFAKHWDSWITKEDIKEIRSYGLNTIRIPVGYWMNEDLIYHDSEYFPHGGFAYLEKLCGWASDAGLYIIIDLHGAPGAQVAKNAFTGQFADTPGFYVDFQYQRALEFLEWMTIKVHTLHNFRNVGMLEVVNEPVQNPQVTTTLRSNYYPNAFHSIRKVEGALSIDRKDYLHIQMMDGAWGAGDPHEHLTDDYYAAYDNHRYLKWDPRVEVSKDSYIKTSCNDNVATNWPAIIGEWSLGVPDNVQETADWKPYSNLDFYQKWFAAQVQNYEQHQGWIFWTWKTQLDEYRWSYRDGVKAGVIPTDLNAVFREDVCKGRSS

SEQ ID NO: 4796 - protein, 490 aa, Aspergillus oryzae
  strain ATCC 42149 / RIB 40
MRIGNLIVAASAASLVHAYPTRDIKKRGSGFTWVGVSESGAEFGSSIPGTLGTDYTWPDTSKIQVLRDDGMNVFRIPFLMERLAPNQMTGSLDATYLKDLKSTVQAVTDSGAYVVLDPHNYGRYSGSIISSTSDFKTFWKTVAGEFASNEKVIFDTNNEYHDMEQSLVLSLNQAAIDGIRAAGATTQYIFVEGNSYSGAWKWADTNDNLSQLTDPQDKIVYEMHQYLDSDGSGTSETCASSTIGKERLQTATEWLKTNNKKGFLGEFAGGVNEQCEQAVEGLLSYMSDNSDVWMGAEWWSAGPWWGSYMYSMEPTDGTAYSTYLPILKKYFVDGAGASTSSSATSAAPSTAAASTSTSVSASTSSASSTTISAVESSSTSSVAEAPSTTSGVVTATPTPSHPAPQPTSNSSSASSGAPTSSAPTTLATSPACGYQTTVTVTASRSTAAPSSSAGAVAHYYQCGGINYSGPTTCESGYTCVKQNPYYSQCL

SEQ ID NO: 4797 - protein, 326 aa, Aspergillus oryzae; identical to SEQ ID NO: 4489
  strain ATCC 42149 / RIB 40

SEQ ID NO: 4798 - protein, 221 aa, Aspergillus oryzae
  strain ATCC 42149 / RIB 40
MNLRLLTLALAAVAAASPVDIQERQLSGGNELRDGSCKPITFIFARASTEPGLLGISTGPAVCNGLKMAKAGQVACQGVGPKYTADLASNALPENTSPAAIQEAQDLFQQAVTKCPDTQIVAGGYSQGTAVMDDSIKRLPDNVKEKIKGVVLFGYTRNAQEHGQIANFPKDKVKVYCAVGDMVCDGTLIVGPAHFTYLGNTGEATQFLLGYLRFLQLTQLP

SEQ ID NO: 4799 - protein, 528 aa, Aspergillus oryzae
  strain ATCC 42149 / RIB 40
MLSRTILFSTSFLWVRVANAAFGITTSDDSYVIDAGSANPLKFTVSRSSCDITSINYYGSELQYSGTGSHIGSGLGSADVSAVEDGDYIKVTCDTDTLTQYFVVHNGDSVIHMATYTTEEPSVGELRFIARLNSELLPNEEPFGDVSTTSGGEAIEGSDVFLVDGETRSKFYSSQRFIDDQRHCVAGDAHRVCMILNQYETSSGGPFFRDINSNNGGSYNSLYWYMNSGHVQTEDRRQGLHGPYSMYFSRSGTPSTDIDTSFFANLDIKGYVATDGRGTVSGTASGADSSFKWVVHWYNADAQYWTYTSSDGSFTSPAMKPGDYTMVYYQGEYKVAETSVSVTVGSSTSKDISGSVETGDTIFKIGDWDGTPTGFRNAENQLRMHPSDSRMSSWGPLTYTVGSSELTDFPMAAFKGVNDPVTIKFTATSAQTGAATLRIGTTLSFAGGRPQATINDYEGSAPSAPTNLNSRGVTRGAYRGLGEVYDVNIPSGTIVEGENTITISVISGSSGDEFLAPNFIFDCVELFQ

SEQ ID NO: 4800 - protein, 181 aa, Aspergillus oryzae
  strain ATCC 42149 / RIB 40
MAGKAYWYSGDDPGMHFLCTPCKSRTCIEPRIYKSRIKMQFTSFKALAIFAASFFAFSAAAHPSCETGAVWADPHDCHSFFECAAGGIPVRKTCGPGTAYNSRFGICDYEEKVRSCHGHGPVGHDESSEGHGHQWKDHGNGQSEGHGQEGKKDSKGQSSEGHGQGTQEHGSGEQEHSEGSH

SEQ ID NO: 4801 - protein, 224 aa, Aspergillus oryzae
  strain ATCC 42149 / RIB 40
MVMLRSLLVSALAALAAGSPIAEPADQSLEARQLGSSNDLTNGACKDVTLIFARGSTEMGNMGTVIGPPLCSSLKSKLGADKVACQGVGGLYTGGLMQNALPQNTDPGAISTAKSLFEQASTKCPNTQIVAGGYSQGSAVIDNAVQQLSAEVKDKVKGVVFFGFTRNLQDKGQIPNYPKDNVKVFCAMGDLVCDGTLIVTAAHLTYTINAPEAASFLASKVQSA

SEQ ID NO: 4802 - protein, 377 aa, Aspergillus oryzae
  strain ATCC 42149 / RIB 40
MRFLPCIATLAATASALAIGDHVRSDDQYVLELAPGQTKVVTEAEKWALRAEGKRFFDITERASSLELASNKKQKLAVTYPDSVQHNETVQNLIKSLDKKNFETVLQPFSEFHNRYYKSDNGKKSSEWLQGKIQEIISASGAKGVTVEPFKHSFPQSSLIAKIPGKSDKTIVLGAHQDSINLDSPSEGRAPGADDDGSGVVTILEAFRVLLTDEKVAAGEAPNTVEFHFYAGEEGGLLGSQDIFEQYSQKSRDVKAMLQQDMTGYTKGTTDAGKPESIGIITDNVDENLTKFLKVIVDAYCTIPTVDSKCGYGCSDHASATKYGYPAAFAFESAFGDDSPYIHSADDTIETVNFDHVLQHGRLTLGFAYELAFADSL

SEQ ID NO: 4803 - protein, 634 aa, Aspergillus oryzae
  strain ATCC 42149 / RIB 40
MRGLLLAGALGLPLAVLAHPTHHAHGLQRRTVDLNSFRLHQAAKYINATESSSDVSSSFSPFTEQSYVETATQLVKNILPDATFRVVKDHYIGSNGVAHVNFRQTAHGLDIDNADFNVNVGKNGKIFSYGHSFYTGKIPDANPLTKRDYTDPVAALRGTNEALQLSITLDQVSTEATEDKESFNFKGVSGTVSDPKAQLVYLVKEDGSLALTWKVETDIDSNWLLTYIDANTGKDVHGVVDYVAEADYQVYAWGINDPTEGPRTVISDPWDSSASAFTWISDGENNYTTTRGNNGIAQSNPTGGSQYLKNYRPDSPDLKFQYPYSLNATPPESYIDASITQLFYTANTYHDLLYTLGFNEEAGNFQYDNNGKGGAGNDYVILNAQDGSGTNNANFATPPDGQPGRMRMYIWTESQPYRDGSFEAGIVIHEYTHGLSNRLTGGPANSRCLNALESGGMGEGWGDFMATAIRLKAGDTHSTDYTMGEWAANKKGGIRAYPFSTSLETNPLTYTSLNELDEVHAIGAVWANVLYELLWNLIDKHGKNDGPKPEFKDGVPTDGKYLAMKLVIDGMALQPCNPNCVQARDAILDADKALTDGANKCEIWKAFAKRGLGEGAEYHASRRVGSDKVPSDAC

SEQ ID NO: 4804 - protein, 639 aa, Aspergillus oryzae
  strain ATCC 42149 / RIB 40
MHMLLFIGALALPVFVCTQSCEPASLSPRLAGVDLEKFRLTPNAEYVDSDQQIPISTTNVGLIEQSYVETAIKLVRETFPNATFRLREDHYVGDNGVAHVHFRQTVHNLDVDNGDFNVNVGRDGSVFSYGNSFYTGPVPSITQLTKRDFTDPVAALKFALTHLQLPITAEDVSVESTKHPHKYVLRGTSGAVTNPKARLVYFVKPDGTLCLVWRVETDVDDNWLLTYVDAKTAEEIHGVVDYVSEATFQVYGWGINDPGQVDSRAVLTDPWDLKESPLTWFRDGQKNWTTTRGNNGIAQENINNLPTYLNNFRPDSPTQNFSYEYPAGGSPKDYINASITQLFYTANAYHDLLYTLGFNEKAGNFQWNNSGLGGKEKDYVILNAQDGASRNNADFATPPDGSPARMRMYLFTHTTPPRDGVFESGIVIHEYTHGLSMRLTGGPDNSRCLSAFESASMGEGWGDFMATAIRLKPSDTRATDYGMGMWVYNNEKGIRQYLYSTSMETNPLNYTSLNRMWEAHAGGTVWASMLYEVLWNLIDRHGKNDGPRPTFDERGVPKDGKYLAMKIVIDAMALQPCNPDFVQARNAILDADQALTGGQNKCEIWTGFAKRGLGQGAEYGRGRRVGSYDIPGDVCQKKI

SEQ ID NO: 4805 - protein, 1375 aa, Aspergillus oryzae
  strain ATCC 42149 / RIB 40
MLNIMTRRVLSATLFILQCASALPALNSSIETYHFPEGLDRAHSYGIQVKQSTGGVHTVESYSAIVSEANTTSGKGIEHNTSFALFDFEGSVDLIVTYNNGPVKSAVIRPYSYGIKPTVKGNTVSFSLDRPRNVVLQVNDDIFDTLQLFTNAIETDIPSQRDPNVVYFGPGIDNGPSSKNGTLVIPSGKAVYLAPGAVVTSRLAFQNATSGSIQGRGVINPRSSGGILIEWSSNILVKDILILGAKGFSVTTGTSKNITMSGIRSMSSTGNGDGIDFFCSEDVLIDGVFLRNSDDNIALYQHRWNYYGNSKNITVQNSSLWADWAHPINIGTHGNTDKPETMDGVTIRNIDILDHREPQMWYQGCIAINPGDSNLIQNVHIEDVRVEDFRLGQLLNFRVMYNSKYNTSPGRGIRNVYVKDLVYNGSHANPSLFLGYDKDRNISNVTFVNLQVNGKLIDDNMAKPSWYYTADFVPMVDWFHSLLNPKLRRFFPMYRDLSWQEPLFFESTMEAPSRRVGILPKREIVNKSSHWCYAMIFTWTPPDEAFGETPPLLPALLFSFHAGVKQTPQSCNGCPVGNWHSMRQHGRNGRSAQDQPPQQQQGQDTSKPEDDIPACQSCRKKKARCSREQPCSQCERFGVACVYDDRRLKPGLRAGAVDQLYRRIDTLENMFLGQSILWKQVWEALHPNSAFPSAPDENLHNEESTGRQLAGARDAMKKSMLQLAETKDTEGPSIESEHNGDGDCRSPKRRKVDLMSTPQQPSRNATDFDILNSDLVHPLVEFYFTNIHHWIPILHVRRFREQIQFYKGRQKATYILHAIVALCSRFSDDSRLGSDAEKAELAEKCRQKVILSSMESFSVENLQALVIIAFDTIGRGRGPSSWSIVGGMARTVEQLQLSVEEEHLSSHSQSGETLIRRMAFLKPSTSWREAEERRRVFWTVFLMDRFCSVSTGWNISLTSADVKRRLPCEGALWEQETEVRPPYFGISDARAASPHRPLLTESRMAADPKEQDCIGGFAYCIEATESLALVTNFFLHHALDIRDADKAQLWLMRFKELDLRMVQWKLFLPPKWRDASVLNADGIMDPNLTLAHTTHNTAVILLHQGIAYPPLHWQSCPVKLPSTSSAETCLEAASEISTIGQQFLLCSSILTNPQFSFCLFIAGRMLLTHSKYYGTPIPNSLDSLIASLFEISRRWAGPQNVHDNLKDNLASGFAKRLVSAKDSFPTLSKPSLDIRQTAYSENTDHRAPPKRVETISTPSVLERSSVVPNNTYAEQEPPLPIPDNHSDTSSFTDVDPFGISLTDRDQFNSQPSHVSIWNNATSPLYASAPIALDCASPEHPPTTLSPGQRISRYGAVEVDRAVVMGENHAHLNHNS

SEQ ID NO: 4806 - protein, 317 aa, Aspergillus oryzae; identical to SEQ ID NO: 4526
  strain ATCC 42149 / RIB 40

SEQ ID NO: 4807 - protein, 467 aa, Aspergillus oryzae
  strain ATCC 42149 / RIB 40
MHSLSLISLALLSPLLVNAQLSGHVGPLTSSSSKASTKTCNVQDYGAKADKETDIGSAIEKAWDDCAEGGVVYIPSGDYAMFSRLKLSGGKASAIQLDGIIYRTGSDGGNLFMIEHSSDFEFFSSTSQGAIQGLGYEFHKDGSLNGPRLLRFYDVTDFSVHDVALVDSPAFHLSLDTCKNAEIYNMAIRGGDSGGLDGVDIWSENVWVHDVEVTNKDECVTVKSPAKNILVENIYCNWSGGCAMGSLGADTNISDVVYRNVYTWKSNQMYMIKSNGGSGSVSNLVLENFIGHGNAYSLDIDGEWSSMSTVSGDGVQLNNITVRNWKGTEEDGAARGPIKVVCAEKAPCTDITIDDFALWTESGDEQTYSCENGFGSGFCLQDGDGTSSYSTVITETAAPTGYEASSMSNDLSTAFGTDASIPIPTIPTSFFPGATPYSALAGAASGNAAKATSSATASRFRHRRGSH

SEQ ID NO: 4808 - protein, 228 aa, Aspergillus oryzae
  strain ATCC 42149 / RIB 40
MFSRIALLPAFLPVALACLGYEGGVPTPTAHYSNSAVIEIAAGEVFDAGWAKYDRGSGACGGQTEGDWKDDVFYLHSGATLKNVIIGADQSEGVHCDGACTLEFVWFEDVCEDAISIVRPKSTTRLTSPLTIHPEKRQRRRRNLDHRRWSLSRRRQGRPAQRLRYCEPSASATCMSRVPLPVMVVRLLASTRALETLLLWSMSALMRIILVFCMTDVRVIGLLLGELQ

SEQ ID NO: 4809 - protein, 463 aa, Aspergillus oryzae
  strain ATCC 42149 / RIB 40
MRSLSSIALLSVVGAASAQAGPWAQCGGKSFSGSSECASGWKCQELNEWFSQCVPGAESTTPTVSSTPTPTDAPSVSITASVTTGINKSISVSSASKSTPLPSSSSASPSPRPTGSGSFAKADGLQFSIDGETKYFAGTNAYWLPFQMNDADIDSVFDHLEQAGLKILRVWGFNDVNTAPSPGTVYFQLHDKEKGTSTINTGKDGLQRLDYVVAAAEKHGVKLIIPFVNSWDDYGGYNAYVKAYGGSKTEWFTNEKIQSVYQAYIKAVVSRYRDSPAIFAWELGNEPRCSGCSTDVIHGWATKISAYIKSLDPNHMVALGDEGMGLTIGSDQSYPYGTSEGNDFEKNLAIPDIDFGTLHLYTTDWGIKDNAWGNGWVENHAKACKAAGKPCLFEEYGMKGNHCTDELKWQKTSLSSGTAADLIWQYGQQLSTGESPKDAYSIFYGTDEWKCAVMDHMENVNKN

SEQ ID NO: 4810 - protein, 815 aa, Aspergillus oryzae; identical to SEQ ID NO: 4529
  strain ATCC 42149 / RIB 40

SEQ ID NO: 4811 - protein, 416 aa, Aspergillus oryzae
  strain ATCC 42149 / RIB 40
MNLWLLTLWVTLVTAWVDNQGTTCTLYPESLTHQGQEVDDSPSIQQAFDMCGTNGTVIFSENVFHVNTVLNTTNLLNCDVHLRGELRFSANVPYWRTHAISVVLQDQVTAWLFGGHNVSFYGEGGFYNGNGQAWYNANRNESNQAGRPMSFTVYNSTDLRVDGLRVIQPQFWATFVWASKNVSFTNLFVNATSDSEWGTMNTDGFDSWQSDNLLVENATIIMGDDCIAAKGNTTNLLAKNIYCEGGTGVTIGSIGQYPEMPDYNLNITFENVTIKDAMDGAYIKTWQGTRIFTPSNGDWGGGGTGLVKNVTFRDFVMDNVGLPIQVAQCVYSAGSNKSCNTSTLQIEDVKWENIRGTSRFNIASSIYCSDEVPCPNMSFENVNITSLNATRGQAYYDTDIQYELFQCTNVVDHLGN

SEQ ID NO: 4812 - protein, 313 aa, Aspergillus oryzae
  strain ATCC 42149 / RIB 40
MSITIDTSVDIDLPTPPQSNGSQKRNLLLAPPSVAAHEEKLRDVFSTFDRSSTDLQMFDRLSAGFVSLPPNTYDLVLVLTDAQSDEAVRLLTRDVYTALVPAMKAGARLQLQQGSLGASEGLEAILAGLVEKDGGFEKPVQEAAVPLKLGGRKKKDKTNGVNGVQNGVATNGASTNGVGMFDPAQNNDDELIDEDALLSDDDLKRPLPRPQNCVPETAKKRRRPCKDCTCGLASQLEEEDRAREAKAAQDLNILKLNTDDLNDELDFTVQGKTSSCNSCSLGDAFRCSSCPYIGLPPFKPGEEVKIMNDMVQL

SEQ ID NO: 4813 - protein, 695 aa, Aspergillus oryzae
  strain ATCC 42149 / RIB 40
MFLPSRKALAFLACLASHSVALLTTSENSTHFNLANDRFSIALAKSNGHIVDVQLDGQDLLGPVDGNAGKGPYLDCSCIPSGFWTPGSGAHLELINGTDSTGTAYGGLYMSATYAGTNQTLSQWFFLRGEETGLHAFSRVTYFNETTPSLRSLGELRTLFRPSTDLWTHFSTSDGNYGPKPLGSNSGLVVQDATTYIGNVTDDPYVSQYSDYFTKYTLAESWRNHDVHGLFSDGSSSSDGSTFGAWLVHNTVETYYGGPLHSDLVVDGIVYNYLVSGHHGAPTPNLTHGFDRTWGPQFYYFNRGDSETTLADLRADAAKYADPEWNAEFYDSIADHIPNFTPSTGRTTFKGKVSLPKGAKRPIIVLSEDGQDFQLNVFNTESLQYWAEIDKSGSFSIPRVVEGTYRITIYADEIFGWFIQDHVKVLKSQSKDYSFTWKEESAGKEIWRIGIPDKSSGEYLHGYAPDTSKPLQPEQHRIYWGKYDYPADFPEGINFHVGKSDPSQDLNYIHWAFFPSQGNHLRTEPYYDNVNNWTVTFDLTADQLHNTNTATFTVQIAGAKTANGNAKWTPVEGKYSNLPWTVNVNGRYESTWVIPYWRSGSCGVRSAVSCQNIEQKFAFPSKNLQEGKNEFVLSLPFNASSTETALLPDALYVQARVMGSRLDPARPAPNPLVNSNLGFGRDNPIMEFSNNRIIT

SEQ ID NO: 4814 - protein, 431 aa, Aspergillus oryzae
  strain ATCC 42149 / RIB 40
MLDFMDYIQLAFAEGTNWNRDNSYSSLTATAQSLLDFSTPERLRVHLSSLSTPNFATSYTLGTVGLIDGSVSYLYSTVPFTNTPSRSALIPLRKLSPGYRQVAPPSAPIEDWNLDSILDNPQNVQPSFASKPTLLHATLHLPPPTTLNALFLRRISPTMHLTLAVCSTRGPPLSKSAPQASLLMQLSHDTGKYSNEYLFSTDNALFGWRGLWNFGPDPRSSTDTAAPRLSLLSAGAEAYYSPVSSLIGMSTGLRFSTLPAATDVPASTATGFATANQSTPISTFPYTLTLTLTPLTGSLSTTYSLRASPNLAFSSRFGFNVYSWESEMVAGCELWRKSRKQDDGLEWARRKMRASEPLSLPSLPAESKERQEEEEATDSVLKIRVDQSWNVRVLWEGRVKELLVSAGVGLGPSDTAFAWMYIFSVRAGLNR

SEQ ID NO: 4815 - protein, 650 aa, Aspergillus oryzae
  strain ATCC 42149 / RIB 40
MDKHRRDESPSGLSDIVEHDGLLGTGLTTRHIEAFGRKVTSTAGHLIGPTGDGNPAHYHNAMADIQRELRRPNTQRRVFALTQTTPTDLVRSKLSTSEIQSRALSSLPDDLLANIPDDSSSYSLFEGFQASQDDIEYRKAHRRRASKSKKLLKDGENRAALPSAPAELKKERDLLSRRMELMGVRKNMCSSEIHDIDNKIANLHNMRKIVLDRLAGLEMEEAELEHELTELENKLEDIQEETPETAVVGTPKSSANDESMASEDPAMDASFMSESIYQKIPSPKSLKHKSKRKRSMPILHEHFSPGSLIKEMEAHTDMVTAIDFDYPFGTMITAALDDTVRVWDLNVGRCTGFLEGHNASVRCLQIEDNIVATGSMDASVKLWDLSRARSRPRSSRINKHEDEEDAADDASQVSHSTTLEDCHVFSLDSHVGEVTALHFRGDNLISGSADKTLRQWDLVKGRCVQTLDVLWAAAQADTLNGDSTWRPSGRVPDASADFVGALQCFDAALACGTADGMVRLWDLRSGQVHRSLVGHTGPVTCLQFDDVHLVTGSMDRSIRIWDLRMGSIYDAFAYDKPVTSMKFDAKRIVAAAGESVVKVYDKADGNHWDCGAGVGADEQGPLPATVDRVCLKDGFLVEGRQDGIVGAWTC

SEQ ID NO: 4816 - protein, 1022 aa, Aspergillus oryzae
  strain ATCC 42149 / RIB 40
MLISKTVLSGLALGASFVGVSAQQNSTRWPLHDNGLTDTVEWDHYSFLINGQRHFVFSGEFHYWRIPVPELWRDLLEKIKAAGFTAFSIYNHWGYHSPKPGVLDFENGAHNFTSIMTLAKEIGLYMIIRPGPYVNAEANAGGLPLWTTTGAYGKLRDNDPRYLEALTPYWANISKIIAPHLITNDGNVILYQIENEYAEQWLDEETHEPNTSGQEYMQYLEDVARENGIDAPLIHNLPNMNGHSWSKDLSNATGNVDVIGVDSYPTCWTCNVSECASTNGEYIPYLKLTYPQISYFKELSPTQPSFMPEFQGGSYNPWGGPQGGCPDDLGPDFANLFYRNLISQRVSAISLYMLYGGTNWGWHASTDVATSYDYSSPISENRKLIEKYYETKVLTQFTKIAQDLSKVDRLGNSTKYSSNPAVSVAELRNPDTGAAFYVTQHEYTPSGTVEKFTVKVNTSEGALTIPQYGSQITLNGHQSKIIVTDFKFGSKTLLYSTAEVLTYAVIDGKEVLALWVPTGESGEFTVKGVNSAKFADKGRTANIEIHPGTNNVTVSFMQRSGMSLVELGDGTRIVLLDRSAAHVFWSTPLNNDPAEAGNNTVLVHGPYLVRSAKLEGCDLKLTGDIQNSTEVSIFAPKSVCSVNWNGKKTSVKSAKGGVITTTLGGDAKFELPTISGWKSADSLPEIAKDYSATSKAWVVATKTNSSNPTPPAPNNPVLYVDENDIHVGNHIYRATFPSTDEPPTDVYLNITGGRAFGYSVWLNSDFIGSWLGTATTEQNDQTFSFSNATLSTDEDNILVVVMDNSAHDLRDGALNPRGITNATLIGPGSYSFTEWKLAGNAGFEDHLDPVRAPLNEGSLYAERVGIHLPGYEFDEAEEVSSNSTSLTVPGAGIRVFRTVVPLSVPQGLDVSISFRLTAPSNVTFTSAEGYTNQLRALLFVNGYQYGRFNPYIGHQIDFPVPPGVLDYNGDNTIAVTVWSQSVDGAEIKVDWNVDYVHETSFDMNFDGAYLRPGWIEERREYA

SEQ ID NO: 4817 - protein, 629 aa, Aspergillus oryzae
  strain ATCC 42149 / RIB 40
MVALSTLSGLSALPFLFSLVQNVYGVSLEVSTEKGNSSSPILYGFMFEDINHSGDGGIYGQLLRNNGLQGSKPGLTAWAAVGDATIAVDAQNPLTEAIPHSLKLDVKQGASGAVGFTNEGYWGVPVDGSEFLNTFWIKGNFSGDITVRLVGNNTGTEYGSTKISQSSNSSNFTKVLAKIPTKKAPDGAVLYELTVDGASVGGSSLNFGLFELFPQTYKSRSNGLKPQVAQPLADMKGSFLRFPGGNNLEGASEARRWKWNETIGPVENRPGRQGDWSYYNTDGLGLDEYFYWCEDMGLTPVLGVWAGFALESGGNTPITGDALKPYIDDVLNELEYVLGDASTKYGSLRASYGRKEPWKLTMVEIGNEDMLGGGCESYVERFTAFSDAIHAAYPDLTIIASTDQSSCLPSKLPEGAWVDYHNYNTADNLVKQFSQFDNKDRSVPYFIGEYSCQQDNAWPFMQGSVAEAVYMIGIERNSDVVKMAAYAPLLQLVNSTQWTPNLIAFTQNPSTVIETTSYYVQQMFSVNRGDTIHNVTSDSAFGPVYWVASSADDKYYVKLANYGADTQEITVTISGKTGGKLTVLADSDPKAFNSDTQTLVTPSESDMKATNGKFTFTLPAWSVGVLAAH

SEQ ID NO: 4818 - protein, 432 aa, Aspergillus oryzae
  strain ATCC 42149 / RIB 40
MQSKTFSVLSSCLLLIATVQGQLSGSVGPSTSISDKKAVKTCNVLDYGATNDNKTDVGQPIMNAFEDCGSGGVIYIPEGDYLIQEWVSLRNGTAFAIQLDGVIYRNGTTTSQGYMFGISGGSDFELYSSTSKGAIQGSGYLYHMNGEFTAPRLLHISDVSHWSVHDIALVDAPMFHFVIDDASNGEVYNMAIRGGNSGGLDGIDVSGDNIWIHDVMVTNKDECVTVKTGSHNFQIENIYCNWSGGCAMDSLGSGTNVSNIVYRNIYTWNSNQMYMIKSNGGDGEVSNLLFENFIGHGNAYSLDLDSEWSSMDTVDGDDGESRPPIRVICPEAIPCTDITIEDVDLWTEEGDSETYVCKNAFGSGACLKSDSSSTATYATTTTVTSAPSGYSATTMAADLTSAFGTDASIPIPTIPTSFYPGATPYSALAGSS

SEQ ID NO: 4819 - protein, 328 aa, Aspergillus oryzae
  strain ATCC 42149 / RIB 40
MKVTKKVLDQSLCCTALLALVGGAAAQCALPSSYSWTSTGALAEPKAGWAALKDFTNVVFNGQHIVYGSVADTSGNYGSMNFGPFSDWSEMASASQNAMNQGTVAPTLFYFAPKDVWILAYQWGPTSFSYKTSSDPTDANGWSAAQPLFSGTISDSDTGVIDQTVIGDDTNMYLFFAGDNGKIYRASMPIDNFPGDFGTQSEIILSDTKENLFEAVQVYTVDGQNKYLMIVEAMGANGRYFRSFTADSLDGEWTVQAGTESQPFAGKANSGATWTNDISHGDLVRNNPDQTMTVDPCNLQLLYQGRDPNASGDYNLLPWKPGVLTLQV

SEQ ID NO: 4820 - protein, 319 aa, Aspergillus oryzae; identical to SEQ ID NO: 4499
  strain ATCC 42149 / RIB 40

SEQ ID NO: 4821 - protein, 321 aa, Aspergillus oryzae; identical to SEQ ID NO: 4500
  strain ATCC 42149 / RIB 40

SEQ ID NO: 4822 - protein, 839 aa, Aspergillus oryzae
  strain ATCC 42149 / RIB 40
MPRLDVEKTIEELSLGEKVALTAGIDFWHTASVPRLNIPTLRMSDGPNGVRGTRFFNGVPAACFPCATALGATWDTELLHEIGQLMGEESIAKGSHIILGPTINTQRSPLGGRGFESFAEDGVLSGLLAGYISKGIQEKGVAATLKHFVCNDQEHQRMAVDSIVTQRALREIYLLPFQLAMRICRTACVMTAYNKVNGTHVSQNKEIITDILRKEWGWDGLVMSDWFGTYSTSDAINAGLDLEMPGKTRWRGTALAHAVSSNEVAEFVMDERVRNVLNLVNFVDGLNIPENAPEKALNRPQDQALLRRAAAESVVLMKNEEDILPLKKEKSILVIGPNSKVAAYCGGGSASLDAYYTVTPFEGVSAQSKGEVKFSQGVYSHKDLPLLGPLLKTADGKTGFSFKVYNEHPSESNRELIEQLHLVSSSGFLMDYVNPKIKSLTYYVDMEGLFTPEEDGVYDFGVTVVGTGQLFIDGELVVDNTKNQRQGSAFFGSATVEEKGSKELKAGQTYKVLFQFGTAPTSDLDTRGVVVFGPGGFRFGASRRVGQEELISNAVKLASEAEQVVVFAGLTSEWETEGYDRDHMDLPPGSDEMISRVLDVNPNAVVVIQSGTPVTMPWANKTKALLHAWFGGNECGNGIADVLYGDVNPSGKLPITFPVRLQDNPSYVNFRSERGRVLYGEDVYVGYRYYEKVDLAPLFPFGHGLSYTTFTRSDLTLTTTPEKPQYEESGEPITATVTVTNTGKVAGAEIVQLWVAPPATEVNRPVRELKGFTKVFLQPGEQKKVEIVVEKKLATSWFDEMREKWASEKGEYEVLVTGTGEGVLKSSFKVEKTRYWLGL

SEQ ID NO: 4823 - protein, 827 aa, Aspergillus oryzae
  strain ATCC 42149 / RIB 40
MALEIDYVLSHISQEDKIALLAGIDFWHTHPIPELNVPSIRSTDGPNGIRGTKFFAGVPAACLPCGTALASTWDQNLLREVGVLIGKECLAKGAHCWLGPTINMPRSPLGGRGFESFAEDPHLAGAMAASMITGCESTGVISAVKHFVGNDQEHERRAVDVLVTQRALREIYLRPFQIVARDAGPGALMTSYNKINGKHVVESKEMLDMVRQEWKWNPLIMSDWLGTYTTIDSMNAGLDLEMPGPSRYRGRYVESALQARLIKESTIDSRARKVLEFVQQASRAPVSAVETGRDYPEDRALNRNLCANSIVLLKNQNDILPLPKTIKKIALVGSHVRTPAISGGGSASLEPYYTVSLYDAVSEALPHTEILYEVGAYAHKMLPVIDRLLTNAVMHFYNEPVGTERILRATQPMSKTAFQLMDFNAPELNRGLFYATLTGDFTPDVSGVWDFGLTVFGTGLLYVDDELVVDNTTHQTRGTAFFGKGTVQELGSKTLNAGQTYKIRIEYGSANTSPMKAIGVVHFGGGAAHLGACLHVDSAEMVRSAVKAAAEADYTILCTGLNHEWESEGFDRSHMDLPPGIDALITSVLDVAANKTVIVNQSGTPVTMPWADRARGIVQAWYGGNETGHGIADVIFGDVNPSGKLPLSWPVDVKHNPAYLNYASVGGRVLYGEDVYVGYRYYEKVGREVLFPFGHGLSYTTFTVSPDVVFSQEVFRPEEPPTAAVKIKNTGKVAGAQVLQLYISAPHSPTPRPTKELHGFTKVLLQPGEERVAHIRMDKYATNFWDEIEGMWKSEEGIYEALIGTSSQNILAKGTFRVDRTRYWLGL

SEQ ID NO: 4824 - protein, 418 aa, Aspergillus oryzae
  strain ATCC 42149 / RIB 40
MKATDLFHVTALVAGALALEHQQPLIGDLSQDLNHIIDSSPLLSFHRALVQIPSISEHEKNVGEYVLDFLSSQNLTVEKQIVTPESDTEEERFNIYAYVGKNRQPDVLVTSHIDTVPPFIPYSLHAPTSGTSFIRTDLVIAGRGTVDAKASVAAIVFAALETLDENPNASIGLLFDVGEENSGVGMKHFSNSELNPTPPTYHTVIFGEPTELSLVAAHKGTLGFKLVAEGKAAHSGYPWLGESAISSLIPVLAHLDTLQDLPPEKGGLLRSETLGKSTLNIGRVHGGIAANVVPAHAEAAISVRLAAGTPEDTRTIIERAVAKVTSGDRSVYPDFGDRKAGAPPQYFDVDVDGFEVITVNYGTDAPALKIHDQRTQRVKRYLYGPGSILVAHADNEAITVGELEEAVRGYKRLIAASL

SEQ ID NO: 4825 - protein, 414 aa, Aspergillus oryzae
  strain ATCC 42149 / RIB 40
MFLSRVFCVLAALACVSAARETCVVPAGGSNATDDAPAIVHAFKKCGRGGKVVFKPTTYHIGSVMNITWLEDVDIDLGGTLLWGTNIQYWLNHSLPVGYQNQSTAFILGGNNVRIDGHGIGTLDGNGDTWYQWIKEQPNTSNYPGRPHAITFNGLTNSVVRGLRFLRSQMCHHVEFDSILVNNTGNVVSSSNTDGADTIRSSHITFNNWTVYNGDDSISLKGNSTDITITNSNLYNGLGIALGSIGQYKDQFETIERLKVSNVNFHSTLHAIYVKTWTADQNGYPPNGGGGGLGYISDVTAKDLKATSLRGAAFAISQCTRFSGAPGEGNCTNSEFQVRDISVLNLSGTTESNRVANLQCSAVAPCTDIALSGINLELKNGTAASEYLCGNVENQKGFECTGAVCEGGSATGEC

SEQ ID NO: 4826 - protein, 419 aa, Aspergillus oryzae
  strain ATCC 42149 / RIB 40
MRLTPSLISCLSLLHFTSALVAFPGAEGFGANAVGGRQGVVYVVSNLNDSGEGSLRDAVSQPGRIVVFSVGGVIEITDRIVVSKQVTILGQTAPGDGITVYGNGWSFSNADDAIVRYIRIRMGKGGSSGKDAMGIADGKNMIFDHVSVSWGRDETFSINGDVSNVTIQNSIIAQGLETHSCGGLMQTDGGVSLFRNLYIDNKTRNPKVKGVNEFTNNVIYNWGGGGGYIAGGSDGESNVNVIGNYFISGLDTSVTAFTRGNENFHAYVETNYYDSDKDGTLNGSELGVDSTNYGGMDLVTEKYDYPAVASVLSPDDALTYVTKYAGASKVRDSVDTQLVAQVESYGKDGALISDEADMGGAGDLDQGTTPTDTDGDGIPDDAEAELGTDPNTADSMDLDTSGYTFLEVWANSLVPSSYA

SEQ ID NO: 4827 - protein, 406 aa, Aspergillus oryzae
  strain ATCC 42149 / RIB 40
MISLNSIFLLSLVGLSRAAPSRSETSPDRTIKPRAACTPTAGGSSSTDDVPAIQEAITSCGDGGIIIIPADTTYYLNSVLDFKGCSNCDFQVEGLLQFTSSTDYWNGKTAMITVSDIDGLKLRSVTGSGVIDGNGQESWDKFAEDSSYKRPTLLYITGGSNIEVSGLRQKNPPNVFISVKGDTSNAQFTSLTMDATSNSDNLPKNTDAFDIGASTYVTISSVAITNDDDCVAFKPGANYVTVENVSCTGSHGISVGSLGKSSDDTVQNVYARNITMINSSKAAGIKTYPSGGDHGLSTVKNATFEDFIVDGCDYAFQIQSCYGEDDTYCEENPGDAVLEGIVVKGFTGTTSDKEDPVVANLNCGSKGTCDVTISGFEVKAPSGDAKILCGNTPSDLGVTCSSGASG

SEQ ID NO: 4828 - protein, 324 aa, Aspergillus oryzae
  strain ATCC 42149 / RIB 40
MHGSLLKLALLSFSLGSSAAVLPRDTGRTSAPSGCSTVGTSGDYSTIGDALTALGSSTADACIYIAAGTYEEQLVINYAGHLTLYGETTDTQTYKQNTVTITHTISSPEAGSLDNSATVNIKSDLVSVYNINIANGYGSGAQAVALVANADQLGFYACQFTGYQDTLYAKAGHQYYINSRIEGAVDYIFGDASAWFENCDIVSNGAGYITAMSRETTSDTAWYAIDHCNIKAASGVDLTGDVYLGRPWRVLARVIYQYSVLPDIINAKGWHSMADGATPLYYEFNNTGAGSDTSDREYLSTIDAPVTKETVLGDDYKNWVDLSY

SEQ ID NO: 4829 - protein, 318 aa, Aspergillus oryzae
  strain ATCC 42149 / RIB 40
MSHFPTLHILILVIANLQIQCFAFVSQSRGFCATGPPTESLKAEYRRLSALGSQSYNPVDSESRAAITPIVIDTWFHIITGEAGTELISDEMIADQLSYLQNAYWNATISYRLQGVTRSANDTWARNEDEMAMKTVLRRGSYRTLNVYFHTDLQASPNAGARAFDIVRRELGVSQQQPTSMLGFCTLPDPSINASSPPSTYIKDGCNVLAETMPGGSLAHYNRGGTAIHEIGHWNGLLHTFEGESCSSDNEGDFIADTPQQSKPTEGCPAQKDSCPELPGFDAIHNFMDYSSDECYDSFTPDQVSRMRSMWFAMRDGK

SEQ ID NO: 4830 - protein, 258 aa, Aspergillus oryzae
  strain ATCC 42149 / RIB 40
MAPITEEAVSGLKDIIGKLEARVEELESRLSNGFKPKSVAEHMRMVLMGPPGAGKGTQAPALKDKYCVCHLATGDMLRSQVAKKTELGKEAKKIMDQGGLVSDEIMVNMIKSELDNNSECKNGFILDGFPRTVAQAERLDDMLAARQQKLQHAVELQIDDALLVARITGRLVHPASGRSYHKVFNPPKQEMKDDITGEPLIQRSDDNAETLKKRLGTYHAQTAPVVDYYKKTGIWRGIDASQEPGQVWKSLLGVFQQN

SEQ ID NO: 4831 - protein, 455 aa, Aspergillus oryzae; identical to SEQ ID NO: 4477
  strain ATCC 42149 / RIB 40

SEQ ID NO: 4832 - protein, 375 aa, Aspergillus oryzae; identical to SEQ ID NO: 4476
  strain ATCC 42149 / RIB 40

SEQ ID NO: 4833 - protein, 1005 aa, Aspergillus oryzae; identical to SEQ ID NO: 4475
  strain ATCC 42149 / RIB 40

SEQ ID NO: 4834 - protein, 238 aa, Aspergillus oryzae
  strain ATCC 42149 / RIB 40
MRLRTSLGVASACASVASAALKVTEDNSTITLANDRLTSTFAKDKGRVSELFLDGQDLLGPISGNTGVGPYLDCYCIPSGFYTAGSTDPRLEVVQGTDSTGTKYAGVILNDTYTPTGQQFQQYWFLRDGETGLHTFSRLAYYNETTPFLRNLQEFRTLFRPNTELWTHLTSSEAQTAPLPSKEAIANEVVVQDATWRFNNTPNDAYYTQFSEYFTKYTFSNCMGLFKTYWYAASANLQ

SEQ ID NO: 4835 - protein, 768 aa, Aspergillus oryzae
  strain ATCC 42149 / RIB 40
MHAIAGLTGLLAGVSLSYAAPTHENITSDAYFYGQSPAVYPSPEGTGSGAWASAYEKAKAFVANLTPEEKVNLTAGTDADNGCSGNIPAIPRLNFPGLCVSDAGNGLRSTDHVNAWSSGIHTGASWNKDLAQKRGLHMGSEYHKKGVNVLLGPVVGPLGRIAEGGRNWEGFSVDPYHSGLLVYETIRGIQAAGVGTSTKHYIANEQETNRNPESTDGIDVAAVSSNIDDKTMHELYLWPFQDVVRAGSVSIMCSYQRINNSYGCQNSKTLNGLLKTELGFQGYVMTDWGAQHGGIASSNAGLDMVMPSSTLWNSNLTDAIANGTMEASRLDDMATRIIASWYQMNQDAGFPSPGVGMPADVYAPHQAIIGKSSDSRKVLLQSAIEGHVLVKNKNNTLPLKSPEMISVFGYDAKGPDSLGFALEWLSYSPAIQPNHTLIVGGGSGGNSPAYISAPLDALQQQVIEDGSSILWNISAQDPEVDPNTDACLVFINSYATEGYDRAGLVDEGSDELVTNVASKCSNTIVTIHNAGIRLVNNWIDHENVTAVIFAHLPGQDSGRALVELLYGRSNPSGKLPYTVAKSADDYGALLHPKLPEGQYGLFPQDDFSEGVYIDYRAFDKQGIEPQFEFGFGLSYTTFDYSGLNIGQVSDNSTSRYPPSAAIQEGGNPHLWDVILRVSVDITNSGPVAGDEVAQLYVGIPNGPVRQLRGFEKVNIPVGQTVTVEFALGRRDLSTWDVVAQEWLLQSGTYQVYVGRSSRDLPLQGEFTI

SEQ ID NO: 4836 - protein, 215 aa, Aspergillus oryzae
  strain ATCC 42149 / RIB 40
MNRDTYRSSNIVIQNSVINNGDDCVSFKPNSTEILVQNLHCNGSHGISVGSLGQYQGEVDIVQNVLVHNISMYNASRKKDMARIKVWPGISSAMSEDLQGGGGLGSVQNITYDKMYIENVDWAIEVTQCYGQKNQTLCNENPSNLTISDVYFNDLTGVTSGKNDPNVGTIICSSPDVCSGIHATNIDVKSPDGDSGFVCTNVDEEFLDVECASSS

SEQ ID NO: 4837 - protein, 153 aa, Aspergillus oryzae
  strain ATCC 42149 / RIB 40
MGSNLPYAADAESPLKPAELQVLRAQYEKEGDYVGIQTKFNFAWGLIKSNARPDQQEGVRLLSEIFRAAPERRRECLYYLALGNYKLGNYGEARRYNDLLLEKEPANLQAASLGTLIDERVSKEGLMGFAIVGGLALAAGLVGGMVFRGAKRR

SEQ ID NO: 4838 - protein, 447 aa, Aspergillus oryzae
  strain ATCC 42149 / RIB 40
MQVKLFYTLALWAPILVSAQLSGSVGPLVDFKTKAKNKTCDITDYGAVADGKTDVGPAILDAWGNCSTGGLIYVPPGTYSLATDLELKHGESTAFQLDGVLARGHEGSYQLILVRNCHDCEFFSGNSQGAVQGYGYEYLQDGNYGERLFRFQDVSDFSVHGFAAIDSPAYYLVFDTVSNGEIYNLLVRGIADLGMTDAFDIWGQNVWVHDIEVTNGDECVTVKSPASDFLIENIYCNLSGGTAIGSLGTGTNISNIHYRNLYMNQADACYLKTHNGDGIVKNIVWENVIVHRGPYPLAVNEAWGKDVGSTGVQVQNLTFRNWYGENTANSRPAIRIECDEDVPCYDITLDNVNLWTEDGDYVEWSCANAYGSGACLQEAKDTGDLATYTTAVTVTATPSYSATHMPGDFTTNPPSTAPFTIPPMPTSFYPGATPISTLLSLSGAGGL

SEQ ID NO: 4839 - protein, 292 aa, Aspergillus oryzae
  strain ATCC 42149 / RIB 40
MSAFASENLTSALLVVGTAIFAVLVGAKFLGGSGKPRKVLNPTEFQNFVLKEKNEISHNVAIYRFALPRPTDILGLPIGQHISLAATIEGQPKEVVRSYTPISSDNEAGYFDLLVKAYPQGNISKYLTTLKIGDNMKVRGPKGAMVYTPNMCRHIGMIAGGTGITPMLQIIKAIIRNRPRNGGNDTTQVDLIFANVNPEDILLKEELEQLVKEDDGFRVYYVLNNPPEGWTGGVGFVTPDMIKERLPAPAQDIKIMLCGPPPMISAMKKATESLGYTKARPVSKLEDQVFCF

SEQ ID NO: 4840 - protein, 835 aa, Aspergillus oryzae
  strain ATCC 42149 / RIB 40
MRWSFLTVLLWLVSLTGAENGFNGWLRYAPVQCDKRCQRALPSSIVTLNSTDSGPIGTASQELQAGLENIVGKQLSIKRSSCGSRSSILVATLEQYRQACNRSSEVPSLGIDGFWLRAYGDTVQIVGENERGALYGAFEYLSLLAQGNFSHVDYTTSAHAPVRWVNQWDNMDGSIERGYAGPSIFFEDGHIVEDLSRVKQYARLLASIRINGVIVNNVNANATLLTSQNMDGLARIANVFRPYGIQIGISLNFASPDTLGGLGTYDPLDPSVISWWANITDSLYDRVPDMAGYLVKASSEGQPGPDTYNRTLAEGANVFAKALQPHGGILMFRTFVYDHHINESIWTNDRANAQVDFFKELDGQFEDNIKYGPIDFQVREPVSPLFANLYKTNMAIELQVTQEYLGQQDHLVYLSPLWKELLDFDLRVDHQPSLVRDIVSGQRFDRQLGGWAAVVNVGTNTTWLGSHLAMSNLYAYGRLAWSPTDDSQGILQDWIRLTFGRDQNVLDAITDMSMASWPAYENYTGNLGIQTLTDILYTHYGPNPASQDNNGWGQWTRADHDTIGMDRTVKNGTGNAGQYPAEIAQVYEDLDSTPDDLLLWFHHVPYTHRLHSGKTVIQHFYDAHYDGAETAHRFLSQWESLKGRIDQQRYNEVLSRLVYQAGHSLVWRDAINNFYWNMSGISDEKNRLGHHPWRVEAESMTLDGYEPYTVSPFETASNYKAVVTTSNSTTGTAQTKLQFPSGTYDLGVNYYDMYGGKSEWTVYVNDRVVGQWEGNSENTLGHTPSIYIDGHSATRITFRGVEIENGDQLKIVGVPDGVEPAPLDYVVLLPPDVVD

SEQ ID NO: 4841 - protein, 638 aa, Aspergillus oryzae
  strain ATCC 42149 / RIB 40
MKVLAPGYLAEASLTALASGCQALSTRPYVPRGYSLSRRNDSTPIYKDASYCIDERVDDLLARMTIEEKAGQLFHTRLMDGPLDDEGSGNNAHNSTSNMIGEKHMTHFNLASDITNATETAEFINRIQELALQTRLGIPVTVSTDPRHSFTENVGTGFKAGVFSQWPESIGLAALRDPYVVRKFAEVAKEEYIAVGIRAALHPQVDLSTEPRWARISNTWGENSTLTSELLVEYIKGFQGDKLGPQSVKTVTKHFPGGGPVENGEDSHFAYGKNQTYPGNNLEEHLKPFKAAIAAGATEIMPYYSRPIGTEYEPVAFSFNKRIVTELLRNELGFDGIVLTDWGLITDGYIAGQYMPARAWGVENLTELQRAARILDAGCDQFGGEERPELIVQLVQEGIISEDRIDVSVRRLLKEKFVLGLFDNPFVDAEAAGRVVGNDYFVRLGREAQRRSYTLLSNNEDIVPLKKIEKSTKFYIEGFNASFIESWNYTVVDSPEEAEYALLRYNAPYEPRPGGFEANMHAGSLAFNDTEKARQAKIYSAVPTIVDIVMDRPAVIPEIIEQAKAVFASYGSDSNAFLDVVFGVSAPEGKLPFDLPSSMEAVEAQMEDVPFDTRNPVFKFGHGLSYANPCASSSSKCS

SEQ ID NO: 4842 - protein, 405 aa, Aspergillus oryzae
  strain ATCC 42149 / RIB 40
MQLGHAKLFLFFLSLFTPALSRRIGHKHTHVAEREAPACTPTAGGSPTVDDVPAIESAMAACPSGTIMIPAKSTYHINSELSFAKCSGCTLQVEGTLLVSDDTKAWSGKDAVLNLEDVNDVSIVSKTGKGVIDGNGQAAWDLLNKDKNYSRVKCLLYLTGKTSGVTISGLTMRNPPNVFSSVKQSVTNVTYSNLILTAVSKSDALPKNTDGFDLGGTGIRMDNIKVQNGDDCIAIQNGAEDITVMNIQCTGSHGLSIGSIGKTPGEVDTVKNIHFKNAKMTKCSKAAGIKIYSGGYGTAEVSNITWENVMVDGTSYAFQVQTCYGSDEKECASQPSTAKLTDIVVKGFSGKTDKDEPVASINCPAKGTCGLSLTEMKVQSATGGEEYQCSNAGTIGVKCAPGASG

SEQ ID NO: 4843 - protein, 771 aa, Aspergillus oryzae; identical to SEQ ID NO: 4485
  strain ATCC 42149 / RIB 40

SEQ ID NO: 4844 - protein, 367 aa, Aspergillus oryzae; identical to SEQ ID NO: 4484
  strain ATCC 42149 / RIB 40

SEQ ID NO: 4845 - protein, 353 aa, Aspergillus oryzae
  strain ATCC 42149 / RIB 40
MVLVATLFSLFTVSLCRSIPRSSPSSSPYTQATDLKIHDPTVINANGAYYAYGVGEHIVIHQAPGLAGPWKQIGSVLDKDSIIPKGDRAKPWAPTTIEVKGTFYCYYSVSNAGCRDSAIGVATSQSPGPGGWTDHGAIVQSGTGQGSDEHPFNEVNAIDPAVLVTGDKGHLVFGSYWSGIWQVPLNEDFSSVGNTTGLNAHHLAKHPKTERVNSQDQNPDPLCRDSSGRRPVEGAYISYHAPYYYLWLSWGQCCDYDPNNLPPSGEEYSIRVGRSESPHGPFVDKQGKELTQGGGELIYGSNNDVYAPGGQGVITVETGDILYYHYSLYRYSTHSLYTFANLDFNQGCTLFIQ

SEQ ID NO: 4846 - protein, 270 aa, Aspergillus oryzae
  strain ATCC 42149 / RIB 40
MIKSIILQAIMVLSTLTSVHGANSSGCGKQPTLVNGVHKINDREYILKVPDNYNANKPHHLIFGLHWRGGNMNSVVNGESVEPWYGLETRAQGSAILVAPNGRNAGWANINGEDVALIDAIIKQVEDDLCIDQSSRFATGFSWGGGMSYALACARAKEFRAVSVLSGGVISGCEGGHDPIAYLGIHGISDPVLPFDGGVTLANKFAANNGCQQTYVGKPGLGSHSSVQTDFKGCSRPVSFIAYDGGHDAAPLGVGNPLAPDATWKFFMAA

SEQ ID NO: 4847 - protein, 657 aa, Aspergillus oryzae
  strain ATCC 42149 / RIB 40
MLPKIFYLSLLPAALGHPHLQPRLDNGLARTPQMGWNTYNHYSCSPNETIVRSNAQALVDLGLASLGYRYVTTDCGWTVADRLSDGSLTWNETLFPKGFPALGKYLHDLDLLFGVYQDSGIKLCGSPPDNVGSLYHEDQDARTFASWEVDSLKYDNCYSDAATGYPNVNYEPSTSPQPRFANMSRALAAQNRSMVFQVCEWGIDFPARWAPALGHSWRIGNDIIPHWRAIYRTLNQAVPQTSFAGPGQWPDLDMLFVGNDILSIPEEQTHFSLWAILKSPLTIGAALKDDNTSINDESLQILKQEEVIGYNQDSLGVSASLRRRWTEEGYEVWSGPLSGGRTVAALINWKDEARELTLDLPDIGLQFAGTVKNIWDGTTAQNVKTSYTAKVQSHGTILLELQDTTASGQYPTDTFATSTDSSTTFESIYGVTTSFRYNITVKLSEASSSGDVNIQSTASNKTITAQVSASGTEASAQIPLLAGSSNSITIVSPQSVDAITITPPNGTYFPNTAFTTTGDADTVSCGAGYCQPVGSKIGNISTNGTARAVIPATAGTKYLAIDYINNDVAFDSAWDWGSNSRNLTVSVNGNKPVRIEVPLSGQHSELFGPGKGWWDTATIGVLTEGWKDGDNDVVIGNEGGESGFTSYGPDFVGLRVL

SEQ ID NO: 4848 - protein, 210 aa, Aspergillus oryzae
  strain ATCC 42149 / RIB 40
MKAIAALALVGGAIAAPTKTVESRQLPGMGSLPGLENGVTQNAGCQELTFIFARGTSEMGNMGSVVGPPVAKQLASLTGNKVTVQGVDYPADAAGNANMGASGGPKMAELIQQAKKQCPNTKVVVGGYSQGAMVVHNAASKVGADAISGAVLFGDPFKTQGVGQLASNKVKEFCASGDPVCLNGMNFMAHLSYGSNAQEAAQFLVQAAGL

SEQ ID NO: 4849 - protein, 506 aa, Aspergillus oryzae
  strain ATCC 42149 / RIB 40
MSSGLSLERACAVALGIVASASLVAAGPCDIYSSGGTPCVAAHSTTRALYSAYTGALYQVKRGSDGSTTDIAPLSAGGVADAAIQDSFCANTTCLITIIYDQSGRGNHLTQAPPGGFNGPESNGYDNLASAVGAPVTLNGKKAYGVFMSPGTGYRNNAASGTATGDKAEGMYAVLDGTHYNSACCFDYGNAEVSNTDTGNGHMEAIYYGDNTVWGSGAGSGPWIMADLENGLFSGLSSTNNAGDPSISYRFVTAVVKGEANQWSIRGANAASGSLSTYYSGARPSASGYNPMSKEGAIILGIGGDNSNGAQGTFYEGVMTSGYPSDATENSVQADIVAAKYAIASLTSGPALTVGSSISLQVTTAGYTTRYLAHDGSTVNTQVVSSSSTTALRQQASWTVRTGLANSACLSFESVDTPGSYIRHYNFALLLNANDGTKQFYEDATFCPQAGLNGQGNSIRSWSYPTRYFRHYENVLYVASNGGVQTFDATTSFNDDVSWVVSTGFA

SEQ ID NO: 4850 - protein, 254 aa, Aspergillus oryzae; identical to SEQ ID NO: 4772
  strain ATCC 42149 / RIB 40

SEQ ID NO: 4851 - protein, 442 aa, Aspergillus oryzae
  strain ATCC 42149 / RIB 40
MQRYISLSVSLSLLSGANALVRPDGVGRLPALGWNTWNAFGCDIDASKVLTAAEETINLGLKDAGYEYINIDDCWSVKSGRDPNTKRIIPDSAKFPDGISGVASKIHDLGLKVGIYSSAGTETCAGYPASLGYEKIDAESFAEWGIDYLKYDNCGVPTNWTDTYTHCVPDNSNGSKFPNGTCPDISNPAPTAYDWSSSNTAQRYNAMRDALLGVNRTILYSLCEWGQADVNTWGNGTGNSWRTTGDITPDWSRIVEIANENSFLMNYADFWGYPDPDMLEVGNGNLTLEENRAHFALWAAMKSPLIIGTALDSINEEHLAILKNKPLLSFHQDPVIGRPAYPYKWGYNPDWTFDPAHPAEYWSGPSSTLGGTLVLMFNSEDSAKHRTAVWSEIPELKDSAEKGSGYRVTEIWTGEDLGCVKDQYDVELQSHDIAALVVGESC

SEQ ID NO: 4852 - protein, 428 aa, Aspergillus oryzae
  strain ATCC 42149 / RIB 40
MVLLHPLLTAAALLGASARAQSVVGTPFGFASGTTGGGNAAPAAPKDTNELKEWLADPNPRVIVIDKEFNFIGTEDTCTDCECCIPDSNTCGDAGQNAIKTEGSDWCGSYPATTCTYDNAGLEGMEVASDKTIIGVGDAGVIRGKGLRLVNGVSNIIIQNVHITELNPQYIWGGDAISLDGTDKIWVDHVKVSLVGRQMFVTGYESSGGVTVSNSEFDGQTKWSASCDGHHYWSVLGYGKGDQITFANNYIHHTSGRSPKIEFDSHWHAYNNFWENNSGHAFDVGEGANVLIEGNVFSNVKTPMNPEDTPGSTFAVNAQDASSCTSALGRPCIANELTSSGELSGNDEAVLSGWPKGEGDTKAMTTDKVPSYVKANAGVGKLGSGGSGAASSSVSITPSPTSSAIPSSSATPSSSAYARRHYARHHHY

SEQ ID NO: 4853 - protein, 566 aa, Aspergillus oryzae; identical to SEQ ID NO: 4461
  strain ATCC 42149 / RIB 40

SEQ ID NO: 4854 - protein, 240 aa, Aspergillus oryzae; identical to SEQ ID NO: 4470
  strain ATCC 42149 / RIB 40

SEQ ID NO: 4855 - protein, 323 aa, Aspergillus oryzae
  strain ATCC 42149 / RIB 40
MFARQTFRCAQPLRQSFRKYSTEAPKAKSLAPIYTAVGLTGLSVGLYRYYYGAGATAEAPVERAKVFTGGDQGWVDLKLSEIEVLSHNTKRLRFEFEDKEAVSGVTIASALLTKFKPVGAEKAVLRPYTPTSDEDQPGYLDLVVKVYPNGPMSEHLHSMNVDQRLSFKGPLPKYQWETNKHEHIALIAGGTGITPMYQLIRQIFKNPDDKTKVTLVYGNVTEDDILLKKELQDLENTYPQRFKAFYLLDKPPKEWTGGKGYINKELLKTVLPEPKEENQKIFVCGPPGLYNAVSGNKVSPKDQGELSGILKELGYNKDQVYKF

SEQ ID NO: 4856 - protein, 146 aa, Aspergillus oryzae; identical to SEQ ID NO: 4464
  strain ATCC 42149 / RIB 40

SEQ ID NO: 4857 - protein, 100 aa, Aspergillus oryzae
  strain ATCC 42149 / RIB 40
MLATVFLIVASALTANAKLGINCRGSAKCSVLWGPSDAAQQLTNVIQHIDTNRWYMNGEHIACVGNQAGNGGGYCAFLQKTGGTNGGVIKNLAHYITDHG

SEQ ID NO: 4858 - protein, 487 aa, Aspergillus oryzae
  strain ATCC 42149 / RIB 40
MHPLLLLLYSTLALGQLIGPVGPTTPLSEKTTECNILSYGAVADNSTDISTALETTFNDCVRPNPGSRLVVPEGQYLLNRGVVLSNATNWAFQLDGLVTAAYGGNWEIERSLILQGFAGVDLLNETINGEGDHKFLLDVLVIVNAVDFEFYSSNGLGAFQGQGYLYRNLNNTDRPRLVRLISPTNASVHDLILVDSPKFHIILDFAVNVEAYHLTIRGANLGSYDGIDAIGTNYYIHDNEVTNRDECVSIKSPSHHALVENLVCNQAGSGLSIGSLNVSAEISNIVARNISILQGNNIAFIKTYPGGSGYVSNITFENFRSKASLYGLNINQYWQNTFTPDTGSVALSNIVYRNVTGSVADGAKRPPLYLIANDLTFATNVTVEDVSVWTETGDSVVNKISNVFGIGDGTYGVNDGIEELGVGEVPTAYTRTVTVTETPTGWVEPGLPAWAAPSTGFGTASPIPVYTPTPLWRPGGVDYDLHYWGSF

SEQ ID NO: 4859 - protein, 496 aa, Aspergillus oryzae
  strain ATCC 42149 / RIB 40
MRSLLWASLLSGVLAGRALVSPDEFPEDIQLEDLLEGSQQLEDFAYAYPERNRVFGGKAHDDTVNYLYEELKKTGYYDVYKQPQVHLWSNADQTLKVGDEEIEAKTMTYSPSVEVTADVAVVKNLGCSEADYPSDVEGKVALIKRGECPFGDKSVLAAKAKAAASIVYNNVAGSMAGTLGAAQSDKGPYSAIVGISLEDGQKLIKLAEAGSVSVDLWVDSKQENRTTYNVVAQTKGGDPNNVVALGGHTDSVEAGPGINDDGSGIISNLVIAKALTQYSVKNAVRFLFWTAEEFGLLGSNYYVSHLNATELNKIRLYLNFDMIASPNYALMIYDGDGSAFNQSGPAGSAQIEKLFEDYYDSIDLPHIPTQFDGRSDYEAFILNGIPSGGLFTGAEGIMSEENASRWGGQAGVAYDANYHAAGDNMTNLNHEAFLINSKATAFAVATYANDLSSIPKRNTTSSLHRRARTMRPFGKRAPKTHAHVSGSGCWHSQVEA

SEQ ID NO: 4860 - protein, 633 aa, Aspergillus oryzae; identical to SEQ ID NO: 4471
  strain ATCC 42149 / RIB 40

SEQ ID NO: 4861 - protein, 430 aa, Aspergillus oryzae
  strain ATCC 42149 / RIB 40
MKSIYSLVLCTALTAASPHPAFPQSPLGVPTTSSPSTGTFNSAEEVINASPFLSFHRDIVQIESISSNEHNVGEFIADFLRARNFTVIEQAVTSSSQTENQERFNVFAYPSSNTPEILITSHIDTVPPFIPYSLDTDSTTDNDPSTIRISGRGSVDAKGSVAAQIFAALDVLEQNPSAPLGLLFVVGEETGGDGMRAFSESSLNPAPSAFHTVIFGEPTELALVSGHKGMLGFEIVAKGHAAHSGYPWLGRSAISAVLPALSRVDQLGNIPADKGGLPSSPKYGNTTVNIGRVDAGVAANVVPATARADVAVRLAAGTPDEARDIVRRAVRDATDGNPDVYAEFNTRSEGYPPQDLDTDVDGFDITTVNYGTDVPNLQIHEREDGPVRRYLYGPGSIHVAHGDNEAITVGDLQEAVRGYRKLIEAALQRR

SEQ ID NO: 4862 - protein, 984 aa, Aspergillus oryzae
  strain ATCC 42149 / RIB 40
MRLLSFIYLVWLALLTGTPQVSATDNGKTSDVAWDKYSLSVKGERLFVFSGEFHYQRLPVPELWLDVFQKLRANGFNTISVYFFWSYHSASEDVFDFTTGAHDIQRLFDYAKQAGLYVIARAGPYCNAETSAGGFALWAANGQMGSERTSDEAYYKKWKPWILEVGKIIAANQITNGGPVILNQHENELQETTYDSNDTKVIYMEQVAKAFEEAGVVVPSSHNEKGMRTVSWSTDYKNVGGAVNVYGLDSYPGSLSCANPNSGFNLLRTYYQWFQNYSYTQPEYLAEFEGGWFQPWGGSFYDSCASELSPEFADVYYKNNIGSRVTLHNIYMTFGGTNWGHSAAPVVYTSYDYGSPLRETREIRDKLKQTKLLGLFTRVSKDLLKTYMEGNGTSYTSDDSIYTWALRNPDSDAGFYVVAHNTSSSREVTTFSLNITTSAGAMTIPDIELDGRQSKIIVTDYSIGSESSLLYSSAEVLTYATLDVDVLVFYLNAGQKGAFVFKDAPADLKYQTYGNSNLSALETSQGTQYSYTQGEGVTAVKFSNGVLVYLLDKETAWNFFAPPTVSSPTVAPNEHILVFGPYLVRGASIKHDTVEIVGDNSNSTSIEIYTGDEHVKKVSWNGNLIDTRATAYGSLIGTVPGAEDIEISLPSLSSWKAQDTLPEISPDYDDSRWTICNKTTSVNSVAPLSLPVLYSGDYGYHTGTKIYRGRFDGQNATGANVTVQNGVAAGWAAWLNGAYVGGFSGDPDKVASWEVLKFNHSSLRSRDNVLTIITDYTGHDQNSQKPIGTQNPRGIMGATLIGGGNFTLWRIQGNAGGEKNIDPVRGPMNEGGLYGERMGWHLPGYQVPESALDSSPLEGVSGAEGRFYTTSFQLDLEEDLDVPIGLQLSAPAGTEAVVQIFMNGYQFGHYLPHIGPQSLFPFPPGVIKNRGQNSLAISMWALTDAGARLEQVELKAYAKYRSGFDFNRDWTYLQPGWKDRTEYA

SEQ ID NO: 4863 - protein, 526 aa, Aspergillus oryzae
  strain ATCC 42149 / RIB 40
MPSLRRLLPFLAAGSAALASQDTFQGKCTGFADKINLPNVRVNFVNYVPGGTNLSLPDNPTSCGTTSQVVSEDVCRIAMAVATSNSSEITLEAWLPQNYTGRFLSTGNGGLSGCIQYYDLAYTSGLGFATVGANSGHNGTSGEPFYHHPEVLEDFVHRSVHTGVVVGKQLTKLFYEEGFKKSYYLGCSTGGRQGFKSVQKYPNDFDGVVAGAPAFNMINLMSWSAHFYSITGPVGSDTYLSPDLWNITHKEILRQCDGIDGAEDGIIEDPSLCSPVLEAIICKPGQNTTECLTGKQAHTVREIFSPLYGVNGTLLYPRMQPGSEVMASSIMYNGQPFQYSADWYRYVVYENPNWDATKFSVRDAAVALKQNPFNLQTWDADISSFRKAGGKVLTYHGLMDQLISSENSKLYYARVAETMNVPPEELDEFYRFFQISGMAHCSGGDGAYGIGNQLVTYNDANPENNVLMAMVQWVEKGIAPETIRGAKFTNGTGSAVEYTRKHCRYPRRNVYKGPGNYTDENAWQCV

SEQ ID NO: 4864 - protein, 235 aa, Aspergillus oryzae
  strain ATCC 42149 / RIB 40
MANTALIGCTGMVGSFILNNLLAHPSVARVDTISRRTPQAASAAQTKLTTIVSDDTSRWASELSSLTPTPSIFFSAFATTRASAGGFENQYKIEHGLNVEMARAARDAGTKVYVLISSAGADKNAYFAYPRMKAEIEEDVKALGFERTVILRPGLIAGQREESRPMEAAIRCIAGFAGKIHSGLKDGWAQEADVIARAAVNAGLKALEGDVPTGSEKVWVLGGSDIIKYGAGSKN

SEQ ID NO: 4865 - protein, 914 aa, Aspergillus oryzae
  strain ATCC 42149 / RIB 40
MRFTATAAALVASSIPATLGQHVRDLSNEKWTLSSDALNHTVPGNLPSHAHLDLLKAGVIDDPYHGLNDFNLRWIPESNWTYTTDKIKDLMPIEFCGKYVASTNNQYRQYSFDVSQILEGCNEDPILKIDFGSAPNIVNAIAEDRNSPVWPDGIQQTYEYPNRWFMRKEQSDFGWDWGPAFAPAGPWKPAYIVQLPKAQNIHVLNTDLDIYRKGQINHLPPDQSQPWVVNASIDFVGSLPPNPSMSIEFKDTKSGEILTSKRIGNVTVSGNSVTGVTVLGGVTPKLWWPLGLGDQNLYNITVTVTGHQNQTLAHVTKRTGFRTIFLNQRNITDAQLAQGIAPGANWHFEVNGHEFYAKGSNIIPPDAFWPRVTEARMARLFDAVVAGNQNMLRVWSSGIYLHDFIYDLADERGILLWSEFEFSDALYPVDDAFLDNIAAEVVYNVRRVNHHPSLALWAGGNEIESLMLPTVERKAPEEYAKYVGEYEKLYISLILPLVYQNTRSITYSPSSTTEGYLDVDLSAPVPMVERYHNTTPGSYYGDTDFYNYDSSVSFNSHVYPVGRFANEFGYHSMPSLQTWQQAVDPEDLHFNSTTVMLRNHHYPAGGTFTDNFHNTSLGMGEMTIAVQRYYPIPNKLDSVANFSAWCHATQLFQADMYKSEIQFYRRGSGMPERQLGSLYWQLEDIWQAPSWAGIEYGGRWKVLHYVSRDIYQPIIVSPFWNYTTGDLDLYVTSDLWESAKGKVNLTWLDLSGTPLPHNAGTPGSVPFNVGALNTTKIYSTNIKNLTLPNPKDAILVLSLSGEGHLPNSDKKTTFTHQNHFTPVFPKDLALVDPGLELSYNTKSKTFTVEAKSGVSLYTWLDYPADVVGYFDENAFVLLPGQKKEIGFTVQEDNTDGKWVQGVTVQSLWNQTLEK

SEQ ID NO: 4866 - protein, 866 aa, Aspergillus oryzae
  strain ATCC 42149 / RIB 40
MAAFPAYLALLSYLVPGALSHPEAKTLTSRASTEAYSPPYYPAPNGGWISEWASAYEKAHRVVSNMTLAEKVNLTSGTGIYMGPCAGQTGSVPRFGIPNLCLHDSPLGVRNSDHNTAFPAGITVGATFDKDLMYERGVGLGEEARGKGINVLLGPSVGPIGRKPRGGRNWEGFGADPSLQAFGGSLTIKGMQSTGAIASLKHLIGNEQEQHRMSSVITQGYSSNIDDRTLHELYLWPFAESVRAGAGSVMIAYNDVNRSACSQNSKLINGILKDELGFQGFVVTDWLAHIGGVSSALAGLDMSMPGDGAIPLLGTSYWSWELSRSVLNGSVPVERLNDMVTRIVATWYKMGQDKDYPLPNFSSNTEDETGPLYPGALFSPSGIVNQYVNVQGNHNVTARAIARDAITLLKNNENVLPLKRNDTLKIFGTDAGTNSDGINSCTDKGCNKGVLTMGWGSGTSRLPYLITPQEAIANISSNAEFHITDTFPLGVTAGPDDIAIVFINSDSGENYITVDGNPGDRTLAGLHAWHNGDNLVKAAAEKFSNVVVVVHTVGPILMEEWIDLDSVKAVLVAHLPGQEAGWSLTDILFGDYSPSGHLPYTIPHSESDYPESVGLIAQPFGQIQDDYTEGLYIDYRHFLKANITPRYPFGHGLSYTTFNFTEPNLSIIKALDTAYPAARPPKGSTPTYPTAKPDASEVAWPKNFNRIWRYLYPYLDNPEGAAANSSKTYPYPDGYTTEPKPAPRAGGAEGGNPALWDVTFSVQVKVTNTGSRDGRAVAQLYVELPSSLGLDTPSRQLRQFEKTKILAAGESEVLTLDVTRKDLSVWDVVVQDWKAPVNGEGVKIWVGESVADLRVGCVVGEGCSTL

SEQ ID NO: 4867 - protein, 347 aa, Aspergillus oryzae
  strain ATCC 42149 / RIB 40
MLFSYLLATLPLLANAALTYKGADISSVFIEEKAGVAYKNLAGETQALEAILTDNGVNSIRQRVWVKNGDYDLTYNVNLAKRVAATGASIYLDLHYSDDWADPKHQTTPDGWSTDDINTLADQIYQYTLSVCNTFAEEKINVEIVSIGNEITSGLLWPLGKTPNYENIARLLHSGAWGVKDSKLATKPKILIHLDNGWDWDQQKYFYDTALGTGLLTSDDFDMIGVSYYPFYNEKATLASLKTSLTNIQTTYGKEVAVVETNWPVKCSSPEFAFPADLKDIPFSVDGQVTFLQRLAETLTATKASGFFYWEPAWTKNAGLGSSCEDNLLVDYNTNQVRNSVKAFGQV

SEQ ID NO: 4868 - protein, 160 aa, Aspergillus oryzae
  strain ATCC 42149 / RIB 40
MGRDTIPDDLRNHSASSLEWDASLEASAQTLAARCVYQHDTTINGGGYGQNIGYGVSSEKIGEMITNLMYNNEMGYFEALYGEANPSMDNFDAWGHFSQIVWKGTTHVGCATVTCNSLGNVDSSVAVPFTVCNYSPAGNYAGEYADNVLRPLGQAMYVVS

SEQ ID NO: 4869 - protein, 752 aa, Aspergillus oryzae
  strain ATCC 42149 / RIB 40
MRFVSLAVGAALLGAAGASSISSNVGLLKANGVALGNWEAAYEKASAFVSGLTTDQKLALITGSNVESANGNFTPLYFLDGDMGLQDFYYVSAFSLSSALAMTWDRDAIYEQAKAVGSEFYNKGVQVVAGPTSQPLGRTPWGGRGVEGFGPDPYLNGLATGLTTKGYVDAGVIPGGKHFLLYEQETNRTSSFGSSGEGSPYSSNADDKTIHETYLWPFYDAVKNGAGAVMCAMTKVNGTMACENSDLLMKMLKTELGFPGMVWPDMNGQNSAKGSALGGEDYGSSSIWSTSTMESFLSNGTLSEARLNDMAIRNLIGYYYVNLDNGRQPTRQTTDVYVDVRANHSKLIRENGAKSMALLKNEGVLPLSKPHVMSIFGAHAGPIMGGPNSNVDVMGSGPTYQGHLATGSGSGMASMPYLITPYDALTNKAAQDGTVLRWVLNDTYSSGGGSSLVPSSTSSTAVEPSFENFATGSDICLVFINALAGEGADRTELYNADQDAMVNTVADNCNNTVAVVNTVGPRLLDQWIEHDNVTAVLYGSLLGQESGNSIVDLLYGDVNPSGRLVHTIAKNESDYNVGLCYTAQCNFTEGVYLDYRYFDAHNITPRYPFGHGLSYTTFHYSSLAIKAPSSITKAPKGNLTVGGPSDLWDVVGTVSARIANNGTLSGAEVPQLYLGFPDSADQPVRQLRGFDRVELSAGQEAVVTFNLRRRDISYWNLKTQQWMVAGGKYTVFVGGSSRDLRLNGTFFLWVGS

SEQ ID NO: 4870 - protein, 281 aa, Aspergillus oryzae
  strain ATCC 42149 / RIB 40
MKNFFSMHAILLACSAGAGLAAITQGISEGTYSRIVEMATISQAAYANLCNIPPAITSAGKIYNAETDINGWVLRDDSRQEIITVFRGTGSDTNLQLDTNYTQAPFDTLPQCSGCAVHGGYYVGWVSVKDQVEGLIHQQASQYPDYSLVVTGHSLGASMAAITAAQLSATYNNITVYTFGEPRTGNQAYASYVDETFQATNPDATKFYRVTHTNDGIPNLPPTSQGYVHHGTEYWSVEPHGPQNMYLCLGDEVQCCEAQGGQGVNDAHVTYFGMASGACTW

SEQ ID NO: 4871 - protein, 353 aa, Aspergillus oryzae
  strain ATCC 42149 / RIB 40
MRFISVSSLLLALAPALNAVPVEVAGSAQGLDVTLSQVGNTRIKAVVKNTGSEDVTFVHLNFFKDAAPVQKVSLFRNATEVQFQGIKQRLITEGLSDDALTTLAPGATIEDEFDIASTSDLSEGGTITINSNGLVPITTDNKVTGYIPFTSNELSIDVDAAEAASVTQAVKILERRTKVTSCSGSRLSALQTALRNTVSLARAAATAAQSGSSSRFQEYFKTTSSSTRSTVAARLNAVANEAASTSSGSTTYYCSDVYGYCSSNVLAYTLPSYNIIANCDLYYSYLPALTSTCHAQDQATTTLHEFTHAPGVYSPGTDDLGYGYSAATALSASQALLNADTYALFANAVNLNC

SEQ ID NO: 4872 - protein, 437 aa, Aspergillus oryzae; identical to SEQ ID NO: 4512
  strain ATCC 42149 / RIB 40

SEQ ID NO: 4873 - protein, 540 aa, Aspergillus oryzae
  strain ATCC 42149 / RIB 40
MLVMQLLLPFLASTAAAAAAIDSTSSSNGSDHHGSSFQAECESFKAKINVTNANVHSVTYVPAGVNISMADNPSICGGDEDPITSTFAFCRIALNVTTSSKSQIFMEAWLPSNYSGRFLSTGNGGLGGCVKYDDMAYAAGYGFATVGTNNGHFGNNGVSFYQNTEVVEDFAYRALHTGVVVGKELTKNFYPQGYNKSYYLGCSTGGRQGWKSVQTFPDDFDGVVAGAPAFNFINLTSWGARFLTLTGDSSAETFVTETQWTAVHNEIIRQCDSLDGAKDGIIEDPDLCQPIIEALLCNATQSSTSGTCLTGAQVKTVNGVFSATYGLNGSFLYPRMQPGSELAAYSSYYSGTPFAYAEDWYRYVVFNNTNWDVATWTVQDAAIANAQDPYQISTWNGDLSPFQKKGGKVLHYHGMEDAIISSESSKVYYKHVADTMNLSPSELDSFYRFFPISGMAHCANADGPSAIGQGTGTFAGNNPQDNVLLAMVQWVEEGVAPDFVRGAKLNGSTVEYRRKHCKYPKRNRYVGPGSYTDENAWECV

SEQ ID NO: 4874 - protein, 160 aa, Aspergillus oryzae
  strain ATCC 42149 / RIB 40
MDSNGLFPFITTVSAKLHYVELYSPLTMDTQDRSSVTPSASNMKPIEWDEGLATAAQQLADSCKFEHNRAGQNLYEGSDPADLVKQAIDAWHNEHKDYNYDSNTCGPNAICGHYTQVVWADSSKVGMAVSSRKCESGMYIVVANYDPVGNYAGEKPYKQQ

SEQ ID NO: 4875 - protein, 333 aa, Aspergillus oryzae; identical to SEQ ID NO: 4451
  strain ATCC 42149 / RIB 40

SEQ ID NO: 4876 - protein, 437 aa, Aspergillus oryzae; identical to SEQ ID NO: 4460
  strain ATCC 42149 / RIB 40

SEQ ID NO: 4877 - protein, 432 aa, Aspergillus oryzae
  strain ATCC 42149 / RIB 40
MSIEVDWRAATSGPDGEALAERIRSFIHDKFQQVALPRFIRSVQVHSFDFGTIPPDLEVKDICEPFADFYEEDEDDETSDVSEELVSGHGTQWHRDLNEPPFHEEMAMNRPLRDPFDEAFHSSTLRSPMEHLNPHFLPRAGTPGIPGGTSTLGYHLMSLGGLSGTQTPLAAVAGGTPFANGWTDPGMGASSRGHPSISGPTAVHPSRMEADIDTSNPTSRPSTSSTLPSHPSASNQPSGDATTGKEHGSLAEDEHLDDPMTSGHPLRLPPRMRERRPEDFQVLCHAKYAGDVRLSLTAEILLDYPMPSFVGLPLKLNVTGITFDGVAVIAYIRKRVHFCFLSAEDADALIGSDQQEARGQDDRPWSSADPTASPKRQGGLLREIRVESEIGRKEDGKQVLKNVGKVERFVLAQVRRTFEEEMVFPSFWTFLI

SEQ ID NO: 4878 - protein, 877 aa, Aspergillus oryzae
  strain ATCC 42149 / RIB 40
MLGSLLLLAPLAGAAVIGSRADTQQCPGYKASNVQENDRSLTADLTLAGKPCNTYGTDLHNLKLLVEYQTDERLHVKIYDAEERVYQVPEKVTPRVDSGDGSSKDSALKFEYEEEPFSFTVKRDDEVLFDSSAENLIFQSQYLKLRTWLPENPYLYGLGEHTDPLRLSTTNYTRTFWNRDAYGTSANSNLYGTHPVYYDHRGESGTHGVFLLNSNGMDVFIDKTADGKQYLEYNALGGIFDFYFFTGSNPKEASIEYSKIVGLPAMQSYWTFGLHQCRYGYRDVYQVAEVVYNYTKAGIPLETMWTDIDYMDRRRVFSLDPDRFPLEKMRELVGYLHDHDQHYIVMVDPAVSVSDNGAFNRGLEQDVFLKTQNGSLYKGAVWPGVTAYPDWFHPDIQDYWNSEFSTFFNAETGVDIDGLWIDMNEASNFCPDPCTDPERYSSENNLPPAPPPVRSSSPRPLPGFPADFQPSSASRSQKRIVKAKVGLEGRDLLNPPYKIRNEAGSLSNKTINTGIVHAGEGYAEYDTHNLYGTMMSSSSREAMQYRRPEVRPLVITRSTYAGAGRDVGHWLGDNFSKWEHYRISIAEGLAFASMFQVPMVGADVCGFAGNTTEELCARWASLGAFFTFYRNHNEIGNIGQEFYVWPTVAESARKAIDIRYRLLDYIYTSFYKQSQTGEPFLQPVFYLYPEDENTFSIDLQFFYGDAILVSPVPDKGLTSVDAYFPDDIFYDWYTGTPVRGHGANITLSNIDITHIPLHIRGGSIIPIRSSSAMTTTELREKSFQLIIAPGLDGTASGSLYLDDGDSLEQKATLEVEFEYRKGVLHIDGKFELHASLVESVTLLGQGKGGSRARREDGTKKTIQTNLELSKPTEIKLE

SEQ ID NO: 4879 - protein, 798 aa, Aspergillus oryzae
  strain ATCC 42149 / RIB 40
MPGAASIVAVLAALLPTALGQANQSYVDYNIEANPDLFSECLETGGTSFPDCESGPLSKTLVCDTSAKPHDRAAALVSLLTFEELVNNTANTGHGAPRIGLPAYQVWNEALHGVAHADFSDAGGFSWSTSFPQPISTMAALNRTLIHQIATIISTQGRAFMNAGRYGLDVYSPNINTFRHPVWGRGQETPGEDAYCLASTYAYEYITGIQGGVDANPLKLIATAKHYAGYDIENWDNHSRLGNDMQITQQDLAEYYTPQFLVASRDAKVHSVMCSYNAVNGVPSCSNSFFLQTLLRDTFDFVEDGYVSGDCGAVYNVFNPHGYATNESSAAADSIRAGTDIDCGVSYPRHFQESFHDQEVSRQDLERGVTRLYASLIRAGYFDGKTSPYRNITWSDVVSTNAQNLSYEAAAQSIVLLKNDGILPLTSTSSSTKTIALIGPWANATTQMLGNYYGPAPYLISPLQAFQDSEYKITYTIGTNTTTDPDSTSQSTALTTAKEADLIIFAGGIDNTLETEAQDRSNITWPSNQLSLITKLADLGKPLIVLQMGGGQVDSSALKNNKNVNALIWGGYPGQSGGQALADIITGKRAPAARLVTTQYPAEYAEVFPAIDMNLRPNGSNPGQTYMWYTGTPVYEFGHGLFYTNFTASASASSGTKNRTSFNIDEVLGRPHLGYKLVEQMPLLNFTVDVKNTGDRVSDYTAMAFVNTTAGPAPHPNKWLVGFDRLSAVEPGSAKTMVIPVTVDSLARTDEEGNRVLYPGRYEVALNNEREVVLGFTLTGEKAVLFKWPKEEQLIAPQ

SEQ ID NO: 4880 - protein, 602 aa, Aspergillus oryzae; identical to SEQ ID NO: 4455
  strain ATCC 42149 / RIB 40

SEQ ID NO: 4881 - protein, 367 aa, Aspergillus oryzae; identical to SEQ ID NO: 4454
  strain ATCC 42149 / RIB 40

SEQ ID NO: 4882 - protein, 242 aa, Aspergillus oryzae; identical to SEQ ID NO: 4453
  strain ATCC 42149 / RIB 40

SEQ ID NO: 4883 - protein, 723 aa, Aspergillus oryzae
  strain ATCC 42149 / RIB 40
MRSLVLLGMSSLATANSLWSSKAASWDTTNEAYTLGNGKLGVMPFGEPGAEKLNLNHDELWEGGPFEVNGYRGGNPNSSMTEILSEVRDEIWKKGTGNDSRLHGDTDGYGSFHSLANLTIAIDGIDKVSDYTRSLDLGTGIHTTTYSTGKGKYTTDVYCSYPAQVCIYKLNSTATLSKVTIYFDQLVEESSLWNATCDSDFARLRGVTQEGPPRGMTYDTIARSSIPGRCDSSTGKLAINARNSSSLTIVIGAGTDFDGTKGTAATDYTFKGEDPAEYVEKITSSALSQSESKLRTEHIEDYSGLMSAFTLDLPDTQDSTGTELSTLITNYNANKTDGDPYLEKLLFDYGRHLFISSSRANSLPPNLQGVWSPTKNAAWSGDYHANINLQMNLWGAEATGLGELTVAVFNYMEQNWMPRGAETAELLYGGAGWVTHDEMNIFGHTGSLVVNPCTSPEQGPTTFGCTHWQQLIHQVYENAIQGAEIAGETDSTLLKDIKDQLPRLDKGLHIGTWGQIKEWKLPDSYDYEKEGNEHRHLSHLVGWYPGWSLSSYFNGYNNATIQSAVNTSLISRGVGLYTNAGWEKVWRSACWARLNNTEKAHYELRLTIDQNIGQSGLSLYSGGDTPSGAFQIDANFGYLGAVLSMLVVDMPLDSTHSEDDVRTVVLGPAIPAAWAGGSVKGLRLRGGGSVDFSWDSEGLVDKASATGVSSNVRIVNVEGTVLV

SEQ ID NO: 4884 - protein, 534 aa, Aspergillus oryzae
  strain ATCC 42149 / RIB 40
MRLITRWIPLANALASTMPVQVVASIENPSLLPTPPMGFNNWARFMCDLNETLFVETTDAMASNGLLEAGYNRINLDDCWMNYDRAENGSLEWNVTKFPRGLPWLGQYVKSKGFNFGIYEDSGNLTCGGYPGSEGYEEIDAEIFAAWGIDYLKLDGCNVYPKEGRTLQEEYKYLYGNWHEILSKMQQPLIFSESAPAYFSMTDNLTDWHTVMDWVPEYGELARHSVDILVYSGEGSAWDSIMTNYKFNTLVARYQRPGYYNDPDFLIADHPGLSLDEKRSQFALWASFSAPLIISAHIPDLSSEDLEYLTNQALIAVDQDPLAQQATLASRDGSLDVLTRNLADGSRLVTILNHGSESIETDISLDILGLSTDCTYKAQDLWGGSTQTIKDAIRIKLNTHATAVYKIDTDEKCSQVIPTGLIFNTASGKCLTGTSSSVGSESCNGSKSQIWQIDASGVIRTLSEQSKCLTADGKAISLQECSENNGQKWSYAITGNLKNADTGYCLTNGGGVSACGFETNSQVFGLPAGVHVAL

SEQ ID NO: 4885 - protein, 492 aa, Aspergillus oryzae
  strain ATCC 42149 / RIB 40
MKRSALILSFLPLVFGCDNPKSPGHSCASVYSVSSAAASSFCATFTASTVTATTGVPEALLSNCDYKTKHLSSACSCLGTAAVPTVATPSSVSSVYITSATATPTSFTFKTSTAHIVKVAKAATSSTAVVTTPVSVPTASSSFTGNGGTTCTVTEYAAISSAVASCSNILLSDIYAPPSSTIDLQGLQTGAAVIFAGKTTFGDTADSDFDPIVVSGTSVTITGVEGHVIDGNGAAYWDGQGSNGGSDKPDHFFVVKDMYNSRIENLYIQNWPVHCFEIESTEHLTVSGLTLNNSAGDAANSKSDGDPAAHNSDGFDIKESSYFTLENTWVHNQDDCVAVTSGTDIVVDGMYCYGGHGLSIGSIGGKSDNTVNGVTFSNSQVISSQNGCRIKTNSGETGEVYNIRYENITLSDISDYGIDVQQDYLNGGPTGEPTNGVTIANVTFVDVTGTMSDGKDYYILCGDDSCSNFVFDGVSITGGSGDSCNYPSTGCP

SEQ ID NO: 4886 - protein, 861 aa, Aspergillus oryzae
  strain ATCC 42149 / RIB 40
MKLGWIEVAALAAASVVSAKDDLAYSPPFYPSPWADGQGEWAEVYKRAVDIVSQMTLTEKVNLTTGTGWQLERCVGQTGSVPRLNIPSLCLQDSPLGIRFSDYNSAFPAGVNVAATWDKTLAYLRGQAMGEEFSDKGIDVQLGPAAGPLGAHPDGGRNWEGFSPDPALTGVLFAETIKGIQDAGVIATAKHYIMNEQEHFRQQPEAAGYGFNVSDSLSSNVDDKTMHELYLWPFADAVRAGVGAVMCSYNQINNSYGCENSETLNKLLKAELGFQGFVMSDWTAHHSGVGAALAGLDMSMPGDVTFDSGTSFWGANLTVGVLNGTIPQWRVDDMAVRIMAAYYKVGRDTKYTPPNFSSWTRDEYGFAHNHVSEGAYERVNEFVDVQRDHADLIRRIGAQSTVLLKNKGALPLSRKEKLVALLGEDAGSNSWGANGCDDRGCDNGTLAMAWGSGTANFPYLVTPEQAIQNEVLQGRGNVFAVTDSWALDKIAAAARQASVSLVFVNSDSGEGYLSVDGNEGDRNNITLWKNGDNVVKTAANNCNNTVVIIHSVGPVLIDEWYDHPNVTGILWAGLPGQESGNSIADVLYGRVNPGAKSPFTWGKTRESYGSPLVKDANNGNGAPQSDFTQGVFIDYRHFDKFNETPIYEFGYGLSYTTFELSDLHVQPLNASRYTPTSGMTEAAKNFGEIGDASEYVYPEGLERIHEFIYPWINSTDLKASSDDSNYGWEDSKYIPEGATDGSAQPRLPASGGAGGNPGLYEDLFRVSVKVKNTGNVAGDEVPQLYVSLGGPNEPKVVLRKFERIHLAPSQEAVWTTTLTRRDLANWDVSAQDWTVTPYPKTIYVGNSSRKLPLQASLPKAQ

SEQ ID NO: 4887 - protein, 463 aa, Aspergillus oryzae
  strain ATCC 42149 / RIB 40
MQLTHLLAFALSLATSEAAYKGFNYGATKSDGSVKSQSDFESEFSTAKNLVGTSGFTSARLYTMIQGGTTNSPISAIPAAIAENTSLLLGLWASGGGMDNELAALKSAISQYGDSFAKLVVGISVGSEDLYRASSEGEKVNAGIGIGPDDLVSFIKEVRSIISGTALSSVPIGHVDTWTAWTNGSNSAVIDAVDWLGFDGYPYFQSSMSNSISDAKSLFDDSVAKTKAVAKGKEVWITETGWPVSGSTQNLGVASLANAKTYWDEVGCPLFDETNTWWYILQDANPTTPNPSFGVVGSTLSTTPLFDLSCSNSTRPSASASSSAAGSATPVGSAVPSGSAAVNPSSSGIVSSAVPSTTPGFTVGKGFRPSNSSAAAYYSSASASGSAYPKFTKTASGSSATSTTAGSSSDSSSTNSGKSSSESSSTNSGASASSSILATGGASSVSGSVFGALVAVFAFVATL

SEQ ID NO: 4888 - protein, 307 aa, Aspergillus oryzae; identical to SEQ ID NO: 4443
  strain ATCC 42149 / RIB 40

SEQ ID NO: 4889 - protein, 405 aa, Aspergillus oryzae; identical to SEQ ID NO: 4463
  strain ATCC 42149 / RIB 40

SEQ ID NO: 4890 - protein, 725 aa, Aspergillus oryzae
  strain ATCC 42149 / RIB 40
MRALSLASLIGIASAACPYMTGELERRDTGTDDATAATEEFLSQYYMADNDTFLTSDVGGPIEDQNSLQVGDRGPTLLEDFIFRQKIQRFDHERVPERAVHARGVGAHGVFTSYGDYSNITAASFLGAEGKETPVFVRFSTVAGSRGSSDLARDVHGFATRFYTDEGNFDIVGNNIPVFFIQDAILFPDLIHAVKPRGDNEIPQAATAHDSAWDFFSQQPSSLHTLLWAMSGHGIPRSLRHVDGFGIHTFRFVTDNGDSKLVKFHWKSLQGKASMVWEEAQQVSGKNPDFMRQDLFEAIEAGRYPEWELGVQIMDEEDQLKFGFDLFDPTKIVPEEYVPITKLGKMTLNRNPRNYFAETEQVMFQPGHIVRGVDFTEDPLLQGRLFSYLDTQLNRHGGPNFEQLPINQPRVPVHNNNRDGAGQMFIPLNPNAYSPNTLNKGSPKQANQTVGKGFFTAPGRESTGRFTRAVSPSFEDVWSQPRLFYNSLTPAEQQFVVDAIRFENSNVKSSVVRNNVIIQLNRVSNDLARRVARAIGVEEPEADPTYYHNNKTTDVGTFGQKLKKLDGLKVGFLASVETPASIEAASELSKQLSEDGVDVVVVAERLSDGVDQTYSGSDAIQFDAVIVAPGAEGLFSTFSFTAPSNATSSSTLFPAGRPLQIVIDGFRFGKPVGAVGSAATALKNAGIQTSRDGVYVDKSVTSGFVDGIKDGLRTFKFLDRFKLDH

SEQ ID NO: 4891 - protein, 652 aa, Aspergillus oryzae
  strain ATCC 42149 / RIB 40
MRPLSHLSFFNGLLLGLSALSAATSVVHERREATSSNWVKRARVNPSDKHVVRIGLTQSSLEEAHDLLMDVSNPSSPNYARFYSADEVAAKFAPSTETVNEVQNWLTEKGINASRVAQTQNHGWLVFHATSKEIENLFDTTYYEYHNRKTGKKAIACEQYHVPASVQKHIDYVHPGVNLNPSSGKPSSIRRRAAASKKTKLPARGPRPIQQHDVKGLNVTNCDQLITPECIRALYKIPSARAAPHPNNSLGIFEEGDYYAQEDLDLFFKTFAKDIPQGTHPIPAFIDGAEAPVPVTKAGGESDLDFELAYPIVHPQSITLYQTDDANWASNTTGFLNTFLDALDGSYCTYCAYGECGNDPSLDPVYPDDAGYDGQLMCGVFKPTNVISVSYGEQENDLPANYQQRQCMEFLKLGLQGVSVLFASGDNGVAGPPGDGNSVNGCLNNGTVFSPAFPNSCPYITNVGATKVYPGYTVSQPESAVYDPDGLYSYASGGGFSNIYPIPDYQAEAVATYFKDHNPPYPYYEGAENLGKNGGLYNRLGRGYPDVAANGDNIAVFNGGEFGSSGGTSASTPIFASIINRIIDERLAVGKGPVGFINPVLYKNPSVLNDITNGTNPGCGTDGFSTAPGWDPATGLGTPNYPKMLKLWLDLP

SEQ ID NO: 4892 - protein, 323 aa, Aspergillus oryzae
  strain ATCC 42149 / RIB 40
MVHLKSLAGILLYTSLCIASSQQAPASINNAFVAKGKKYFGTCADQGTLSDGTNSGIIKADFGQLTPENSMKWDATEPSQGKFSFSGADYLVNYAATNNKLIRGHTLVWHSQLPSWVQGITDKNTLTSVLKNHITTVMNRYKGKVYAWDVVNEIFNEDGTLRSSVFYNVLGEDFVRIAFETARAADPQAKLYINDYNLDSANYGKTTGLANHVKKWIAQGIPIDGIGSQTHLSAGGSSGVKGALNTLAASGVSEVAITELDIAGASSNDYVNVVEACLEVSKCVGITVWGVSDKNSWRSAESPLLFDGNYQPKSAYNAILNAL

SEQ ID NO: 4893 - protein, 466 aa, Aspergillus oryzae
  strain ATCC 42149 / RIB 40
MAVLSVLLPITFLLSSVTGTPVTSPRQQSCNTVDEGYQCFSGVSHLWGQYSPYFSVDDESSLSEDVPDHCQVTFAQVLSRHGARYPTKSKSEKYAKLIKAVQHNATSFSGKYAFLKSYNYSLGADDLTPFGENQLVDSGIKFYQRYEELAKNVVPFIRASGSDRVIASGEKFIEGFQKAKLGDSKSKRGQPAPIVNVVITETEGFNNTLDHSLCTAFENSTTGDDAEDKFTAVFTPSIVERLEKDLPGTTLSSKEVVYLMDMCSFDTIALTRDGSRLSPFCALFTQEEWAQYDYLQSVSKYYGYGGGNPLGPAQGIGFANELIARLTKSPVKDHTTTNTTLDSNPATFPLNATLYADFSHDNTMTSVFFALGLYNTTEPLSQTSVQSTEETNGYSSARTVPFGARAYVEMMQCTDEKEPLVRVLVNDRVIPLQGCDADEYGRCKRDDFVEGLSFVTSGGNWGECFA

SEQ ID NO: 4894 - protein, 232 aa, Aspergillus oryzae; identical to SEQ ID NO: 4520
  strain ATCC 42149 / RIB 40

SEQ ID NO: 4895 - protein, 725 aa, Aspergillus oryzae
  strain ATCC 42149 / RIB 40
MGALRWLSIAATASTALALNPEGLISAPRRSEAIPNPSGDVAVFSQSQYSFKTHKTTSQWNVLDLKSGDIKLLTNDSDVSEIVWLGSDDSTVLYVNGTNADIPGGVELWVSDISDFANGYKAASLPASFSGFKVVTTDSGDVRYVAYAESWANGTAYNEELVAKPLSSARIYDSIYVRHWDYYLTTRFNAVFSGTLKKSEGKGKATYKADGDLKNLVSPVKNAESPYPPFGGASDYDLSPDGKWVAFKSKAHDIPRANYTTAYIFLVPHDGSKTAVPINGPDSPGTPEGVKGDAGSPVFSPDSKKIAYWQMADESYEADHRTLYVYTVGSEETIPSLAADWDRSLDSVKWADDDNLIIGVEDAGRSRLFSIPADAGDDYKPKNFTDGGVVSAYYQLPDSTYLVTSTAIWTSWNVYIASPEKGVIKTLATANKIDPELKGLGPEIVDEFYYEGNWTKIQAFVIYPENFDKSKSYPLLYYIHGGPQSSWLDSWSTRWNPKVFADQGYVVVAPNPTGSSGFGDALQDAIQNQWGGYPYEDLVKGWEYVNENFDFIDTDNGVAAGASYGGFMINWIQGSDLGRKFKALVSHDGTFVADAKVSTEELWFMQHEFNGTFWDNRENYRRWDPSAPERILKFSTPMLIIHSDLDYRLPVSEGLSLFNILQERGVPSRFLNFPDENHWVQNKENSLVWHQQVLGWLNKYSGVEESNEDAVSLDNTVIPVVDYNP

SEQ ID NO: 4896 - protein, 104 aa, Aspergillus pallidus
DCDYTCGSHCYSASAVSDAQSAGYQLYSAGQSVGRSRYPHQYRNYEGFNFPVSGNYYEWPILSSGSTYNGGSPGADRVVFNNNDELAGLITHTGASGNGFVACG

SEQ ID NO: 4897 - protein, 363 aa, Aspergillus parasiticus
MQLLQSSVIAATVGAALVAAAPVELEARDSCTFTSAADAKSGKTSCSTITLSNIEVPAGETLDLTGLNDGTTVIFSGETTFGYKEWEGPLISVSGTNIKVQQASGAKIDGDGSRWWDGEGGNGGKTKPKFFYAHKLDSSSITGLQIYNTPVQGFSIQSDNLNITDVTIDNSAGTAEGHNTDAFDIGSSTYINIDGATVYNQDDCLAINSGSHITFTNGYCDGGHGLSIGSVGGRSDNTVEDVTISNSKVVNSQNGVRIKTVYGATGTVSNVKFEDITLSGITKYGLVVEQDYENGSPTGTPTNGITVSGITFEKVTGTVESDATDIYILCGSGSCTDWTWSGVSITGGKTSSKCENVPTGASC

SEQ ID NO: 4898 - protein, 176 aa, Aspergillus restrictus
MVAIKNLFLLAATAVSVLAAPSPLDARATWTCINQQLNPKTNKWEDKRLLYSQAKAESNSHHAPLSDGKTGSSYPHWFTNGYDGNGKLIKGRTPIKFGKADCDRPPKHSQNGMGKDDHYLLEFPTFPDGHDYKFDSKKPKEDPGPARVIYTYPNKVFCGIVAHQRGNQGDLRLCSH

SEQ ID NO: 4899 - protein, 394 aa, Aspergillus saitoi
MVVFSKTAALVLGLSTAVSAAPAPTRKGFTINQIARPANKTRTVNLPGLYARSLAKFGGTVPQSVKEAASKGSAVTTPQNNDEEYLTPVTVGKSTLHLDFDTGSADLWVFSDELPSSEQTGHDLYTPSSSATKLSGYSWDISYGDGSSASGDVYRDTVTVGGVTTNKQAVEAASKISSEFVQDTANDGLLGLAFSSINTVQPKAQTTFFDTVKSQLDSPLFAVQLKHDAPGVYDFGYIDDSKYTGSITYTDADSSQGYWGFSTDGYSIGDGSSSSSGFSAIADTGTTLILLDDEIVSAYYEQVSGAQESYEAGGYVFSCSTDLPDFTVVIGDYKAVVPGKYINYAPVSTGSSTCYGGIQSNSGLGLSILGDVFLKSQYVVFNSEGPKLGFAAQA

SEQ ID NO: 4900 - protein, 1007 aa, Aspergillus saitoi
MKLSSACAIALLAAQAAGASIKHRINGFTLTEHSDPAKRELLQKYVTWDDKSLFINGERIMIFSGEFHPFRLPVKELQLDIFQKVKALGFNCVSFYVDWALVEGEPGEYRADGIFDLEPFFDAASEAGIYLLARPGPYINAESSGGGFPGWLQRVNGTLRSSDKAYLDATDNYVSHVAATIAKYQITNGGPIILYQPENEYTSGCCGVEFPDPVYMQYVEDQARNAGVVIPLINNDASASGNNAPGTGKGAVDIYGHDSYPLGFDCANPTVWPSGDLPTNFRTLHLEQSPTTPYAIVEFQGGSYDPWGGPGFAACSELLNNEFERVSYKNDFSFQIAIMNLYMIFGGTNWGNLGYPNGYTSYDYGSAVTESRNITREKYSELKLLGNFAKVSPGYLTASPGNLTTSGYADTTDLTVTPLLGNSTGSFFVVRHSDYSSEESTSYKLRLPTSASSVTIPQLGGTLTLNGRDSKIHVTDYNVSGTNIIYSTAEVFTWKKFADGKVLVLYGGAGEHHELAISTKSNVTVIEGSESGISSKQTSSSVVVGWDVSTTRRIIQVGDLKILLLDRNSAYNYWVPQLATDGTSPGFSTPEKVASSIIVKAGYLVRTAYLKGSGLYLTADFNATTSVEVIGVPSTAKNLFINGDKTSHTVDKNGIWSATVDYNAPDISLPSLKDLDWKYVDTLPEIQSSYDDSLWPAADLKQTKNTLRSLTTPTSLYSSDYGFHTGYLLYRGHFTATGNESTFAIDTQGGSAFGSSVWLNGTYLGSWTGLYANSDYNATYNLPQLQAGKTYVITVVINNMGLEENWTVGEDLMKTPRGILNFLLAGRPSSAISWKLTGNLGGEDYEDKVRGPLNEGGLYAERQGFHQPEPPSQDWKSSSPLEGLSEAGIGFYSASFDLDLPKGWDVPLFLNIGNSTTPSPYRVQVYVNGYQYAKYISNIGPQTSFPVPEGILNYRGTNWLAVTLWALDSAGGKLESLELSYTTPVLTALGEVESVDQPKYKKRKGAY

SEQ ID NO: 4901 - protein, 639 aa, Aspergillus shirousami
MSFRSLLALSGLVCSGLASVISKRATLDSWLSNEATVARTAILNNIGADGAWVSGADSGIVVASPSTDNPDYFYTWTRDSGIVLKTLVDLFRNGDTDLLSTIEHYISSQAIIQGVSNPSGDLSSGGLGEPKFNVDETAYAGSWGRPQRDGPALRATAMIGFGQWLLDNGYTSAATEIVWPLVRNDLSYVAQYWNQTGYDLWEEVNGSSFFTIAVQHRALVEGSAFATAVGSSCSWCDSQAPQILCYLQSFWTGSYILANFDSSRSGKDTNTLLGSIHTFDPEAGCDDSTFQPCSPRALANHKEVVDSFRSIYTLNDGLSDSEAVAVGRYPEDSYYNGNPWFLCTLAAAEQLYDALYQWDKQGSLEITDVSLDFFKALYSGAATGTYSSSSSTYSSIVSAVKTFADGFVSIVETHAASNGSLSEQFDKSDGDELSARDLTWSYAALLTANNRRNSVVPPSWGETSASSVPGTCAATSASGTYSSVTVTSWPSIVATGGTTTTATTTGSGGVTSTSKTTTTASKTSTTTSSTSCTTPTAVAVTFDLTATTTYGENIYLVGSISQLGDWETSDGIALSADKYTSSNPPWYVTVTLPAGESFEYKFIRVESDDSVEWESDPNREYTVPQACGESTATVTDTWR

SEQ ID NO: 4902 - protein, 363 aa, Aspergillus sojae
MQLLQSSVIAATVGAALVAAAPVELEARDSCTFTSAADAKSGKTSCSTITLSNIEVPAGETLDLTGLNDGTTVIFSGETTFGYKEWEGPLISVSGTNIKVQQASGAKIDGDGSRWWDGEGGNGGKTKPKFFYAHKLDSSSITGLQIYNTPVQGFSIQSDNLNITDVTIDNSAGTAEGHNTDAFDIGSSTYINIDGATVYNQDDCLAINSGSHITFTNGYCDGGHGLSIGSVGGRSDNTVEDVTISNSKVVNSQNGVRIKTVYDATGTVSNVKFEDITLSGITKYGLVVEQDYENGSPTGTPTNGITVSGITFEKVTGTVESDATDIYILCGSGSCTDWTWSGVSITGGKTSSKCENVPTGASC

SEQ ID NO: 4903 - protein, 377 aa, Aspergillus sojae
MRFLPCIATLAATASALAIGDHIRSDDQYVLELGPGETKVVTEAEKWALRAEGKRFFDITGRTSSLELASNKKQKLAVTYPDSVQHNETVQNLINSLDKKNFETVLQPFSEFHNRYYKSDNGKKSSEWLQGKIQEIISASGAKGVTVEPFKHFFPQSSLIAKIPGKSDKTIVLGAHQDSINLNSPSEGRAPSADDDGSGVVTILEAFRVLLTDEKVAAGEAPNTVEFHFYAGEEGGLLGSQDIFEQYLQKSRDVKAMLQQDMTGYTKGTTDAGKPESIGIITDNVDENLTKFLKIIVDAYCTIPTVDSKCGYGCSDHASATKYGYPAAFAFESAFGDDSPYIHSADDTIETVNFDHVLQHGRLTLGFAYELAFADSL

SEQ ID NO: 4904 - protein, 328 aa, Aspergillus sojae
MKVTKKVLDQSLCCTALLALVGGAAAQCALPSSYSWTSTGALAEPKAGWAALKDFTNVVFNGQHIVYGSVADTSGNYGSMNFGPFSDWSEMASASQNAMSQGTVAPTLFYFAPKDVWILAYQWGPTSFSYKTSSDPTDANGWSAAQPLFSGTISDSDTGVIDQTVIGDDTDMYLFFAGDNGKIYRASMPIDNFPGDFGTQSEIILSDTKENLFEAVQVYTVDGQNKYLMIVEAMGANGRYFRSFTADSLDGEWTVQAGTESQPFAGKANSGATWTNDISHGDLVRNNPDQTMTVDPCNLQLLYQGRDPNASGDYNLLPWKPGVLTLQV

SEQ ID NO: 4905 - protein, 861 aa, Aspergillus terreus
MKLSILEAAALTAASVASAQDDLAYSPPYYPSPWADGHGEWSNAYKRAVDIVSQMTLTEKVNLTTGTGWELERCVGQTGSVPRLGIPSLCLQDSPLGIRMSDYNSAFPAGINVAATWDKTLAYQRGKAMGEEFSDKGIDVQLGPAAGPLGRSPDGGRNWEGFSPDPALTGVLFAETIKGIQDAGVIATAKHYILNEQEHFRQVGEAQGYGFNITETVSSNVDDKTMHELYLWPFADAVRAGVGAVMCSYNQINNSYGCQNSLTLNKLLKAELGFQGFVMSDWSAHHSGVGAALAGLDMSMPGDISFDSGTSFYGTNLTVGVLNGTIPQWRVDDMAVRIMAAYYKVGRDRLWTPPNFSSWTRDEYGFAHFFPSEGAYERVNEFVNVQRDHAQVIRRIGADSVVLLKNDGALPLTGQEKTVGILGEDAGSNPKGANGCSDRGCDKGTLAMAWGSGTANFPYLVTPEQAIQNEVLKGRGNVFAVTDNYDTQQIAAVASQSTVSLVFVNADAGEGYLNVDGNMGDRKNLTLWQNGEEVIKTVTEHCNNTVVVIHSVGPVLIDEWYAHPNVTGILWAGLPGQESGNAIADVLYGRVNPGGKTPFTWGKTRASYGDYLLTEPNNGNGAPQDNFNEGVFIDYRRFDKYNETPIYEFGHGLSYTTFELSGLQVQLINGSSYVPTTGQTSAAQTFGKVEDASSYLYPEGLKRISKFIYPWLNSTDLKASTGDPDYGEPNFEYIPEGATDGSPQPRLPASGGPGGNPGLYEDLFQVSVTITNTGKVAGDEVPQLYVSLGGPNEPKRVLRKFERLHLAPGQQKVWTTTLNRRDLANWDVVAQDWKITPYAKTIFVGTSSRKLPLAGRLPRVQ

SEQ ID NO: 4906 - protein, 471 aa, Aspergillus terreus
MMSLFKSIIAAGLVFHPLVQAQQPSSSSPGDPSLTTWKCTTGGGCLQQDTSVVLDWGVHWIHTSNSQSCTTSSGVNSALCPDEATCAKNCVIDPANYATAGVATSGDTLTMHQYYQNNGVITNASPRLYLLGSDGNYVMLKLLGQELSFNVDLSTLPCGENGASYLSEMSATGGRNEYNTGGAQYGSGYCDAQSPVMAWRNGTLNTSGQGFGCNEMDILEANSRANSFTPHSCNGNDCDKGGCGFNPYALGQQNYWGPGGTVDTSKPFTITTQFITDDGSKTGTLKEIRRQYIQNGKIIANAKSSAGVDSITEPRCESVDGAAATYGGLKRMGEALGRGMVLIFRIWNDAGGFMNWLDSGSAGPCSSTEGNPSLIQSAHPDTHVVFSNIRWGDIGSTYTNPGGSGSSSSSTTTTTKTTSTTATTKITTTTSAGGATQTHWGQCGGQGSTGPTACASPYTCQKQNEWYSECL

SEQ ID NO: 4907 - protein, 466 aa, Aspergillus terreus
MGFLAIVLSVALLFRSTSGTPLGPRGKHSDCNSVDHGYQCFPELSHKWGLYAPYFSLQDESPFPLDVPEDCHITFVQVLARHGARSPTHSKTKAYAATIAAIQKSATAFPGKYAFLQSYNYSLDSEELTPFGRNQLRDLGAQFYERYNALTRHINPFVRATDASRVHESAEKFVEGFQTARQDDHHANPHQPSPRVDVAIPEGSAYNNTLEHSLCTAFESSTVGDDAVANFTAVFAPAIAQRLEADLPGVQLSTDDVVNLMAMCPFETVSLTDDAHTLSPFCDLFTATEWTQYNYLLSLDKYYGYGGGNPLGPVQGVGWANELMARLTRAPVHDHTCVNNTLDASPATFPLNATLYADFSHDSNLVSIFWALGLYNGTAPLSQTSVESVSQTDGYAAAWTVPFAARAYVEMMQCRAEKEPLVRVLVNDRVMPLHGCPTDKLGRCKRDAFVAGLSFAQAGGNWADCF

SEQ ID NO: 4908 - protein, 466 aa, Aspergillus terreus
MGVFVVLLSIATLFGSTSGTALGPRGNHSDCTSVDRGYQCFPELSHKWGLYAPYFSLQDESPFPLDVPDDCHITFVQVLARHGARSPTDSKTKAYAATIAAIQKNATALPGKYAFLKSYNYSMGSENLNPFGRNQLQDLGAQFYRRYDTLTRHINPFVRAADSSRVHESAEKFVEGFQNARQGDPHANPHQPSPRVDVVIPEGTAYNNTLEHSICTAFEASTVGDAAADNFTAVFAPAIAKRLEADLPGVQLSADDVVNLMAMCPFETVSLTDDAHTLSPFCDLFTAAEWTQYNYLLSLDKYYGYGGGNPLGPVQGVGWANELIARLTRSPVHDHTCVNNTLDANPATFPLNATLYADFSHDSNLVSIFWALGLYNGTKPLSQTTVEDITRTDGYAAAWTVPFAARAYIEMMQCRAEKQPLVRVLVNDRVMPLHGCAVDNLGRCKRDDFVEGLSFARAGGNWAECF

SEQ ID NO: 4909 - protein, 326 aa, Aspergillus terreus
MVRLTVLAGFLLTSAACSACVIGERQAASSINNAFKAKGKKYFGTCGDQGTLSDSTNSAIVKADFGQLTPENSMKWDATEPNRGQFSFGGADYLVNYAASNGKMIRGHTLVWHSQLPGWVQGITDKNTLTSVLKNHITTVMQRYKGKVYAWDVVNEIFNEDGSLRKSVFYNVLGEDFVRIAFETARSVDPQAKLYINDYNLDNANYAKTKGMADHVRKWISQGIPIDGIGSQTHLGSGGSWTVKDALNTLASSGVSEVAITELDIAGASSTDYVNVVNACLSVSKCVGITVWGVSDKYSWRSNDKPLLFDSNFQPKAAYNAIISAL

SEQ ID NO: 4910 - protein, 540 aa, Aspergillus terreus
MPSTYDIYKKLLLLASFLSASQAQQVGTSKAEVHPSLTWQTCTSGGSCTTVNGKVVIDANWRWVHNVDGYNNCYTGNTWDTTLCPDDKTCASNCALEGADYSGTYGVTTSGNSLRLNFVTQASQKNIGSRLYLMEDDSTYKMFKLLNQEFTFDVDVSNLPCGLNGAVYFVSMDADGGMAKYPANKAGAKYGTGYCDSQCPRDLKFINGMANVEGWEPSANDANAGTGNHGSCCAEMDIWEANSISTAYTPHPCDTPGQVMCTGDSCGGTYSSDRYGGTCDPDGCDFNSYRQGNKTFYGPGMTVDTKSKITVVTQFLTNDGTASGTLSEIKRFYVQNGKVIPNSQSTWSGVSGNSITTAYCNAQKTLFGDTDVFSKHGGMEGMGAALAEGMVLVMSLWDDHNSNMLWLDSNYPTDKPSTTPGVARGSCDISSGDPKDVETNDANAYVVYSNIKVGPIGSTFSGSTGGGSSSSTTATSKTTTTSATKTTTTTTKTTTTSASSTSTGGAQHWAQCGGIGYTGPTTCVAPYTCQKQNDYYSQCL

SEQ ID NO: 4911 - protein, 404 aa, Aspergillus terreus
MKLSLLAVLALPLALAAPNKRASSFVWFGSNESGAEFGQGNIPGVLGKDYIWPDASAIATLHSAGMNIFRVAFMMERLVPSTMTGTADATYMGDLKATVKAITDMGAYAVIDPHNFGRYYGNIISSTSDFAAFWTTVAKEFASNDKVIFDTNNEYHDMDQTLVLNLNQAAINAIRSAGATSQYIFVEGNSYSGAWTWATVNDNLKALTDPSDKIVYEMHQYLDSDGSGTSETCVSGTIGQERVAAATTWLKNNGKKGFLGEFAGGANSVCKAAVTGMLDALAQNADVWMGASWWAAGPWWGTYMFNMEPPSGTGYTNYLSVLKPYFVGGSGGTTTTTTTTKTSSTTATTTTTKGTTTTTTTTSSTATSGAQHWGQCGGNGWTGPTTCVSPYTCQKQNDWYSQCL

SEQ ID NO: 4912 - protein, 384 aa, Aspergillus terreus
  strain NIH 2624 / FGSC A1156
MVWLAALVLLPLVSAQSPVWGQCGGTGWTGATTCASGSCCVYSNEWYSQCQPCSGSGSTTLTTTTTSKASSTTTTTKAATSSTCALPSKYTWTSTGPLANPKSGYVSLKDFTHVPYNGQHLVYASDVNSAGSYGSMSIGPFADWSAMSSASQNTMSSGTVAPQLFYFRPKSTWVLAYQWGATAFSYRTSSDPTNANGWSSAQPLYSGTLSSSSTGPIDLTLIGDDTTMYLFFAGDNGNIYRASMPIGNFPGNFGSSATVVLSDSQYKLFEAVQVYRVQGQQLYLMIVEAIGSNGRYFRSFTATSLGGAWTAQATTEAAPFAGKANSGATWTNDISHGDLIRSTADETMPVDPCNLQFLYQGRDPSQNPDYNLLPYRPGLLTLKR

SEQ ID NO: 4913 - protein, 435 aa, Aspergillus terreus
  strain NIH 2624 / FGSC A1156
MKFFTAALFASAVSAFAVDSIIPGARVIPATDTLELQHVGAHHHKHPNRRTVTIRSSRNDTDDVSKDFLWGISRANHGGRLLLQKGKKYVIGKKLDLSFLNNIEVQLDGELKFTDDVPYWQKNNFYYSFQKSISFWRWGGQDIKIFGSGVLNGNGQRWYNEFAGQEILDPDNTFYRPILFVTENATRVSVEGITQLNSPCWTNFFVGSNDVSFDNVYIEAFSTNASALPKNTDGFDSYNVKGLSVTNTRVNVGDDCFSPKPNTTDIFVQNLWCNGTHGVSMGSIGQYPGVMDIIEHAYIENVTLLNGQNGARLKAWAGENVGYGRINNITYKNIRIENTDKPVVLDQCYFNVDTATCAEYPSSVNITNITFENVYGTSSGKEGKVVADLVCSPNAVCSDIHLADIDLTSPAGSPPVIICEGIQGDIGVECQSSTS

SEQ ID NO: 4914 - protein, 660 aa, Aspergillus terreus
  strain NIH 2624 / FGSC A1156
MRLSVSLGLASLWTAIGATALNVSQTNSSITLANDRLTAIFSNAGKVVDLYLDGQDLLGPASGSTGVGPYLDCYCTPKGFYTAGSTTPRMEVVQGTDATGTQYAGVILNDTYTPTGQQFQQYWFLRDGETGLHMFSRLAYYNETTPFLRNLQEFRTLFRPNTDLWTHLTSSELQTAPLPSDEAVGKQVVVQDATWRFNNTPNDAYYTQFSEYFTKYTFSNAWRDNNVHGLYADGSTSNGTTFGAWLVMNTKDTYYGGPLHSDLTVDGIVYNYIVSNHHGEGTPNITNGFDRTFGPQFYLFNGGGSSSLNELRSEAESLADPSWNVEFYDSIAKHVVGYVPSSKRGSVQGQIKLPRGATRPIAILTVDGQYFQDNSVDPRSYQYWVEMDANGKFQLDHVVEGKYRLTVYADGIFGDYVRDGVQVRGRKTTRINDSWQPESAGVEVWRLGTPDKSSGEFLHGVARDPTHPLHPPEYLIYWGAYDWQQDFPNGVNYTIGSSDPATDFNTVHWSVFGPTPDNPDVEYDTTHDWAINFSLTKKQLQKRKTATLTIQLAGAKTASGNTDVYKPDEPYTNLALESYINQQEEPLTMLIGFNQSSSCIVRSAVSCYQVRSRMTFPADWLQVGSNTLTLHLPRNATDVEDAILPGTVYVQYDALRLELS

SEQ ID NO: 4915 - protein, 782 aa, Aspergillus terreus
  strain NIH 2624 / FGSC A1156
MHSFLGLVGLLAGVSVSSAAPSVQNITSDTYFYGQSPPVYPSPEGNGTGSWAVAYQKAKAFVAQLTSEEKVNLTAGVTSDTGCSGMIPAIPRLNFPGLCVSDAGDGLRGTDYVNSWPSGIHAGASWNKNLARQRAYHMGTEFHKKGVNVLLGPVVAPLGRVVEGGRNWEGFSNDPYLSGALVYETVKGIQSAGVGACTKVRFPQRLQSSGSNLVQHFTGYEQETNRNPETVDGVDIASVSSNIDDKAMHELYLWPFQDAVHAGSVSVMCSYQRINNSYACQNSKTLNGLLKTELGFQGYVMTDWYGQHGGIAAANAGLDMVMPYTELWGSNLTDAISNGTMEASRLDDMATRIIASWYQVNQNKNFPAPGIGMPADVNEPHQAVIGKSPDSRTTLLQGAIEGHVLVKNTKQALPLQSPRLLSVFGYDAKAGDSLIVNDVSFVNASVQKNHTLYVGGGSGTNSAAYVLAPLDAVQQQAYEDGTSVLWDVVSEDPDVDATTDACLVFINAYATEGYDRPGLVNKESDTLITNVAGKCNNTIVTIHNAGIRLVGDWINHENVTAVIFAHLPGQDTGKALVELLYGRANPSGRLPYTVAKRAGDYGSLLHPSQPEGKYGLFPQSDFSEGVFIDYRAFDKQGIEPQFEFGFGLSYTSFNYSGLAVKKVNRTTEPYPASAPVQEGGNPNLWDEILTVSAKVQNSGSMDGDEVAQLYLGIPNAPVRQLRGFEKVGIPAGQAVNVKFSLTRRDLSVWDTEAQQWKLQSGDYQVYVGRSSRDLPLKGQFSI

SEQ ID NO: 4916 - protein, 307 aa, Aspergillus terreus
  strain NIH 2624 / FGSC A1156
MTPVPVSVDTTADFAAPPTKTAPSTSTRTLLLAPPSIAAHEEKLRDIFATFDRASTDLQMLDRLSAGFVSLPAATYDLVLVLTDTDSARRAEALQLLSRDVYSALVPSMKGGAKLQLQDGTWNSAEGLEAILAGLVEKDGAFEKPAYQEAAVPLRLGGKKKKAPAPTEQPPVATGVGFVDGNDELIDEDDLLSDDDLKRPMQQPANCQPEKAKKRRRPCKDCTCGLAAEMEAEDKARQEKADKDLNVLKLQSTDLSDEVDFTVQGKTSSCNSCSLGDAFRCSSCPYIGLPPFKPGEEVKILNNMVQL

SEQ ID NO: 4917 - protein, 486 aa, Aspergillus terreus
  strain NIH 2624 / FGSC A1156
MQLTQLLALALSLATSEAAYKGFNYGDKKPDGSSKYQADFASEFETAQNLVGAPGFTSARLYTMIQAGTANDPISAIPAAIAQNTSLLLGLWASGNNMNNELTALKAAISQYGEDLSKLVVGISVGSEDLYRNSVLGQKVNAGVGVDPHVLASYIEEVRSTISGTPLSGAPLGHVDTWNDWVNGSNAAVIDAVDWVGFDGYPYFQNTMANSIDDAKALFNEAVAKTKSAAGNKEVWITETGWPVSGKTENLAVASIPNAKRFWDEVGCPLFDNTNTWWYTLQDAFGASVPNPSFGIVGSTLTTQPLFDLSCSKSNTTSSSAIASPTSTAAAAGGVAGGSTGSASGSSTGTGSSSGSGSNSNTGAASGAVGAADRETSGTSGSANTNGTSGSGSGSNSTSGHGSNVTVPTRPTSVSNVSPSKSSSALFTGAATSMGASPSSVGNVGPSKSSGAASPSSTTMFTGAATSVSAPVVHVVLLALMMVIAA

SEQ ID NO: 4918 - protein, 257 aa, Aspergillus terreus
  strain NIH 2624 / FGSC A1156
MAPITEETVAGLKDTIGKLEARIEDLEGRLGQSKPKSVAEQMRIILMGPPGAGKGTQAPRIKEKYCVCHLATGDMLRSQVAKKTELGKEAKKIMDQGGLVSDEIMVNMIKSELENNAECKNGFILDGFPRTVAQAERLDDMLAARQQKLQHAIELQIDDALLVARITGRLVHPASGRSYHKIFNPPKQEMKDDITGEPLIQRSDDNAETLKKRLGTYHAQTAPVCDYYKKTGIWRGIDASQEPGQVWKSLLGVFQKN

SEQ ID NO: 4919 - protein, 326 aa, Aspergillus terreus
  strain NIH 2624 / FGSC A1156
MRPRQSKVTQVLSGAVLLASGAAASCSLPSTYSWTSTEALAEPKSGWTALKDFTNVVSNGQHIVYASTTDSSGNYGSMAFSPFADWSDMASASQNAMSASAVAPTIFYFAPKDVWILAYQWGPTAFSYKTSSDPSDANGWSEAQPLFSGSISDSSTGVIDQTVIGDDTNMYLFFAGDNGRIYRASMSIDNFPGDFGTQSEVVLEDTTNNLFEAVQVYKVDGQDQYLMIVEAIGSAGRYFRSFTASSLDGEWTVQAGTEDQPFAGKANSGASWTNDISHGDLVRNNPDQTFTVDPCNLQLLYQGKDPNSSGDYNQLAWRPGVLTLKV

SEQ ID NO: 4920 - protein, 406 aa, Aspergillus terreus
  strain NIH 2624 / FGSC A1156
MLINFEKVLSLALLAGSVSGRKHVPRGFVTTSGMKFQLDGKDFYFAGSNAYYFPFNDNQTDVELGLAAAKQAGLTVFRTWGFNDKNATYIEGGLPAYGGEGAGTTEVVFQRWANGTSTIDLEPFDKVVNAAKNTGMKLVVALTNNWADYGGMDVYTINLGGQYHDDFYRLPAIKKAYKRYVKEMVTRYRDSPAIMAWELANEPRCGADGVRNLPRSADGCNPEVLTAWIDEMSTYIKKLDPHHLVTWGGEGGFNIESDDWAYNGADGGDFDNELALPNIDFGVFHSYPDWWSKTVSWTNQWIRDHAAAMRTGRKPVVHEEYGWLTPEARLEYLGTVSNITRLEAVGGWQQISVSEKMSDMYWQYGYSGYSYGRNHNDGFTIYLDDPEAKELVYKHAKEVKKLNRRH

SEQ ID NO: 4921 - protein, 847 aa, Aspergillus terreus
  strain NIH 2624 / FGSC A1156
MGHTGRYCSIMLRTIIFIALLGIVSAENGSAGWLRYSRLPSSVVHKFDPPTRIVTLNATSSSPVYSAGKELENGFKGLFGKDLTHLSSGCGRSSSIIVGTFDSFTAACGPLPKEVVLEVDGFWLSTEGHSVRIIGQNERGALYGTFEYLSMLARGNFSSVSYVSNPSAPVRWTNEWDNMDGTIERGYGGLSFFFANGSILPDLTRAAEYARLLASVKINGVILTNVNADPATLKPENIKGLGRIGDAMRPYGVQIGIALNFASPQTLGGLPTFDPLDEDVISWWHNVTAEIYGAVPDFGGFLVKANSEGQPGPLTYNRTLAQGANLFADAVKPYGGIVMFRAFVYSLLNISDWRADRASAAYEAFQGLDGAFKDNVIVQIKAGPLDFQVREPASPLFGYLRNTNVAIELPVTQEYLGQQSHTVYLAPLWKSVLDMDLRVDNESSRVSEIVTGRRFKRKLGGFAGVANAGNNVTWMGSHLSMSNLYAYGRLAWDPTEDSETIVRDWSHLTFGLNPKVTDVVTRIHMESWPAYLNYSSGNTGLPTLTDVTNNHFGPNVRAQDDNGYGIWTRSDSFSIGMDRTVRNGTGFSGQYPPELAVKFEHIDTTPTELLLWFHHVNYTHTLPTGQTVIQYMYDTHYSGAEVAQTFPSMWKGLEKGIDQQRFREVLHQLTFQAGHAIAWRDSIVDYYHNLTQIPDEKGRVGKHEWRIEAESMTLNGYKIISPDPPESASNFSLVTTVTNTTRATAKTKLQVKSGLYDIVVVYFDLGGGVAKWETHLDNRLLGKWQGDNEYTLSHAATQEPDGASKARITFNDVHVKKGDTLEIVGVGDGLDTAPLDYVAVSPRGTMD

SEQ ID NO: 4922 - protein, 723 aa, Aspergillus terreus
  strain NIH 2624 / FGSC A1156
MAALRWLSAVVAVSTTVLAITPEQMLSAPRRGEAIPNPSGNVALFSASQYSFDTKEKSSSWNLLNLKTGDITLLTDDANVSEIVWLGGDDTSLLYINGTNAEIPGGVELWVSSVKDFSKGYKAASLGASFSGLKAVRTRSGDIKFAVNAQSYANGTAYNEELATKYASTARIYDSIYVRHWDTYLTTTFNAVFAGTLKKGKHQYASAGPLKNLVAPVKNAESPYPPFGDSTDYDVSPDGKWVAFKSKAPDVPRANYTTAYIYLAPHDGSSTATPINGPDSPGTPEGVQGDANYPVFSPDSRHLAYFQMAHKSYESDRRVLYVYTLGSKTTTPAVAGDWNRSPDSAKWLDNKHLILGSEDHARVRLFGPVPIDADDDFKPQNFTDGGAVSSYHVLPDKTVLVTGTAIWTSWNVYTASPKKGVIKTIASANKIDPGLAGLGPEDISEFYYDGNWTKIQSWIIYPENFDSSKKYPLFFYIHGGPQSATPDSWSTRWNAKVFADQGYVVVAPNPTGSTGFGQELTDAIANNWGGAPYEDLVKAWEYVDKNLPYVDTENGVAAGASYGGFMINWIQGSDLGRKFKALVCHDGTFVADAKISTEELWFIEHDFNGTFWGARDNYRRWDPSAPERILQFSTPQLVIHSDQDYRLPVAEGLAMFNVLQERGVPSRFLNFPDENHWVLKQENSLVWHQQMLGWLNRYSGIEEANPDAVSLDDTIIPVVNYNP

SEQ ID NO: 4923 - protein, 404 aa, Aspergillus terreus
  strain NIH 2624 / FGSC A1156
MTTYQTLFLIPLAISTLVTAWLPETDKTITSRNGTNLFASSKGKIRGVNMGSQFVFEPWIAEKAWSSMGCKGQKSEFDCVVSLGQDAANKAFAQHWGSWITQDDITEIQSYTLNTIRVPIGYWMKEDLVNKTSEHFPQGGFAYLEKLCGWASDAGLYIILDLHGAPGAQTPHNPFTGQYASTAGFYNDYQFGRALEFLEWITTKVHQSDSFRNVGMLEIVNEPLQNAQKVGSMRSTYYPDAFKRIRAAEQKLNVSKSGYLHIQMMDKLWGSGDPEEYLTDKYYVAYDDHRYLKWDPKVNVSKENYISTSCSDELDSNTPTIVGEWSLSVPDDVASTPDWDMDTNKDFYKKWFAAQITAYEKQRGWVFWTWKTQLGGYRWSYKDAVAAGVVPEDIDSALNMGVCN

SEQ ID NO: 4924 - protein, 311 aa, Aspergillus terreus
  strain NIH 2624 / FGSC A1156
MAPFSFILTVLLYALTCSARALGHAHALLPRAGSLEQVTDFGDNPTNVGMYIYVPNNLASSPGIVVAIHYSPEGTGTAEAYYTGSPYAQLAEQYGFIVIYPQSPYEGTCWDVSSQETLTHNGGGNSNSIANMVTWAISKYNADSSKVFVTGSSSGAMMTHQNVMAATYPELFAAATVYSGVPAGCFYSSSNQQDGWNSTCAQGQVITTPENWANVAKGMYPGYNGTRPKMQIYHGSVDTTLLPQNYYETCKQWAGVFGYNYDSPQQVQDNTPQSNYATTTWGDDLQGIFATGVGHTVPIRGDDDMAWFGFA

SEQ ID NO: 4925 - protein, 839 aa, Aspergillus terreus
  strain NIH 2624 / FGSC A1156
MTRLDVEKTIEELTLGEKVALTAGIDFWHTASVPRLNIPTLRMSDGPNGVRGTRFFNGVPAACFPCATALGATWDTELLHECGRLMGEESIAKGSHIILGPTINTQRSPLGGRGFESFAEDGVLSGNLAGYMSKGIQEKGVAATLKHFVCNDQEHERLAVDSIVTMRAMREIYLMPFQLAMRICPTACVMTAYNKVNGTHVSENKQIITDILRKEWGWDGLVMSDWFGTYSTSEAINAGLDLEMPGKTRWRSTPLAHAVSSNKVAEFVMDERVRNVLNLVNFVEPLGIPENCPEKALNRPQDQALLRRAAAESIVLMKNDDNILPLKKDKPILVIGPNAKIAAYCGGGSASLDPYYTVTPFEGVSAKSTGAVTFSQGVYSHKQLPELGPLMKSADGKKGFSFRVYKEPVSAPSRELVDELHLVSSSGFLMDYVHPKIDSLTFYVDMEGYFTPEEDGVYDFGVTVVGTGKLLIDGETVVDNTKNQRPGSAFFGTATVEEQGSKELKAGQTYKVVLEFGTAPTSDLDTRGVVVFGPGGFRFGASRRVSQEELIAKAADAAAQAEQVVIFAGLTSEWETEGHDRDHMDLPPGSDEMIQRVLAANPNTAVVIQSGTPVTMPWAAQTKALVQAWFGGNECGNGIADVLYGDVNPAGKLPLSFPVRLQDNPSYLNFRSERGRVLYGEDVYVGYRYYEKVNLAPLFPFGHGLSYTTFERSDLTLATVPEKPQYETAGEPITASVTVTNTGPVAGAEVVQLWVRPPPTGVNRPVRELKGFAKVMLNPGEQKRVDIVVEKKLATSWWDEQREMWASEKGQYEVQVTGTGADVLTSSFAVEKTRFWLGL

SEQ ID NO: 4926 - protein, 765 aa, Aspergillus terreus
  strain NIH 2624 / FGSC A1156
MYSSNSRRAASILACIVSLTQLGFAQSPFPDCENGPLSKNAVCDTTLDPVTRAQALLAAMTLEEKINNTQYNSPGVPRLGLPAYNWWSEALHGVAGSPGVHFADSGNFSYATSFPSPITLGAAFDDDLVKQIATVIGTEGRAFGNAGHAGLDYWTPNINPYRDPRWGRGQETPGEDPFHTSRYVYHLIDGLQDGIGPEKPKIVATCKHFAGYDIEDWEGNERYAFDAVISDQDMAEYYFPPFKTCTRDAKVDAVMCSYNSVNGIPTCADPWLLQTVLREHWEWEGVGHWVTSDCGAIDNIYKDHKYVADGAHAAAVAVNAGTDLDCGSVYPQFLGSAISQGLLGNRTLDRALTRLYSSLVKLGYFDPAADQPYRSIGWSDVATPDAEQLAHTAAVEGTVLLKNDGTLPLKKNGTVAIVGPYANATTQLQGNYEGTAKYIHTMLSAAAQQGYKVKYAPGTGINSNSTSGFEQALNAAKGSDLVIYFGGIDHEVEAEALDRTSIAWPGNQLDLIQQLSDLKKPLVVVQFGGGQVDDSSLLSNAGVNGLLWAGYPSQAGGAAVFDILTGKTAPAGRLPVTQYPEEYVDQVPMTDMNLRPGPSNPGRTYRWYDKAVIPFGYGMHYTTFDVSWKRKNYGPYNTAAVKAENAVLETFSLQVKNTGKVTSDYVALVFLTTTDAGPKPYPIKTLVGYQRVKAIRPGERKVVDIDVTVGSVARTAANGDLVLYPGSYKLQVDVEKDYPTAGFKIAGKEVVLDHFPQPPRNATKA

SEQ ID NO: 4927 - protein, 451 aa, Aspergillus terreus
  strain NIH 2624 / FGSC A1156
MRLWPLTFWVTLVTAWVDNRGTTCVLYPESLVHRGQPVDDAPSIQQAFDMCGTNGTVIFSENVFHVNTVLNTTNLLNCDVHLRGELRFSTNIPYWRTHSISVVLQDQVTAWLFGGQNVNFYGEGGFYNGQGQAWYNANRNESNQAGRPMSMTFYNSTNLLVDGLKVVQPQFWATFVWASRNVTFTNLFVNATSNSEWGTMNTDGFDSWQSDNLLVENATIISGDDCIAAKGNTTNLLARNIYCEGGTGITIGSIGQYPDMPDYNLNTTFENVTIKNAMDGAYIKTWQGTRIFTPSNGDWGGGGTGLVKNITFRNFEMDNVGLPIQVSQCVYSAGSDKNCNTSTLQIEDVKWENIHGTSRFNIASSIYCSDERPCPNITFENVNITSLNATRGLPYYGTDMQHELFQCTNVLGQKSSGIPCNQAAPSNFSQWIYGNVDSSGLSTGTSGHLGN

SEQ ID NO: 4928 - protein, 281 aa, Aspergillus terreus
  strain NIH 2624 / FGSC A1156
MKQFSAKFALALSAAAGQALAASTQGISEDLYNRLVEMATISQAAYANMCNIPSTITVGEKIYNAQTDINGWVLRDDSTKEIITVFRGTGSDTNLQLDTNYTLTPFSTFSECSGCEVHGGYFIGWSSVQDQVMSLVKEQADQYPDYTLTVTGHSLGASMATLAAAQLSGTYDNITLYTFGEPRSGNEAFASYMNDKFTATSADTTKYFRVTHSNDGIPNLPPAEQGYVHGGVEYWSVDPYSAQNTYVCTGDEVQCCEAQGGQGVNDAHTTYFGMTSGACTW

SEQ ID NO: 4929 - protein, 326 aa, Aspergillus terreus
  strain NIH 2624 / FGSC A1156
MVRLTVLAGFLLTSAACSACVIGERQAAASINNAFKAKGKKYFGTCGDQGTLSDSTNSAIVKADFGQLTPENSMKWDATEPNRGQFSFGGADYLVNYATSNGKMIRGHTLVWHSQLPGWVQGITDKNTLTSVLKNHITTVMQRYKGKIYAWDVVNEIFNEDGSLRKSVFYNVLGEDFVRIAFETARSVDPQAKLYINDYNLDNANYAKTKGMADHVRKWISQGIPIDGIGSQTHLGSGGSWTVKDALNTLASSGVSEVAITELDIAGASSTDYVNVVNACLSVSKCVGITVWGVSDKYSWRSNDKPLLFDSNFQPKAAYNAIISAL

SEQ ID NO: 4930 - protein, 325 aa, Aspergillus terreus
  strain NIH 2624 / FGSC A1156
MRLPTLFMLAAIATASPMSDLNRREMTRRQAAESCPIGYCTQNGGTTGGTAGDTVTVTDLAGLTEAAENETPLTIIVSGAISGSAKIRVASDKTIYGETGSSITGVGFYIRRVSNVIMRNLKIGQVDADNGDAIGIDESTNVWVDHCDLSGDLSAGKDDLDGLLDITHGAEWITVSNTYFHDHWKGSLIGHSDSNEGEDLGHLHITYANNYWYNVNSRTPSIRFGTVHIINNYWDNLLLTGVNCRMDAQVLVQSSAFSNCPDEAIFFADSDYTGYAVVDDVDLGGSTNSVPEGTLTPSSLPYDAIEAIGSAQIATTIPGTAGQKL

SEQ ID NO: 4931 - protein, 471 aa, Aspergillus terreus
  strain NIH 2624 / FGSC A1156
MNSLTKSIIAAGLVFHPLVQAQQPSSSSPGNPSLTTWKCTTGGGCLQQDTSVVLDWGFHWIHTSNSQSCTTSSGVNSALCPDEATCAKNCVIDPANYATAGVATSGDTLTMHQYYQNNGVITNASPRLYLLGSDGNYVMLKLLGQELSFNVDLSTLPCGENGALYLSEMSATGGRNEYNTGGAQYGSGYCDAQSPVMAWRNGTLNTSGQGFGCNEMDILEANSRANSFTPHPCNGNDCDKGGCGFNPYALGQQNYWGPGGTVDTSKPFTITTQFITDDGTKTGTLKEIRRQYIQNGKIIANAKSSAGVDSITEPWCESVDGAAATYGGLKRMGEALGRGMVLIFSIWNDAGGFMNWLDSGSAGPCSSTEGNPSLIQSAHPDTHVVFSNIRWGDIGSTYTNPGGSGSSSSSTTTTTKTTSTTTTTKITTTTSAGGATQTHWGQCGGQGWTGPTACASPYTCQKQNEWYSQCL

SEQ ID NO: 4932 - protein, 420 aa, Aspergillus terreus
  strain NIH 2624 / FGSC A1156
MLRKLTPLALALLPLVAGQTIGETPEVHPKLPTWKCSNRHGCVKQDTSVVIDAATHWIHEKGGETSCTGSSGPNPNLCPDKETCAANCVIEGISDYANYGVQTKGSSMTLHQYLRDGNTTKSVSPRVYLLAEDGENYEMLQLLNQEFTFDVDVSTLVCGMNGALYFSEMQRDGGRSELNPAGAARGTGYCDAQCFNIPWINGEANVEGAGACCNEMDIWEANARATGYTPHPCNITQLYECSGAECEANGVCDKPGCGFNPYALGAHDFYGYDLEVDTTKPMTVVTQFYTKDNTTTGALVEIRRLYVQNGHVIQNAVVSVDGESVDSITADYCADPSSAFNRLGGLQRMGEALGRGMVLAFSVWNDAGSFMSWLDGGNSGPCNATEGDPALIEKLHPDTHVTFSNIRWGDIGSTYRGKRR

SEQ ID NO: 4933 - protein, 843 aa, Aspergillus terreus
  strain NIH 2624 / FGSC A1156
MASFFQQSLATGWSFKDAEDNSAEAWMPVAQVPSVVHQDLIANNKLQDPYVGFRELDARWVNEKSWTYRTVFQKPAVPAGSSVILAFDGLDTFAKVKLNGNVILESNNMFLAHRIDVTKALGADGDHVLEIDFDCAMLRARELRAKDPQHKWVGFNGDPARMGVRKAQYHWGWDWGPVLMTAGIWRDVRLEVYTARVADLWTETDLAVDHHAAQISAFAQVEGAISSSKVNFILSLHGQEVARAVAEPQDQVAKVAFDVQQPSLWWPNGYGDPTLYEISATLDQDGATVHQISKKIGIRTAEVVQRPDKHGKSFFFRINGVDIFCGGSCWIPADNLLPSISAERYRKWIELMVHGRQVMIRVWGGGCYEDDSFYQACDELGVMVWQDFMFGCGNYPTWPEMLESVEKEAIYNVRRLRHHPSIVVYVGNNEDYQVQEQQGLTYNFEDKDPQNWLKSDFPARYIYEKILPEVVQRYSPSTFYHPGSPWGDGKITSDPTVGDMHQWNVWHGTQEKYQIFDTLGGRFNSEFGMEAFPHMSTIEYFVENEKDKYPQSHVLDFHNKADGHERRIATYLVENLRTATDLETYIYLTQVVQAETMMFGYRGWRRQWGDERHCGGALLWQLNDCWPTISWAIVDYFLRPKPAFYAVARVLNPIAVGVRREHHDWSVTHAQPPKKSKFELWVASNLQKETRGMVELKFLSVDTGREIRERIVREDVIIVPNGTTDIIVDGVIDHQEYAEPHVLAARLWVDGKIVARDVDWPQPFKYLDLSGRGLEVKTVSTSDDQQTLLISAQKPVKCLVFEERDGVRVSDSAMDIVPGDEQTVTITGLKADAPPLKYKYLGQ

SEQ ID NO: 4934 - protein, 388 aa, Aspergillus terreus
  strain NIH 2624 / FGSC A1156
MKLSPLMALAGLASAQLALALPQATPSASATPSPTPGDGSFASTNGLQFVIDGETGYFAGSNSYWIGFLTNNADVDLVFTHMKEAGLRILRVWGFNDVNEKPADGTVWFQMHADGQSTINTGADGLQRLDYVVQSAEKHGIKLIVNFVNYWDDYGGMNAYVQAYGGSDNTDFYASKDMQAAYRAYIKAVVSRYLDSPAIFAWELANEPRCQGCAPSVLHDWIDSTSQYIKSLDSKHMTCIGDEGFGLDIGSDGSYPYGYSEGGNFTMSLALPTIDFGTFHLYPSSWGTNNDWGNGWVASHGAACKAAGKPCLFEEYGVTSDHCAVEKPWQMTALNTTGIAADLYWQYGDQLSSGQSPNDGNTIYYGTDEFTCLVTDHIASIGSRATRK

SEQ ID NO: 4935 - protein, 234 aa, Aspergillus terreus
  strain NIH 2624 / FGSC A1156
MRSTAAVLSILLPGALACLGYEGGVPKPTAHYSNSKVIEIAAGQVFDAGWAKYDRGSGACSGDSEGSWQDAVFYLHSGATLKNVIIGKDQAEGVHCDGPCNLEFVWFEDVCEDAITIKNDKAGQETWIVGGGAYHASDKIVQHNGCGTVNIINFYAEDYGKVYRSCGNCSSQCKRNVYVEGVTARDGGEVVGINSNYGDTATLKNVCTDASHPCVLYKGCAGGCEPSKVGYCSG

SEQ ID NO: 4936 - protein, 209 aa, Aspergillus terreus
  strain NIH 2624 / FGSC A1156
MKLLTVLTLLTGLVAASPIDLEKRQRNELRVGACEEITFIFARASTETGYLGGSTGPGVCNGLKLARVGQVACQGVAPRYTADLASNFLPQGTSQAAIDEAVELFQLAASKCPNTKIVAGGYSQGTAVMHNAIPALPDNIKNMIKGVVLFGDTRNQQDGGRIPNFPTDKTKIYCAVGDLVCEGTLVITAAHFTYMANVADAVSFLLARV

SEQ ID NO: 4937 - protein, 270 aa, Aspergillus terreus
  strain NIH 2624 / FGSC A1156
MAILSRLLTTVTLGSLLTSAVAQSSGCGKQPTLTNGVQNINGREYILNIPEGYDSSKQYKLIFGLHWLGGSMNDVVSGNSIEPWYGLESRAEGSAIFVAPNGLNAGWANNGGEDTALMDAIIEAVEADLCIDQSSRFATGFSFGGGMSYALACARASKFRAVSVLSGGVISGCDGGNDPIAYLGIHGINDPVLPIDGGIEMANKFVQNNGCQSADVGRPNSGSGQSVRTDFQGCSRPVSFIAYDGGHEGAPLGVGNPLAPDATWEFFTGA

SEQ ID NO: 4938 - protein, 506 aa, Aspergillus terreus
  strain NIH 2624 / FGSC A1156
MLLPRGFNRAVVTALGVVGTGTLVAAGPCDIYSSGGTPCVAAHSTTRALYSAYTGPLYQVKRGSDGATTNIAPLSAGGVANAAAQDSFCAGTTCLITIIYDQSGRGNHLTQAPPGGFKGPEANGYDNLASAIGAPVTLNGQKAYGVFISPGTGYRNNAASGTATGDAPEGMYAVLDGTHYNGGCCFDYGNAETSSTDTGNGHMEAIYFGDNTVWGSGSGSGPWIMADLENGLFSGSSTKNNAGDPSVSYRFLTAIVKGKPNQWAIRGANAASGSLSTYYNGARPNASGYNPMSKEGAIILGIGGDNSIGAQGTFYEGVMTSGYPSDATENSVQANIVAAKYAVAPLTSGPSLTVGSSISLRATTSCCTTRYLAHNGSTVNTQVVSSSSSTALKQQASWTVRAGLANSACFSFESKDTPGSFIRHYDFVLQLSANDGTKQFYEDATFCPQSGLNGQGSSIRSWNYPTRYFRHYNNVLYAASNGGVHTFDATGSFNDDVSWVVSTSFA

SEQ ID NO: 4939 - protein, 736 aa, Aspergillus terreus
  strain NIH 2624 / FGSC A1156
MNYRVPSLKATALAMAALTQALTTWDAAYEKALADLASLTQSEKVGVVSGITWEGGPCVGNTYAPESIAYPSLCLQDGPLGIRFANPVTAFPAGINAGATWDRELLRARGAAMGEEAKGLGVHVQLAPVAGALGKIPSAGRNWEGFTSDPYLSGIAMAETIHGMQGSGVQACAKHYILNEQEHSRETISSNVDDRTMHEVYLWPFYDAVKANVASVMCSYNKINGTWACENEGILDTLLKQELGFRGYVMSDWNAQHSTVASANTGLDMTMPGSDFSQPPGSIYWNENLAEAVANGSVPQARVDDMVTRILAAWYLLEQDQGYPAVAFDSRNGGKASVDVTADHADIARTVARDSIVLLKNSNNTLPLRNPSSIAVVGSDAIVNPDGPNACTDRGCNVGTLAQGWGSGTAEFPYLVAPLDAIQERSSGNGTKVVTSTTDDATAGADAAASADIAIVFISSDSGEGYITVEGHQGDRNNLDPWHGGNDLVKAVAAVNKKTIVVVHSTGPVVLETILAQPNVVAVVWAGIPGQESGNALADVLYGDVSPSGKLPYTIGKSEADYGTTWVANGADDDFPEGLFIDYRHFDKNEIEPRYEFGFGLSYTRFNFSNLAINIDATSGPTSGAVDVGGAADLYDSVGTISATVTNVGGVSGAEVAQLYIGFPSSAPETPPKQLRGFQKLPLAGGADGVAEFELTRRDISYWDVGQQKWVVPEGSFQVYVGASSRDIRLDGSFTV

SEQ ID NO: 4940 - protein, 725 aa, Aspergillus terreus
  strain NIH 2624 / FGSC A1156
MTIENGIAKAIYVDGTKFVLNGRHVSYCFHVDDETGDLRTDHFGGRVTGAIPVDPSPVVDGWTGMPDRVRREFPDQGRGDFRIPALRIRQAEGHTVSALKYQSYTLLHGKPDLPGLPATFGTEKDVSTLVVHLRDEYSSVTADLIYSVFPEYNAIVRSVSITNNGFQPISIEALASFSTDLPYEDLEMISLRGDWAREAHRMRRKVEYGTQGFGSTTGFSSHLHNPFLALAHPSTTESQGEAWGFSLVYTGSFEVNVEKGSQGLTRAVLGFHPNQLSWPLSPGETLTSPECVAVYSNHGLGGMSRSLHRLFRDHLIKSKFATANRPVLLNSWEGLYFDIDETSMIRIAKESAALGVKLLVMDDGWFGKDYPRTSDAAGLGDWVPNPARFPNGLAPMVDQITSLKVANSSANLLFGIWVEPEMVNPDSALYREHPEWALHAGSYPRTEQRNQLVLNLALLEVQEFIINFMTDLLSSAKISYVKWDLNRGINETSAPKATHAYMLGMYKVFDTLTSRFPDVLWEGCAAGGGRFDPGILQYFPQIWTSDDSDAVERIFIQMGSSLAYPASAMGAHISAVPNHQTGRTTPLSLRAHVAMMGGSFGLELDPSQVSAEEKALIPELIALAEKVNPIVLTGDMWRLSLPEESNWPAVQFISQDQSQVVLFYFQLSPNVNHSMPRVRLQGLDEDAMYRVDGAGPYSGAMLMNLGLQYSFRTEYGSRVVFLEKQ

SEQ ID NO: 4941 - protein, 371 aa, Aspergillus terreus
  strain NIH 2624 / FGSC A1156
MHYLHSASLIAPLLAATKVAAHGHVTNVVVNGVYYQGFDIGSFPYMADPPKVAAWTTPNTGNGFISPEQYGSADIICHENATNAQAHIPIKAGDRINLQWTAWPESHHGPVIDYLARCDGSCSTVDKTSLEFFKIDGVGLVDDSDVPGVWGDDQLIKNNNSWMVEIPKSIAPGNYVLRHELIALHSAQTEGGAQNYPQCFNLQVTGSGTDQPSGVVGTKLYSESGPGIVVNIYSSLSSYTVPGPTMYSGAASITQTSSAVTSTGTAVTGTGGASQAAVAVPTSEVTTLPVQVPTTLMTSAATPVSSSAIPSSSSIVPSTSPTSSPSAGTYGTQKLYGQCGGEGWVGPTACGQGATCRAYNRYYHQCVSSTN

SEQ ID NO: 4942 - protein, 216 aa, Aspergillus terreus
  strain NIH 2624 / FGSC A1156
MNYKLLTLALASLAAANPIERQRKIHPAVLSGGDELRNGDCQPVTFIFARASTEQGLLGGSTGPALCNRLKSALDGVACQGVGPKYQATLAANALPKGTSDEAIEEAQSLFQLAAEKCPDTQIVAGGYSQGTAVMHGAIPGLDDALKDKIKGVVLFGDTRNQQDNGQIPDFPKDKIKIYCAAGDMVCYGTLIVAAPHFSYIADVPDAADFLVSKLE

SEQ ID NO: 4943 - protein, 360 aa, Aspergillus terreus
  strain NIH 2624 / FGSC A1156
MKTSFGLLALAAAAKLVNAHATVFAVWINDEDQGLGNTADGYIRSPPNNSPVTDVTSKDMTCNVNGATAAAKTLDVKAGDKITFEWHHNSRDASDDIIASSHLGPVMVYMAPTEKGSAGSGWVKIAEDGYSNGKWAVDTLIANRGKHSITVPDVPAGEYLFRPEIIALHEGNREGGAQLYMECVQVKVTSDGSKTLPEGVSIPGTYTATDPGILFDIYNSFDSYPIPGPAVWDGSSSGSSSGSSKTTAAAPAATSAASASSTKAPATTAAPVQTESAKPATSTTQAAAPTTLVTSAKPTATATAGAGDSGSGSCSATAPATGVVKMYAQCGGMNYSGSTTCESGLTCKQWNPYYHQCVKA

SEQ ID NO: 4944 - protein, 558 aa, Aspergillus terreus
  strain NIH 2624 / FGSC A1156
MKAAILATAAALTGSALADVAHMRRGHDSFHHRRAMHAQEPEETCGCTTEVITFYGSPTLVPISTPSATPTPAPAPETTSTEEVTTTLHSTSTSTVTVTATPETPEVTLPTPGVTSFSSTGVYTIPATTLTVTDTTTVCGATSTELPSGTATYGGVTTVVETSTTVVCPYATVKPSGSTVTSVIETTTYVCPSAGTYTVVPPTTTYVPTSTVMVYPTPATFTPGTYTQDAQTVTVTRTDYTYVCPTFHPELPSSSAPAPTTSAVPTTTAVPTSTVVPSSTTSVPASSSSSSAEVPQTTGSGQMGMTYSPYTNAGGCKSKADVLQDIATIKQKGFTHVRVYSTDCSSLEWIGEGAKQQGLIMILGVYIDSSGVSGAQSQVTDIANWAEWDLVSLIVVGNEAIQNGYCTASELASFITSAKQAFKAAGYSGQVTTTEPINVWESSGSALCSSIDILGANIHPFFNSEVTASQAGKFVQSQVDILEKICPGKDVINLETGWPSKGSANGLAIPGTSQQSEAIKSLRNDVGALSVFFSFSNDLWKSPGAFDVEQYWGCIDQF

SEQ ID NO: 4945 - protein, 237 aa, Aspergillus terreus
  strain NIH 2624 / FGSC A1156
MRSFFSLALIASATGILASPADPMITASPTLAKRATSCTFSGSNGAASASASQKACATMVLSALAVPSGTTLDLSDLADDTTVIFEGETTWGYKEWSGPLLQISGKGIKVQGASGAVLNPDGARWWDGEGSNGGKTKPKFFYAHDLSDASITDLHITNTPVQAVSINGCDGLTVTDMTIDNSAGDSAGGHNTDGFDIGSSSDVTITGAKVYNQDDCVAVNSGTGVTFSGGLDEWYVM

SEQ ID NO: 4946 - protein, 526 aa, Aspergillus terreus
  strain NIH 2624 / FGSC A1156
MHVNTLSVLSLVGLVPLAAARLSGSVGPLTSASAKAATKTCNVLDYGAAADKTTDLGAPLASAFADCKTGGLVYVPPGDYALESWAQLSGGKAWALQIDGTIYRTGTDGGNMIFIEHSSDFELFSSTSSGAMQGLGYEFHKDDNWSGPRLLRLYDVSDFALHDFILVDSPSFHLSLDTCSNGEVYNMAIRGGNHGALDGVDVWSTNIWIHDVEVTNKDECVTVKSPAQNILVENIYCNWSGGCGMGSLGADTNISDITYRNVYTWNSNQMMLIKSNGGSGTVSNVVLENFIGHGNAYSLDIDSAWSSMSTQSGDGVEFSNFTIRNWKGTEANGAERGPVKIICPNGAPCYEMYIEDFAMWTEEGDEQWYTCQSAFGSGFCLQSGSDYSSYEATTSTATSAPSGYSAPTMASDLTRDFGSTVSIPIPTIPTSFYPGATPYSALMGAQSSASANVRAVAFGTSAVVSRAGSSSRPAQTGSFLTKSTTAAAGSIMGPTAAAVQGVCAPPAGQGRGAARYGGHRRHGHRH

SEQ ID NO: 4947 - protein, 388 aa, Aspergillus terreus
  strain NIH 2624 / FGSC A1156
MKTATFSTLLALSASAVNAQVSGTAFGFAAGTTGGGSAAPETPSSIDELVEWLTDDTARTIMIDRTWDFTGTEGTTDGQCCSTRTTTCEGGTSAGQAWIQDTCDDGTWVSCTYDNAAKNPINVGSNKSIVGVGSDGVLKGKGLRITGGNSNVIIQNIHITDLNPQYVWGGDAITLDDADLVWIDHNKISLIGRQFIVSGWGKAGRVTISNNEFDGVTDWSAGCNGKHYWTLLLIGEQDFYTFSDNWVHDVSGRAPHMGTDMTESTIFFHGVNNYFQNIGGHAFDIDTNTWALLEGNYFESVDTPLTETSLTSGALIYNVPTVDSASACTSPLGYICEWNRLAGSGTWTERTDADVLTMASQYIDSLIDHIPVADVPTTVVANAGVGKL

SEQ ID NO: 4948 - protein, 633 aa, Aspergillus terreus
  strain NIH 2624 / FGSC A1156
MRLLSLAGAMALPLCVLAHPTHRTRGIARRGIDLTPYRLPGNAEYTSSRTSAMRSLLFERADGEDYVETAKKVLQSVHPDATFRVIDDHYVGDNGVAHVHLLQTAHGIDIDNANFNVNIDKNGKVLSYGNSFFSGKIPDSDPLTKRSFSDPVEALKAAATGLGIPLTADDVTSEGLDGTTSYTFKGTKGALSDPTADLVYLAKPDNTLALTWRVETDMNSNWLLTYVDAETAETIHGVVDYISDATYQVYPWGLNDPTEGSRQILEDPWDSKASEFTWIGDGKAKYKTTRGNNGIAQSNPDGGDDYLNNHRPESSSLKFVYPYSPNATSPSSYIDASITQLFYTANTYHDLLYTLGFNEKAGNFEANNNGAGGKGNDFVILNAQDGSGTNNAMFGSPPDGRPGRMYMFIWTESNPPRDGSMEAGIVIHEYTHGLSSRLTGGPANARCVDGEESGGMGEGWGDFMATAVRLKSGDTRQTDYTMGAWAANDPKGIRDYPYSTSMTKNPLTYAHLNNVTEVHEGGTIWASMLYEVMWNLIDKHGKNDAPKPDLKDGVPTDGKYLSMKLVMDGMALQPCNPSFIQARDAILDADVALTKSGNQCEIWKGFAKRGLGERAALKNGIRVDSFDVPKGVC

SEQ ID NO: 4949 - protein, 468 aa, Aspergillus terreus
  strain NIH 2624 / FGSC A1156
MGRVSSLALALLLPAVQAQQTLWGQCGGIGWTGPTNCVAGAACSTQNPYYAQCLPGTATTSTTLTTTTRVTTTTTSTTSKSSSTGSTTTTKSTGTTTTSGSSTTITSAPSGNPFSGYQLYANPYYSSEVHTLAMPSLASSLLPAASAAAKVPSFTWLDTAAKVPTMGTYLADIKAKNAAGANPPIAAQFVVYDLPDRDCAALASNGEYSIANGGVANYKKYIDAIRAQLLNYPDVHTILVIEPDSLANLVTNLNVAKCANAQSAYLECVNYALIQLNLPNVAMYIDAGHAGWLGWPANIGPAAQLFAGVYKDAGAPAALRGLATNVANYNAFSISTCPSYTSGDANCDENRYINAIAPLLKDQGWDAHFIVDTGRNGVQPTKQNAWGDWCNVIGTGFGVRPTTNTGNSLVDAFVWVKPGGESDGTSDSSSARYDAHCGYSDALQPAPEAGTWFQAYFEQLLKNANPAF

SEQ ID NO: 4950 - protein, 231 aa, Aspergillus terreus
  strain NIH 2624 / FGSC A1156
MVSFLRLAVACFAAVGALAAPVESLEERSDELFNSTLHEFAERSTPSSTGWSNGYYYSFWTDGGGSVTYTNGAAGQYSVQWSNVGNFVGGKGWNPGSARTINYGGSFNPSGNGYLAVYGWTTNPLVEYYVVESYGTYNPGSGGTYKGTVNSDGGTYNIYTATRYNAPSIIGTATFTQYWSVRTSKRTGGTVTMANHFNAWASHGMNLGTHNYQIVATEGYQSSGSSSITVY

SEQ ID NO: 4951 - protein, 434 aa, Aspergillus terreus
  strain NIH 2624 / FGSC A1156
MKFLHTVAQTATLLLSLGASVEGFNRARNDACKPHHPFRPLPASTPRTKTCHVRSHGDGTDDAAFVLSALRKCNNGGKVVFDADKEYTIGTALDMTFLRHVDLEILGRIQFTNDTDYWQAHAFRHGFQNATTFFQLGGTDVNVYGSGTLDGNGQVWYDLYAAEPLTLRPILLGVIGLHGGTIGPLKLRYSPQWYQLVANSTDVLFDGIDISGYSSSKNTAKNTDGWDTYRSSNIVIQNSVVNNGDDCVSFKPNSTDILVQNMHCNGSHGISVGSLGQYKGEIDIVKNILVYNISMYNASDMARIKVWPGVDSALSEDLQGGGGSGAVSNITYDRMYIENVDWAIEVTQCYGQKNQTLCNQYPSNLTISDVHIKNMWGTTSGKRDPNVGTIVCSSPDVCSDIYVTNVNVTSPSGTDDYICTNVDESLLDVNCSSG

SEQ ID NO: 4952 - protein, 248 aa, Aspergillus terreus
  strain NIH 2624 / FGSC A1156
MRFTRSLPFVLSLFTAALADVEFTTPTVDTVLKAGDVVTVHWKDSGIPPRISELTQYDLYLCAGEDLTGLNEEIALLMKDVAFARGNSVSFKIDPALGADVPEAYFLKMVSSGPDAFTINYSHRFSISGMAGTFSPDSIQSIREDRAELRKRQAQGAYTIPYELQVGPTRYAPMAKQPGSTIPPNLSPTPQHPASPYTIATTFLPAPTVQQTMTATLTHSVVSMENTASPAPNPHDAQMKRYLERWKD

SEQ ID NO: 4953 - protein, 116 aa, Aspergillus terreus
  strain NIH 2624 / FGSC A1156
MKLTGLLSLALLTTLALAAPDPKKNGPNRDWCGQVCTGKNDCSGECNKCVNFVCKRTSVLIYKEYLHKNATDHAARLNATRHLTIMIDETTRVDHVTVKFNVETYGMESITRRPEA

SEQ ID NO: 4954 - protein, 527 aa, Aspergillus terreus
  strain NIH 2624 / FGSC A1156
MAPIHYLLPIITLGSAALARQDAFEAKCHSFANKIHLPNVHVNFASYVPGGTNLTLADNPSSCGATSQSVSADVCRVAMAVATSNSSEITLEAWFPRNYTGRFLSTGNGGLSGCIQYYDMAYTTGFGFATVGANNGHNGTSGEPFYHHPEVLEDFAYRSIHTGVVIGKKLTKMFYEEGFNKSYYLGCSTGGRQGFKSVQKYPNDFDGVVAGAPAFNFANLISWSAHFYPITGPPGSDTYLSPAMWKVAHDEIIRQCDQIDGAKDGIIEDPSLCNPIMETIICKPGASSDNCLSAAQAKTVREVLYPLYGVNGTLLYPRMQPGSEVLAAPIMYNGQPFAYSTDWYRYVVYNDPNWNGTTFDVQDAAAALAQNPYNIQTWDADLTPFRKSGGKVLTYHGLQDQLISSENSKLYYARVAETMGMPPEELDEFYRFFQISGMGHCGGGDGAYGIGNGLATYSGKDPENNVLMAMVQWVEKGIAPETVRGAKFANGPGSTVEYSRKHCRYPRRNVFKGPGNYTDENAWECVV

SEQ ID NO: 4955 - protein, 232 aa, Aspergillus terreus
  strain NIH 2624 / FGSC A1156
MASVALIGCTGMVGSHILTSLLAHPSVARVDTISRRTPNAASAAQAKLTTFVSDDTSKWASQLSALTPIPSIFFSSFGTTRAAAGGFENQYKIEHGLNVEMARAARDAGTKVYVLVSSSGASKDSSIPYSRMKGEIEEEAKAMGFEHTVILRPGLISGTREESRPLEAAARYIAGFAGKVHSGLKDSWAQDADVIAKAAVNAGLKALEGDVPAGSEKVWVLGGSDIIKLGKE

SEQ ID NO: 4956 - protein, 783 aa, Aspergillus terreus
  strain NIH 2624 / FGSC A1156
MRVPAQATIAVLASAVSSPLNDPQIYDLDDPYHDLNDFNLRWIADANWTYTSDPIRGLGNNTHSTWLVFEGLDTFATIKYCDKQIASTNNQFRQYAFDISEAVKDCTADPVLSLNFGSAPKIVDQIAADPASPQWPFGIQQSYEYPNRWFMRKEQSDFGWDWGPAFAPAGPWKPAYLVQLSSEQNVHVLNTDLDIYRQGQINYLPPDQTQPWVLNASIDFFGSLPSNSSMSIAISETNSGAELTTQSLRNITILNGSITGVAVLKDASPKLWWPYGLGEQNLYNVTITVSDGVRSLARVTKRTGFRTIFLNQRNITDTEIAQGVAPGAHWNFEVNGHEFYAKGSNLIPPDAFWARVTTTKMARLFDSVVAANQNMLRVWSSGAYLPDFMYDLADERGVLLWSEFEFSDAMYPVDKAFLDNVAAEVVYNVRRVNHHPSLALWAGGNEIESLILPTIERSYPDQYAKYVGDYETLYINLILPLVYENTHSITYSPSSTTEGYLDVNLSAKIVMAERYQNLTEGHYYGDTDYYNYDTSVAFDFSQYPVGRFANEFGFHSMPSLQSWQQAVDPEDLHFNSSVIMLRNHHYPAGNLSTHNFHNTSMGMGETTMGVMNYYPVPDKTDPIANFSAWCHATQLFQADFYKSQIQFYRRGSGMPERQLGSLYWQLEDIWQAPSWAGIEYDGRWKVLHYVARDIYQPVIVSPFWNSTTRRLDVYVTSDLWEPVSGTVDLAWMDLSGKPIAQNARTPKTAAFVVGALNTTKIYSMNINERALPDPKNSVLIFPG

SEQ ID NO: 4957 - protein, 867 aa, Aspergillus terreus
  strain NIH 2624 / FGSC A1156
MAPSSLKWTLLCALPWTLASPASYNVHHARDSDAQAFSPPYYPTPHGGWIADWAEAYEKASQLVRNMTLAEKVNLTTGTGMYMGPCAGQTGSVPRFGIPNLCMHDGPLGVRNTDHNTAFPPGITVGATFDKDLMRSRGVALGEEGRGKGVNVLLGPSVGPIGRKPRGGRNWEGFGADPSLQAIAGSLTIEGMQSTGLIACIKHFIANEQEMHRMSSVVTQGYSSNVDDRTLHELYLWPFAEGVRAGVGSLMAAYNDVNNSASSQNSKMLNDILKDELGFQGFVMSDWFGNYGGVSAALAGLDVSMPGDGAIPLLGDSYWGSELSRSILNGTVPVDRLNDMATRILASWYKMGQDQDYPLPNFSANTEDAEGPLYPGAVFSPKGVVNKFVNVQGDHNVTARAIARDAITLLKNNNNILPLHRNDSLKIFGTDAGTNPDGINSCSDKGCNKGVLTMGWGSGSSKLPYLVTPQEAIANISSHAEFHITDSFPSDVSAGPNDIAIVFINSDSGENYITVEGNPGDRTSAGLNAWHNGDDLVKAAAEKFRQVVVVYHTVGPVLMEEWIDLEPVKAVLVAHLPGQEAGWSLTDVLFGDYSPSGHLPYTIPRSESDYPDSVSLIQQPFGRIQDDYTEGLYIDYRHFAKAGITPRFPFGYGLSYTNFNFSRASISAQSSLDTAYPAPRSPKGSTPEYSTAIPPAAEAAWPKNFNRIWRYLYPYLDNPEGARANSSRKYPYPDGYSTVQKPGPRAGGGEGGNPALFDVAFSVQVQVTNTGARKGRAVAQLYVELPDSLGVDTPSRQLRQFEKTKILAPGESQVLTMEITRKDLSVWDVVAQDWKAPVNGEGVKMWIGESVADMRVLCTVGEGCSTL

SEQ ID NO: 4958 - protein, 264 aa, Aspergillus terreus
  strain NIH 2624 / FGSC A1156
MDQKATEYIQLPRPATRHHVQRPHQFSRARTQLLTQPDVEANTDGADTIRSSHITFNNWTVYNGDDSISLKGNSTDITITNSHFYNGLGIALGSIGQYKDQFETIERFTVKNIDYHNTLHAVYFKTWTDDQNGYPPNGGGGGLGYASDMVFQNLRASGLRGSAISISQCTRFSGAPGEGNCTNSQFQIRDITLANLTGTTKVSSVASFQCSAVAPCTNIGLFHTDLTLSNGTIAGEYLCGNVEDPRGFECTGAPCVGGSATGEC

SEQ ID NO: 4959 - protein, 247 aa, Aspergillus terreus
  strain NIH 2624 / FGSC A1156
MVQKSLLFSLLASTALGALTKRYSFPLPESQGSETFSEPYEVAAGETFDGGMKTYGRGVECTGQVEGGEDDTVFIVQEGGTLKNAIIGTDQIEGVYCLGSCTIENVWWEKVCEDALSLKEGDGIYTISGGGAQGAEDKVIQHNTGGEVIIDGFEVYDFGKLYRSCGTCGDIQRKVSVSNVVAVSGSQLVGINENFGDTATIDSSVCATDVNDICATYNGTDGDEEPEEVSTGPSDYCIYTEPIAECA

SEQ ID NO: 4960 - protein, 253 aa, Aspergillus terreus
  strain NIH 2624 / FGSC A1156
MHHKALLISLASTALALHGSSSHSHLGKRFTFPLPSSKGSVTFDAPKIISGNTTFDGGMKTYGRGVECTEGEGGDSDAVFWVENGGTLKNAIIGADQIEGVHCMGACTIENVWWEAVCEDALSLKEGSGPFTVIGGGAQGAEDKVIQHNSGGTVSIDGFTVYNFGKLYRSCGNCDEMFERHVTVSGVTAVQGSTLVGINSNYGDTATIKGDVCATDVDTICQEYEGNSSGEEPPETGSGPSSACKYSEPLPAC

SEQ ID NO: 4961 - protein, 654 aa, Aspergillus terreus
  strain NIH 2624 / FGSC A1156
MDKHRRDESPSGLSDIVEPDGLLGTGLTSRHIEAFGRKVTTTAGHLMAPSSTEATTGSHYHSAMVDIQRELRRPNTQRRVFSLTQTTPTDLVRSKLSTTEIQSRAISSLPDDLLANIPEDSSSYSLFEGFQASQDDHEYRKVHRRRISKGKKLLKDGDARAALPSTPTDLKKDRDILSRRLDLMGVRKNMCSSEIHEIDNKIANLHNMRKIVLDRLAGLEMEEAELEHELTELDNKLEDLQEEQPESQAAVATPKSSEANEDSFVSEDPAMDASFMSESIYQKMSSPKSIKQRSIRKRSMPILHEHFAPGSQIKEMPAHNDMVTAIDFDFPFGTMVSAALDDTVRVWDLNVGRCTGLLEGHNASVRCLQIEDNIVATGSMDASVKLWDLSRARSVTRDGRVNKDDEGEDTADDAHELFQSTTLEDCYVYSLDAHVDEVTALHFRGDTLISGSADKTLRQWDLVKGRCVQTLDVLWAAAQASTLGGDTQWRPSGRLPDASADFVGALQCFDAALACGTADGMVRLWDLRSGQVHRSLVGHTGPVTCLQFDDVHLVTGSLDRSIRIWDLRTGSIYDAYAYDKPVTSMMFDSKRIVAAAGENVVKVYDKADGHHWDCGAGVGADAEGPSPATVERVRLKDGFLVEGRKDGIVSAWTC

SEQ ID NO: 4962 - protein, 459 aa, Aspergillus terreus
  strain NIH 2624 / FGSC A1156
MLDFMEYIQLGFAEATNWNRDNSYSSLTATAQSLLDFKTPERLRVHLSSLSTPHFATSYTLGTVGLIDGSVSYLYSTVPFDHTPSRSALIPLRKLAPGYRQVQPPVAPIENWGWDSTLNHETTPLAQKATLLHATMHMPPPTTLNALFLRRISPTMQLTLAVCSTRGPPLSKSAPQASLLTQLSHDTGKYSNEYLFSTDNALFGWRGLWNFGPDPRNPADDAAPRLSLLSAGAEAYYSPVSSLVGMSTGLRFSTLPAATDASSAPSSSSSPSSATPTQISTFPYTLTLTLTPMTGSLSTTYSLRASPNLSFSSRFGFNVYSWESEMVAGCELWRQSRKRVPAEEEDDGLEWARRKLRMMDDAAVPLPPTSSVPAEPEQDETTESVLKIRVDQSWNVRLLWEGRVKELLVSAGVGLGPSSFSSSAWTNSTAGGAGGQASGGGNAGTSYWRGVGVSVSYSS

SEQ ID NO: 4963 - protein, 841 aa, Aspergillus terreus
  strain NIH 2624 / FGSC A1156
MLRLPLVLVWSLWASLTVAENGLNGWLRYAPIPCDGRCHKALPSRIVALNSTQGSPLETAIEELQTGVRGMTGKRLSVAKENNCNLHATALIATVEEYRRTCRNSSDIPDLDVDGFWLRTEGNNVQILGQSERGALYGAFEYLSMLAQGDFSSVDYSTSPHAPVRWVNQWDNMDGSIERGYAGPSIFFAQGQIVPDLSRAKQYARLLASVRINGIIVNNVNANATLLTPQNMDGLARIANVFRPYGIRIGIALNFASPDTLGGLGTYDPLDPSVISWWGNITDSLYERIPDMAGYLVKASSEGQPGPDTYNRTLADGANLFARALKPHGGVMMFRAFVYDHHINESIWTNDRANAQVDFFKKLDGQFEDNVIVQIKYGPIDFQVREPVSPLFANLYHTNTAIELQVTQEYLGQQCHLVYLPPLWKTITDFDLRVDHSPSVVRDIISGERFNRPLGGWAAVVNVGTNDTWLGSHLSMSNLYAYGRMAWSPTDDSVEILQDWIRLTFGRDQHVLDTITDMSMASWPAYENYTGNLGIQTLTDILYTHYGPNPASQDGNGWGQWTRADHDSIGMDRTVKNGTGNAGQYPAEIAEIYEDIDKTPDDLLLWFHHVPYTHRLDSGKTVIQHFYDAHYAGAETAQGFVPQWESLRGRIDPERYDAMRTRLVYQAGHSIVWRDAINNFYWNLSGIADTNGRVGHHPWRVEAESMQLQGYQPYAVSPFETASNYTAVVTTSNSTTGTASTTLDFPSGTYDVGVNYFDMYGGKSRWSLYLNDKVVGKWEGNSEDVLGHTPSIYLDGHSAIRITFNGVKVRKGDRLKIVGVPDGVEPAPLDYVVFLPQGVID

SEQ ID NO: 4964 - protein, 615 aa, Aspergillus terreus
  strain NIH 2624 / FGSC A1156
MATVRICVCGDEGTGKSSLITSLVKGVFVTHKIQPVLPQITIPPTIGTPENVTTTTVVDTSALPQERNNLAREIRKSNVILLVYSDHYSYERVALFWLPHFRSLGVNVPVVLCANKSDLAADHSEAQVIEEEMLPLMAEFKEIDSCIRTSAREHRNVNEAFFLCQKAVTHPIAPLFDSKESSLKPAAIAALQRIFYLSDKDRDGYLSDKEIKEFQMRCFEKPLSEEDLVHIKETIQKAHPASVTPSGIDCRGFIHLNRMYAEKGRHETVWIILRAFQYTDNLSLQESFLHPKFEVPPYASAELSPEGYRFFVNLFLLSDKDNDGGLNEAELASLFAPTPGLPASWADGSFPSCTVRNEAGHVTLQGWLAQWSMTTFTSPKTTLEYLAYLGFESSDRSNPSTTAALKVTRPRKRRRRPGRVGRNVVLGHVLGAPGSGKSTLLDAFLSRGFSTTYHPTIQPRTAVNTVELPGGKQCYLILDELGELEPAILENQAKLLDQCDVIIYTYDSSDPDSFSYITSLRDKYPHLEELPSVFVALKADLDRTTQRAEYQPHEYTAMLNMPSPPLHVSATWSSIQEVFVHIAEAAMEPSTAFPRSEEDVEVLSNFGVMYQGTPR

SEQ ID NO: 4965 - protein, 419 aa, Aspergillus terreus
  strain NIH 2624 / FGSC A1156
MRLGIALFSLIGLCHSVSALIAFPGAEGFGANAVGGRQGEIYVVTNLNDSGEGSLRDAVSATDRIVVFAVGGVIEISDRIVVSKRVTILGQTAPGDGITVYGNGWSFSNADDAIVRYIRIRMGKVGDSGKDAITIAEGSTMIFDHVSVSWGRDETFSISGTASNITIQNTIIAQGLETHSCGGLIQTGGGVSLFRNLYIDNKTRNPKVKGVNDFTNNVVYNWGGGGGYIAGDSSGDSYANIIGNYFISGPSTSVTAFTRGNEYFHGYVETNYYDPDRDGTLNGNELGVSASNYGGMALVDTKYDYPAVEYQMTPGEAVNYVTGYVGASKVRDSVDTQLIAQVKSWGTKGELISDEASMGGPGDLDGGSPPTDSDGDGIPDDAETEIGSDPNTADSMELHSSGYTYVEMWANSLVPSSYH

SEQ ID NO: 4966 - protein, 466 aa, Aspergillus terreus
  strain NIH 2624 / FGSC A1156
MGVFVVLLSIATLFGSTSGTALGPRGNHSDCNSVDHGYQCFPELSHKWGLYAPYFSLQDESPFPLDVPDDCQITFVQALARHGARSPTDSKTKAYAATIAAIQKNATTFPGKYAFLKSYNYSMGSEDLTPFGRNQLQDMGAQFYRRYDTLTRHINPFIRAADSSRVHESAEKFVEGFQNARQGDPRANPHQPSPRVDVVIPEGTAYNNTLEHSICTAFEDSTVGDAAADNFTAVFAPAIAKRLEADLPGVQLSADDVINLMAMCPFETVSLTDDAHTLSPFCDLFTAAEWTQYNYLLSLDKYYGYGGGNPLGPVQGVGWANELIARLTHSPVHDHTCVNNTLDANPATFPLNATLYADFSHDSNLVSIFWALGLYNGTKALSQTTVEDTTQTDGYAAAWTVPFAARAYIEMMQCRAEKQPLVRVLVNDRVMPLHGCAVDNLGRCKRDDFVEGLSFARAGGNWAECF

SEQ ID NO: 4967 - protein, 86 aa, Aspergillus terreus
  strain NIH 2624 / FGSC A1156
MQLTNFLAAAATALLCTTARANAVPCNGRDIWAYPGDCHAFYQCGAGNVGVFMTCGNDRAFHPELRTCGPITPELCRWFNGGFDSN

SEQ ID NO: 4968 - protein, 879 aa, Aspergillus terreus
  strain NIH 2624 / FGSC A1156
MLGSLLLLAPLAGAAVIGSRSNNTEPCPGYKVSNVREGVNSLTADLSLAGKPCNTYGTDLKDLKLLVEYQTERPDERLHVMIYDANEQVYQVPESVVPRVEGRKGARPHSALKFTYEEEPFSFTVTRDDEVLFDTSASNLIFQSQYLNLRTWLPEDPYLYGLGEHTDSLRLPTTNYTRTIWNRDSYGVPQNSNLYGAHPVYYDHRGESGTHGVFLLNSNGMDIRIDKTEDGQQYLEYNTLGGVFDFYFFTGSTPKETSMEYSKIVGLPAMQSYWSFGLHQCRYGYRDVYQVAEVVYNYSKAGIPLETMWTDIDYMNARKVFTLDPERFPLPKMRELVDYLHKHDQKYIVMVDPAVSAVDNEAYEHGVDQGIFLQQQNGSLYKGAVWPGVTVYPDWFHPDIQEYWNSEFSAFFSADDGVDIDGLWIDMNEAANFCTWPCADPEQYAIDNDLPPAPPAVRPSNPRPLPGFPDSFQPSSSKRAVKRAGGSKGAKVGLPGRNLVDPPYKIQNAAGSISNKTINTDIIHAGEGYAEYDTHNLYGTMMSSASRGAMLNRRPDVRPLIITRSTFAGAGSHVGHWLGDNLSQWDQYRISISQIVAFASMFQVPMVGADVCGFGGNTTEELCARWAALGAFYTFYRNHNEIGSTSQEFYQWPTVADSARKAIEIRYKLLDYIYTAFHKQTETGEPFLQPMFYLYPEDENTFANDVQFFYGDALLVSPVLTEGSTSVDAYFPDDIFYDWYTGAPVRGHGAKKTLENIDVTHIPLHVRGGNIIPVRSSGAMTTKELRNKSFELIIAPGLDGTASGSLYLDDGDSLEQKGTAEIKFEYRRGKLSVKGSFGRSAAGVKVQAVKVLGQKAESRMSAFRSTEFELTRPMEISLQ

SEQ ID NO: 4969 - protein, 1022 aa, Aspergillus terreus
  strain NIH 2624 / FGSC A1156
MARFPQLLFLLLASIGLLSAAQNHSDSEWPLHDNGLSTVVQWDHYSFHVHGQRIFVFSGEFHYWRIPVPGLWRDILEKIKAAGFTAFAFYSSWGYHAPNNHTVDFSTGARDITPIYELAKELGMYIIVRPGPYVNAEASAGGYPLWVTTGAYGSLRNDDARYTAAWKPYFAKMSEITSQYQVTDGHNTFCYQIENEYGQQWIGDPVDRNPNQTAVAYMELLEASARENGIVVPLTANDPNMNTKSWGSDWSHAGGNVDVVGLDSYPSCWTCDVTQCTSTNGEYVPYKVMQYYDYFQEVQPTMPGFMPEFQGGSYNPWAGPEGGCPGDTGVDFANLFYRWNIAQRVTAMSLYMLYGGTNWGAIAAPVTATSYDYSSPISEDRSIGSKYYETKLLALFTRSATDLTMTDRIGNGTHYTNNPAVAAYELRNPVTNGAFYVTIHADSTVGTDESFRLNVNTSAGALTVPSKGSIRLNGHQSKIIVTDFRFGPSHTLLYSTAEVLTHAVMDKKATLVLWVPTGESGEFAVKGAKSGKVERCPQCSNATFTRKKDVLVVNFTQAGGMSVLQLNNGVRVVLLDRAAAYKFWAPPLTDDPFAPETDLVLVQGPYLVRSASLSGSTLALRGDSANETALEVFASKKVHTVTWNGKRIKTSRSSYGSLTASLAAPPAVSLPALSSAQWKSQDSLPERLPSYDDSGPAWVDANHMTTQNPRTPDTLPVLYADEYGFHNGIRLWRGSFTDAASGVYLNVQGGAAFGWSAYLNGHFLGSHLGTATTSQANKTLLFPAGTLRKNTTNTILVIHDDTGHDQTTGALNPRGILAARLLAPSDSSTAPNFTQWRVAGTAGGESDLDPVRGVYNEDGLFAERMGWHLPGFDDADWPANNSTTTRGAQVSLSVTGATVRFFRAVVPLHLPRGVDASISFMLGTPAGASTAYRAQLFVNGYQYGRFYPHIGNQVVYPVPAGVLDYDGENTIGVAVWAQSEAGAEMSLDWRVNYVADSSLDAVRVAAEGALRPGWSEERLQYA

SEQ ID NO: 4970 - protein, 793 aa, Aspergillus terreus
  strain NIH 2624 / FGSC A1156
MPRVASVAAVLAALLPSALGQANTSYVDYNHEANPDLFPQCVATIELSFPDCENGPLSKTLVCDKSARPHDRAAALVSMFTLEELVNNTGNTGTGVPRLGLPKYQVWSESLHGVYRANWASEGDYSWATSFPQPILTMAALNRTLIHQIGDILSTQARAFSNVGRYGLDTYAPNINSFRHPVWGRGQETPGEDAYYLASTYAYEYITGIQGGVDPETLKLVATAKHYAGYDIENWDGHSRLGNDMQITQQDLSEYYTPQFLVSARDAKVHSVMCSYNAVNGVPSCSNSFFLQTLLRETFGFVEDGYVSGDCGAVYNAFNPHEYAANESSASADSIRAGTDIDCGTSYQYHFTNAFDEGEISRQDIERGVIRLYTNLVRLGYFDGNSSQYRDLTWSDVQTTDAWNISHEAAVEGTVLLKNDGTLPLADSIRSVALIGPWANATTQMQGNYYGPAPYLTSPLAALEASDLDVHYAFGTNISSTTTAGFADALAAARKADAIIFAGGIDNTIEGEALDRMNITWPGNQLDLINQLSALGKPLVVLQMGGGQVDSSALKHNTNVSALLWGGYPGQSGGTALLDIIRGVRAPAGRLVTTQYPAGYATQFPAIDMGLRPNGTNPGQTYMWYTGTPVYEFGHGLFYTTFEAKRASTATNHSSFNIEDLLTAPHPGYAYPQLRPFLNFTAHITNTGRTTSDYTAMLFANTTAGPAPHPNKWLVGFDRLGALEPGASQTMTFPITIDNVARTDELGNRVLYPGRYELALNNERSVVLRFTLTGEKAVLMKWPLEKQEIPPAA

SEQ ID NO: 4971 - protein, 346 aa, Aspergillus terreus
  strain NIH 2624 / FGSC A1156
MKSFSPSLLLLASVAPLVSGHYVFSKFLVDGSVSQDFEYIRRNSNGYMPTLAGDILSNDFRCNQGSMDSAASTKVYTVAPGTEIGFGLAYGASMKHPGPLQVYMSKAPGDVKEYDGSGDWFKVYQEGVCSDISDGLVDTDWCTWGKDTVKFKIPSDMPPGQYLVRVEHIGLHRGFSGNSEFYFTCAQIEVTGSGTGTPAEVAKIPGIYKPDDANIHFNIYYPTPTAYDLPGPSVWVEGKGGSAAQSSAPAPSAVESAASEAPAVTSAVKVPAESETTAAPAQTTLATACKPAAPAETTAASEVAINAPAGAIKKYFQCGGMHWKGSGACESGTSCKQWNPYYHQCV

SEQ ID NO: 4972 - protein, 410 aa, Aspergillus terreus
  strain NIH 2624 / FGSC A1156
MKLSLLAVLALPLALAAPNKRASSFVWFGSNESGAEFGQGNIPGVLGKDYIWPDASAIATLHSAGMNIFRVAFMMERLVPSTMTGAADATYMGDLKAVSRVELVYLDVLANPAQTVKGDHRYGYGNIISSTSDFAAFWTTVAKEFASNDKVIFDTNNEYHDMDQTLVLNLNQAAINAIRGAGATSQYIFVEGNSYSGAWTWATVNDNLKALTDPSDKIVYEMHQYLDSDGSGTSETCVSGTIGQERVAAATTWLKNNGKKGFLGEFAGGANSVCATAVKGMLDALAQNADVWMGASWWAAGPWWGTYMFNMEPPSGTGYTNYLSVLKPYFVGGSGGTTTTTTTTTTTKTTSTATTTTTKATTTTTTTASSTATAGAQHWGQCGGNGWTGPTTCVSPYTCQKQNDWYSQCL

SEQ ID NO: 4973 - protein, 541 aa, Aspergillus terreus
  strain NIH 2624 / FGSC A1156
MPSTYDIYKKLLLLASFLSASQAQQVGTSKAEVHPSLTWQTCTSGGSCTTVNGKVVVDANWRWVHNVDGYNNCYTGNTWDTTLCPDDETCASNCALEGADYSGTYGVTTSGNSLRLNFVTQASQKNIGSRLYLMEDDSTYKMFKLLNQEFTFDVDVSNLPCGLNGAVYFVSMDADGGMAKYPANKAGAKYGTGYCDSQCPRDLKFINGMANVEGWEPSANDANAGTGNHGSCCAEMDIWEANSISTAYTPHPCDTPGQVMCTGDSCGGTYSSDRYGGTCDPDGCDFNSYRQGNKTFYGPGMTVDTKSKITVVTQFLTNDGTASGTLSEIKRFYVQNGKVIPNSESTWSGVSGNSITTAYCNAQKTLFGDTDVFTKHGGMEGMGAALAEGMVLVLSLWDDHNSNMLWLDSNYPTDKPSTTPGVARGSCDISSGDPKDVEANDANAYVVYSNIKVGPIGSTFSGSTGGGSSSSTTATSKTTTTSATKTTTTTTKTTTTTSASSTSTGGAQHWAQCGGIGWTGPTTCVAPYTCQKQNDYYSQCL

SEQ ID NO: 4974 - protein, 368 aa, Aspergillus terreus
  strain NIH 2624 / FGSC A1156
MHSFQLLGLAALGSLVAAAPSPSRVSDLTERSSSCTFTDAAKASSSASSCSSIVLKDIAVPAGKTLDLSHVKDGTTITFEGTTTFGYKEWKGPLIRLAGKDITVTMAKGAVIDGEGSRWWDGKGTNGGKTKPKFLYAHKLEDSTIKGLNIKNTPVQAISVQANNLHLTDITIDNSDGDSKGGHNTDGFDISESNGVYISGANVKNQDDCIAINSGKNIEFTGGTCSGGHGLSIGSIGGRDDNTVQGVKITDSTVTNSDNGIRIKTIVDETGSVSDVTYSNIKLSGIHKKGIVIQQDYKNGGPTGKPSNGIPIKDVTVDGITGSVDSKATPVYILCGSGSCSDWTWKNVKLSGGKSSSECKNLPSGVSC

SEQ ID NO: 4975 - protein, 352 aa, Aspergillus terreus
  strain NIH 2624 / FGSC A1156
MRFTALATAILPLACNVLALPAKTGEAPKLDVSLSQVDNTLIKAVVKNTGSEDITFVHLNFFRDKAPVKKVSLFRNATELPFQGIKQRFRTEGLTEDALTVLAPGESIEDEFDIAATSDLSEGGSITISTDGFVPIATGNKITGSVPYSSNELSIEVDAAQAASVASAVKPLDKRTKVASCSGTRSSALSTALKNTVSLANAAASAAQSGSSSRFQEYFKTTSSSVRSTVAARFRAVASEASSTSSGSTTYYCTDTYGYCSSNVLAYTLPAYNIIANCDIYYTYLSALTRTCHAQDQATTTLHEFTHAPGVYSPGTDDLGYGYDAATALSSSQALNNADTYALFANAVNLNC

SEQ ID NO: 4976 - protein, 218 aa, Aspergillus terreus
  strain NIH 2624 / FGSC A1156
MSLRSVLVAALAALAVATPVPENSLQERQLMSSNDVEDGVCRDVTFIFARGSTEQGNMGFVVGPEVCTSLKADLGSGKVACQGVGGAYTASLAPNFLSANTDPQSIQAATDLFEKAVANCPNTQIVAGGYSQGSAVMDNSIQALPADIQEKVKGVVLFGFTRNLQDNGQIPNYPKEDVKVYCALGDLVCSGTLIITPAHMTYGVNAGDAAQFLASKVQ

SEQ ID NO: 4977 - protein, 121 aa, Aspergillus terreus
  strain NIH 2624 / FGSC A1156
MRTALAILSSTLSAALALANPLAARHGAPICPSGTAYSSMQCCAVNVADVVSLDCQPPGPLPSSAAEFKEICAKIGDKPQCCTLALAGQAIACQNPAGMDEDSGSSESESDSGSGGGGGDA

SEQ ID NO: 4978 - protein, 285 aa, Aspergillus terreus
  strain NIH 2624 / FGSC A1156
MLWTLSILPLLGHAIASAVPAEKRQSCPGVHVFGARETTASPGYGSSSTVVNLILSAYSGSTAEAISYPACGGQSSCGGVSYSASVAAGIDAVASAVNSFNTQCPSTQLVLVGYSQGGEIMDAALCGGGVPNQGVTNTAVRLSSSAVNMVKAAIFMGDPLFRAGLPYDVGTCSAGGFDARPAGFSCPSASKIQSYCDGPDPYCCNGSNAATHNGYGAEYGQAALTFVKSKLSSSSSGGGSTGGGSGSGGTVAQYGQCGGQGYTGATTCQSPYTCTVMNQWYSQCL

SEQ ID NO: 4979 - protein, 846 aa, Aspergillus terreus
  strain NIH 2624 / FGSC A1156
MLRSLGAAILAAGLLVAPANGAASQTYTWKNVRTGAGGGFVPGIVFNPSAKGVAYARTDIGGAYRLNSDDTWTPLQDHVNSSNWNNWGVDALATDPIDTNRLYLAVGMYTIDWDPNNGAILRSTDKGDTWESTALPFKVGGNMPGRGMGERLAVDPNDNKILYFGARSGHGLWKSTDYGVTWSNVTSFTWTGTYVQDSSSAYTADPVGIAWVTFDSTSGSKGSATPRIFVGTADTGKSVFKSEDAGKTWAWVSGEPMYGFLPHKGVLSPAEKTLYISYSNGAGPYDGTNGTVHKYNISSGVWTDISPTSVASTYYGYGGLAVDLQVPGTIMVAALNCWWPDELIWRSVDSGATWSPIWDWNGYPNINYYYGYDITNAPWIQDSTSTDEFPVRVGWMVEALAIDPFDSNHWLYGTGETIYGGHDLLKWDSAHNVTLKSLAVGVEEMAVLGLITPPGGPALLSAVGDVGGFYHTDLDTAPSQSFHTPSYGTTNDIDYAGNKPSNIVRSGSSDTDPTLALSNDFGKTWSADYAASSSTGTGKVALSADGDTILLMSSTQGAMRSQNQGTLSAVSSLPSGAAIASDKANNTVFYGGSAGSFYVSTNTGASFKKTVSLGSSSSVNAIRAQPSVAGDVWASTDKGLWHSTDYGSSFTQVGSGCTAGWSFGFGKASSTGSYPVIYGFFTVDGVTALFKTEDKGANWQMISDAEYGFGSATSNIVNGDLSNYGRVFVGTNGRGIFYGVPSGSLPTTTTTAHTTSTTKSSTSSTSTTLTTTTKTSSTSTTKSSTTTTSKTTTTTTKTTSTTSSATSTGTSTPYGQCGGIGYTGPTACPTGWKCTYANDYYSQCIQ

SEQ ID NO: 4980 - protein, 455 aa, Aspergillus terreus
  strain NIH 2624 / FGSC A1156
MRIGSLIMAASAAGLVHAYPRREITKRETGFTWFGVSESGAEFGESNIPGTLGTDYTWPDTAKIQTLRSAGMNIFRVPFLMERLVPDNMTGTPDSTYLQGLKKTVTAITDSGAYAVLDPHNYGRYSGSIISSTSDFKAFWKTVAGEFASNDKVIFDTNNEYHDMDQSLVLDLNQAAINGIRAAGANTQYIFVEGNSYTGAWKWASTNDNLAQLTDPVDDRLVYEMHQYLDSDGSGTSETCVSATIGKERVQSATQWLKDNNKKGFLGEFAGGANQQCETAVEGLLAYMAQNADVWMGAEWWAAGPWWGDYMYSLEPTDGAAYEAYMPILKKYFVGAAGSSSSAASTSSAAASTSASSVSVTSAEASSAPAPTAPVSTAPVSTASSATTPTTTQATSVITSVTSLLPIFTSPPSTSNPPGVASRWGQCGGINWNGPKTCQGGYTCVMQNPYFHQCL

SEQ ID NO: 4981 - protein, 529 aa, Aspergillus terreus
  strain NIH 2624 / FGSC A1156
MKALFAAITMAHALLQTQASLQNPNLLPTPPMGFNNWARFMCDLNETLFVETADAMAANGLLAAGYNWLNLDDCWMTHQRAPNNSLMWNTTKFPRGLPWLGSYVKAKGFRFGIYEDAGNLTCGGYPGSLGHEELDARTFADWGVEYLKLDGCNVFPEGGRTSEQQYEHLYGLWHRILSGMPHPLVFSESAPAYFANEKNLSDWYTVMDWVPRYGELARHSTDILVYAGEGSAWDSIMVNYRYNTLVARYQRPGYYNDPDFLIPDHPGLTMDEKKSHFGLWASFAAPLIISAYIPGLSEEDIGYLTNRDLIAVDQDPLAQQATLASRDDEVDVLTRSLADGSRLVSVLNRGNSSVQRVIPLQWLGLNPGQRYQARNLWDGTEKRIRKDLTVTVRSHATEIYKFTGSNGRVDAVSTGIVFNTASGNCLTGDAAGVGFAPCTGGEKQIWQVRGSELRPLSLLGECLTADGTRLSLRPCAGDEAQMWSYHISGNLKSGHEGGCLTEGHGVASCGWELNSQVFGLPSGVRVSGY

SEQ ID NO: 4982 - protein, 351 aa, Aspergillus terreus
  strain NIH 2624 / FGSC A1156
MHTLQSAILLGGLLATQVAAHGHVTNIVINGVYYRGWNIDSDPYNSNPPLVAAWRTPNTANGFIAPDAFGTSDIICHLNALNGQGHIQVAAGDRISLQWNTWPESHHGPVLDYLADCGGSCETVDKTTLKFFKIDGVGLVDDTTPPGIWGDDQLIANNNTWLVEIPSSIAPGNYVLRHELIALHGAGSANGAQNYPQCFNLQITGSGTVKPSGVLGTALYSPTDPGILVNIYNSLNYIVPGPTPIPQAVSVVQSSSAIRATGTATAPGATGGTTATTTSKATTTSSTTLVTTTSASTTSRTTTTTTAGAGGSQTVYGQCGGTGWTGPTACVASATCTTLNPYYAQCLPTST

SEQ ID NO: 4983 - protein, 416 aa, Aspergillus terreus
  strain NIH 2624 / FGSC A1156
MLYNLSKAVLALSVLAASADAAGIRLEKRASTFDYETEMVRGVCLGGWLVLEPWLSPGLFDAAPDGAVDEWTYTEILGQDEAKARLIGHWDTFITEQDFFDIAAAGMNHVRIPIGYWAVEALPGDPYVDGQLEYLDRAIEWAGAAGLKVIVDLHGAPGSQNGFDNSGRKGAIQWGQGDTLGQTVNAFRKLAERYVPSSDVVTAIEAVNEPFIPGGVNEDQLKEYYQQAYDIVTQMSPDVDLVFSDGFINPTPWNGFISDSGNIVMDNHHYEVFDINLLRMSVDDHVRSVCDFGRTQLAPATKPVVVGEWTGAMTDCARYLNGRGVGARYDGAMGGESVGDCGPFIQGSVSDLSPDDQKNMRRFIEAQLDAWEMKSGWLFWNWKTEQGAPGWDMKDLLDNGVFPFPLESRKYPGQCG

SEQ ID NO: 4984 - protein, 250 aa, Aspergillus terreus
  strain NIH 2624 / FGSC A1156
MKLSVLSLASLASAAALNAKVLTGKSLTRRADFCDQWGQVTTGNFILYNNLWGQGNADSGSQCTGLDSSSGNDSIAWHTSWSWSGGAGQVKSYANAAYVFTPKQLSALGSIPTSWSWKYTGSDIIANVAYDLFTSSTADGDNEYEIMIWLAALGGAGPISSTGSPVASPTVAGHSWDLYSGMNGQMQVYSFVASSQTESFSADLQEFIMYLQSNQGLPTSQYLVDVQAGTEPFSGSDATLTTSAYSVSVA

SEQ ID NO: 4985 - protein, 319 aa, Aspergillus terreus
  strain NIH 2624 / FGSC A1156
MFARQTFRYAQPLKQSFRKYSTEAPKGKSLAPVYLTVGLAGLGVGLYRYNSATAEAPAERAKVFTGGDQGWVDLKLSEIEVLNHNTKRFRFEFEDKEAVSGLNVASALLTKFKPEGGKAVLRPYTPVSDESQPGFLDLVVKVYPNGPMSEHLHSMNVDQRLEFKGPLPKYPWEANKHQHICLIAGGTGITPMYQLARHIFKNPEDKTKVTLVYGNVSEQDILLKKELEELENTYPQRFKAFYVLDNPPKEWTGGKGYISKELLKTVLPEPKEENIKIFVCGPPGLYKAISGNKVSPKDQGELTGILKELGYSQEQVFKF

SEQ ID NO: 4986 - protein, 453 aa, Aspergillus terreus
  strain NIH 2624 / FGSC A1156
MHQRALLFSALVGAVRAQQAGTLTEEVHPPLTWQKCTADGSCTEQSGSVVIDSNWRWLHSTNGSTNCYTGNTWDESLCPDNEACAANCALDGADYESTYGITTSGDALTLTFVTGENVGSRVYLMAEDDESYQTFDLVGNEFTFDVDVSNLPCGLNGALYFTSMDADGGVSKYPANKAGAKYGTGYCDSQCPRDLKFINGMANVEGWTPSDNDKNAGVGGHGSCCPELDIWEANSISSAFTPHPCDDLGQTMCSGDDCGGTYSETRYAGTCDPDGCDFNAYRMGNTSYYGPDKIVDTNSVMTVVTQFIGDGGSLSEIKRLYVQNGKVIANAQSNVDGVTGNSITSDFCTAQKTAFGDQDIFSKHGGLSGMGDAMSAMVLILSIWDDHNSSMMWLDSTYPEDADASEPGVARGTCEHGVGDPETVESQHPGATVTFSKIKFGPIGSTYSSNSTA

SEQ ID NO: 4987 - protein, 320 aa, Aspergillus terreus
  strain NIH 2624 / FGSC A1156
MYRSTLLFLFIALVNAFANPGPCTGDCWTHDPGLYQRKSDGRYFRFATGGGIHISSAPAIVGPWEDNGFALPNGSKINHAGNDNLWAPDVHYQENTKKYYMYYSVSVLGKKDSVIGVASSDTMEVGSWTDHGSIGLNTSNNPPYNTIDANWIRIDGAPALNFGSYWQGIFQVPLKNPFELAEIAPHQIAWNASLNHRIEAAFEFKHGNYYYLTFSSGLGGNYDVNLPAQGEEYSIHVCRSEGGRNNFVDKSGRSCRESGGTTLLASHGNVYAPGGQGIVEDKNLGQVLYYHYADKTKGLAKTDYQFGWNRLNWVDGWPSV

SEQ ID NO: 4988 - protein, 220 aa, Aspergillus terreus
  strain NIH 2624 / FGSC A1156
MVALHTLLLTAFAAVSLANPIPAPELEARQIINANDLENGVCKPVVLIFARGSTELGNMGAIAGMPTCNALKLALGSQNVACQGVGGAYTASLIPNFLPANTNQASIREATGVFEMAHTRCPNSQIVAGGYSQGSAVMDNTIQDLPDVIKNKVKGVVLFGFTRNLQDLGRIPNYPKEQTKVICAVGDLVCVGTLIITPAHLTYTLNAPEAAQFLASMVSV

SEQ ID NO: 4989 - protein, 338 aa, Aspergillus terreus
  strain NIH 2624 / FGSC A1156
MRASFVVTAPLLAAAVHGYAAPGACSGACNIHDPSLIRRESDGKYFRFSTGNKISYASASSIEGPWTTIGSMLPDGSSIDLPGNDDLWVSAHATWTGVPHANREYQAPDAQIVNGVYHVYYSVSSFGSQNSAIGLATSTSMDAGTWTDHGSTGIQSSSSKNYNAIDGNLFNDGGTYYMNFGSFWADIFQAPMNSAATKVASSSYGIAYDPSGTHAVEGSYLYKYGNYYYLFYSWGICCGYDTSRPAAGQEYKIKVCRSTSATGNFVDADGVACTNGGGTVVLESHDNVYGPGGQGVFTDPNLGPVLYYHYVDTNIGYADGQKLFGWNVLDFSSGWPVV

SEQ ID NO: 4990 - protein, 503 aa, Aspergillus terreus
  strain NIH 2624 / FGSC A1156
MRFTVLIGGGFSLVHLVTALNNGLAVTPQMGWDNWNAFGCSLSQSLILSTASFIKKTGLRDAGYHYIILDDCWSSGRASNGALIADSTKFPNGMSYLGNQLHADGFGFGIYSSAGTKTCAGYPGSLGYETIDANTFASWGVDYLKYDNCNNNGQSGSQAVSSARYAVMQKALAASGRQILYAICNWGEDKPWIWGPSVGNSWRITGDIFDRFNTAYSTCPVPNSGGYQCSVTQIMSMQATISSYSAKGGWNDMDMLEVGNGGMSDAQYVAHFSIGFSILANPAVIAVNQDPLGVAASYRWTRNNVQLWSGPLASTTGGSVNDVVVVLFNNGGSSTTASATLSEIFGSSSVPSTQFEIRDLWGSRLSDSQAQSILNDGAAAHSSLLYNATAQSYSTGLSQANPMLLGTAVGSVSGPSGTITQSIPATGCRMFRLRAISSTTSSTTTTRSSTTTKSTSSTTTSAAQPQQTKWGQCGGQGWTGPTQCESPSTCQFQNGKCSQYKTI

SEQ ID NO: 4991 - protein, 403 aa, Aspergillus terreus
  strain NIH 2624 / FGSC A1156
MHMHSLVAALAAGTLPLLASAAGLHQSAVAKGLVYFGSATDNGELSDTAYVSQLSNTNDFGQITPGNSMKWDATEPSRNSFSYSGGDAIANLAEKNGQKLRCHTLVWHSQLPSWVSSGSWTNATLIAAMKNHITNVVTHYKGRCYAWDVVNEALNEDGSYRNSIFYQVIGEAYIPIAFATAAAADPSAKLYYNDYNTEYAGAKATGAQRIVKLVQSYGAKIDGVGLQAHLIVGNVASASTLASVLKGFTSLGVEVAYTELDIRMTLPSTSALLAQQATDYQNVAAACVSTSGCIGITIWDWTDKYSWVPSVFSGQGAALPWDSNFAKKPAYNGILAGLGASSSTSTTSTTLTTTTKTTTSAGSGSTGVSQKWGQCGGLGWTGPTTCVSGTTCQYQNDWYSQCL

SEQ ID NO: 4992 - protein, 861 aa, Aspergillus terreus
  strain NIH 2624 / FGSC A1156
MKLSILEAAALTAASVVSAQDDLAYSPPYYPSPWADGHGEWSNAYKRAVDIVSQMTLTEKVNLTTGTGWELERCVGQTGSVPRLGIPSLCLQDSPLGIRMSDYNSAFPAGINVAATWDKKLAYQRGKAMGEEFSDKGIDVQLGPAAGPLGRSPDGGRNWEGFSPDPALTGVLFAETIKGIQDAGVIATAKHYILNEQEHFRQVGEAQGYGFNITETVSSNVDDKTMHELYLWPFADAVRAGVGAVMCSYNQINNSYGCQNSLTLNKLLKAELGFQGFVMSDWSAHHSGVGAALAGLDMSMPGDISFDSGTSFYGTNLTVGVLNGTIPQWRVDDMAVRIMAAYYKVGRDRLWTPPNFSSWTRDEYGFAHFFPSEGAYERVNEFVNVQRDHAQVIRRIGADSVVLLKNDGALPLTGQEKTVGILGEDAGSNPKGANGCSDRGCDKGTLAMAWGSGTANFPYLVTPEQAIQNEVLKGRGNVFAVTDNYDTQQIAAVASQSTVSLVFVNADAGEGFLNVDGNMGDRKNLTLWQNGEEVIKTVTEHCNNTVVVIHSVGPVLIDEWYAHPNVTGILWAGLPGQESGNAIADVLYGRVNPGGKTPFTWGKTRASYGDYLLTEPNNGNGAPQDNFNEGVFIDYRRFDKYNETPIYEFGHGLSYTTFELSGLQVQLINGSSYVPTTGQTSAAQAFGKVEDASSYLYPEGLKRISKFIYPWLNSTDLKASTGDPEYGEPNFEYIPEGATDGSPQPRLPASGGPGGNPGLYEDLFQVSVTITNTGKVAGDEVPQLYVSLGGPNEPKRVLRKFERLHIAPGQQKVWTTTLNRRDLANWDVVAQDWKITPYAKTIFVGTSSRKLPLAGRLPRVQ

SEQ ID NO: 4993 - protein, 349 aa, Aspergillus terreus
  strain NIH 2624 / FGSC A1156
MLLSFLPLLPLATAALTYRGADISSLLIEEDAGIAYKNLNGQTQALESILADNGVNSIRQRLWVNPSDGSYDLDYNLKLAKRAKAAGMSVYLDLHYSDTWADPSHQTTPAGWSTDDIGTLAWQVYNYTKEVCDTFAANDIALEMVSIGNEIRNGLLWPLGATDSYPNIARLLHSGAWGVKDSALATTPQILLHLDNGWDWAAQKYFYDTVLAAGSELTSADFDLIGVSYYPFYNADATLSALKTSLGNLASAYGKKVLVVETNWPVACPNPEYQFPADLADIPFSVDGQSTFLRRLGEVVAGTDGGAGVYYWEPAWTKNAGLGSSCQDNLLVDYNTDQVRASISALGGI

SEQ ID NO: 4994 - protein, 433 aa, Aspergillus terreus
  strain NIH 2624 / FGSC A1156
MKSAISLLLASAATYVGASPHPEPPQLVLSPSTSTGVHGDEATSAIASSAADDVISDSPFLSFHRDLVQISSISGHERKAGDFVAEFLQAHNFTVVKQPVPSKDGRQPDEDRFNVFAYPSGASAAPKILLTSHIDTVPPFIPYSAARVDNDIRISGRGSVDAKGSVAAQVFAALDILERDPSAPLGLLFVVDEEVGGTGMKVFSDSSLNPSPSPFRAVIFGEPTDLALVSGHKGMLGFELVATGQAAHSGYPWLGHSAVSALLPALLRVDRLGDIPAQEGGLPSSPKYGRTTVNIGRMEGGVAANVVPASAHANVAVRLAAGTPDEARDIVRRAVRDATGGDENVYPDFSEWSEGYPPQDLDTDVDGFEVTTVNYGTDVPNLRIHERADGAPVRRYLYGPGSIHVAHGDHEAITVAQLEEALQGYRKLIEAAM

SEQ ID NO: 4995 - protein, 628 aa, Aspergillus terreus
  strain NIH 2624 / FGSC A1156
MVAFSTISGLGALSLLFSIIESVDGVSLKVSTDGGNSSSPLLYGFMFEDINHSGDGGIYGQMIQNNGLQGSSPNLTAWASVGDGTISVDTTNPLTAAIPNSLKLDIKPDATGAVGFTNEGYWGIPVDGTEFQNSFWMKGDFSGEITVRLVGNETGTEYGSTTFNQSSSSDDYTKVSVKFPTTKAPDGNVLYELTVDGESAQGSSLSFTLFELFAQTYKSRSNGLKPQLADALESVKGSFLRFPGGNNLEGNDVETRWKWNETIGPLENRPGHQGTWGYFNTDGLGLDEYLYWCEDMNLTPVLGVWAGFALESGGNTPITGDALTPYIEDVLNELEYVLGDPSTTYGKLRASYGREEPWNVTLVEIGNEDNLGGGCESYAERFTAFYNAIHDAYPDLTLIASTDNASCLPSPLPEGAWVDYHNYNTPDELVKQFGMFDNVDRSVPYFIGEYSRWEIPWPNMQGSVAEAVFMIGLERNSDVVKMAAYAPLLQLVNSTQWTPDLISFTQNPNMVIDSTSYYVQQMFSVNRGDTIKEVTSDSAFGPVYWVASSSGSSYYVKLANYGADTQEVSVSIPGMSSGKLTVLADSDPEAYNSDTQTLVTPSESNVQASNGQFSFTLPAWSVAVLTAN

SEQ ID NO: 4996 - protein, 817 aa, Aspergillus terreus
  strain NIH 2624 / FGSC A1156
MANIAHLIVSGLLAATVAHGQQYEGSSRSEDAFSYVQPRNTTILGQYGHSPAVLPSPNSTGSGGWQAAHTKARHFVSQLTLEEKADMVTGQPGPCVGNIVAIPRLGFNGLCLQDGPLAIRVADYASVFSAGVTAASTWDRDVLYERAFAMGQEFRAKGAHIALGPVAGPLGRSAYGGRNWEGFAADPYLTGVAMELSVKGYHDAGVQATPKHFIGNEQETQRNPIYNPNGTITDVLQEAVSSNIDDRTMHELYLWPFANAAHAKAAAFMCSYQRLNGSYACQNSKALNGLLKEELGFQGYVMSDWGGTHSGVASIESGLDMNMPGGLGPYGTIPQAGSFYGGNVTQGVKNGTIDEARVDDMIIRIMTPYYWLGQDKDFPSVDPSSADLNTFSPRSTWLRQFNLTGERNRDVRGDHAKIIRRQAAEATVLLKNEKNALPLKSPKSLAIFGNDAGEPTMGAVNQANFEFGTLAAGGGSGTGRFTYVVSPLEAIQSRAKQANTLVQYWMNNTDIATTDVTTLWVPAPPDACLVFLKTWAEEGEDREYLHVDYDGNDVVSSVASKCNNTIVVTHSSGINELPFADHPNVTAILAAHYPGQESGNSIVDVLYGDVNPSGRLPYTIARNGSEYNAPPTTEVTTTGAEDWQAWFNEKLEIDYRYFDAHNISVLYEFGFGLSYTTFNLSEINAEPLVESISSVPEQRPIQPGGNPALWENVYNVSVVVTNTGDVEGKAVPQLYVTFPDSTPAGTPPKQLRGFDKVALKPGQSQAASFQLMRRDLSYWDVVSQQWLIPEGEFVISVGFSSRDLREVVRVTPVSGST

SEQ ID NO: 4997 - protein, 396 aa, Aspergillus terreus
  strain NIH 2624 / FGSC A1156
MKVPRLLLALGGLASIHIASALPQGAVERDMHATSAVVHGGNVKTKFPSTTGLKFTIDGETGYFAGSNSYWIGFLTNNADVDLVFQHMKESGLKILRVWGFNDVNTKPATGTVWYQLHANGTSTINTGPDGLQRLDYVVHSAERHGIKLIINFVNNWNDYGGINSYLQAYGGASNEDFYNSEPMQKAYRAYIKEVVSRYIDSPAVFAWELANEPRCKGCDTSVLHSWIEKTSRYIKSLDKKHMVTTGEEGFGLDLMSDGSYPFTYVEGGNFTDTLSIPTIDFGTFHLYPSSWGTTNDWGNLWVEAHGAACKAAGKPRLFEEYGVTADHCALEKPWQTTALKTKGVSGDLYWQYGDTLSTGPSPDDGNTFYYGTDEFDCLVSDHVAAIDEMEKHGRH

SEQ ID NO: 4998 - protein, 747 aa, Aspergillus terreus
  strain NIH 2624 / FGSC A1156
MVAFMNSATFVAGLFTLWSRPIWATPASNTNAVVVNGTAFTLNGDHVSYRFHVDDATGDLFSDHFGPRVSGNFPTEIVSQVNGWVNTIGRVRREFPDQGRGDFRIPAIRIRQTAGYTVSELLYRSHTVIPGKPALPGLPATFGSEEDVTTLVVHLYDEISEVAADLSYSIFPKYDAVVRSVNVTNQGAGNITIETLASLSVDFPYEDLDMVYLRGDWAREAHSERRKVEYGTQGFDSSAGYSSHLHNPFLAIMNPATTESQGETWGFSLVYSGSFAVNVERGSQGFTRALLGLNPGQLSWVLRPGESLVSPECVAVYSADGIGGMSRLLHRLYRNHLIKSKFAVSDRPVLLNSWEGLGFNYNETTVYQLATEAAELGVKLFVLDDGWFGDKYPRTADNAGLGDWVPNPDRFPHGLPHEVDRITALHPGNDTSTNLRFGLWFEPEMVNPNSSLYHQHPDWALHAGSYPRTLTRNQLVLNMALPEVQDYVIKSVSDILDSADISYVKWDNNRGIHETPSPSTDHQYMLGMYRVFDNLTTKYPNVLWEGCASGGGRFDPGVLQYFPQIWTSDDTDALERITIQMGTSLAYPPSAMGAHLSAVPNQQTGRTLPITFRAHVAMMGGSFGLELNPAHMPDDERDAVPGLIALAERVNPIVLTGDMYRLSPHDSQWPAVLFISPDGEQAVLFYFQTSPRVDNSIPRVKMQGLDPQAVYSVDGDAEYSGATLMNVGLQFPFDSDVGSKVVFFQRL

SEQ ID NO: 4999 - protein, 529 aa, Aspergillus terreus
  strain NIH 2624 / FGSC A1156
MKISYFFVASLSYVSVARASQSFEERCTDFRDSINSLPNVQATIVEYVAGSQNVSLPDNDPSCNQSSQFVTADICRAAMVVKTSNSSQIVMEAWFPRNYTGRFLATGNGGFGGCIRYPELDYTTRLGFAAVATNNGHNGTSAEAFLNSPEVLRDFADRSIHTAAKVGKELTKRFYAEGFRKSYYLGCSTGGRQGFKSVQQYPHDFDGVVAGAPAVHEVNLISWAGHIYEITGNKSEETYLPPALWNIVHSEVMRQCDGLDGAQDNLIEDPDLCHPTFENIMCPSDNKSNNGSLSCITEAQANTVIQLMSPYYNTDGSMLFPGMQPGSETVSSALLYTGVPTPYAKEWFRYVVYNDTNWDPTTFNIKDAQAALKQNPFNIQTWEGDLSRFQNAGGKIITYHGMQDFLVSSFNSREYYKHVHETMGLAPDQLDEFYRYFRISGMAHCYYGDGASYIGGSAPSAYSDDPEDNVLMAMVEWVEKGIAPEFIRGTKLDQDGHPQYTRKHCRYPRRNVYRGPGSYLDENAWECVL

SEQ ID NO: 5000 - protein, 531 aa, Aspergillus terreus
  strain NIH 2624 / FGSC A1156
MLSKALFFSSLPLWAKVASAAFGITTTDSSYTIDAGSPNPLKFTVSRSSCDITSINYYGSELQYQSKGSHIGSGLGSASVSAVQNGDYIKVTCDTDTLTHYFVVHSGDPIIHMATYITAEPSIGELRFIARLNSNLLPNEEPFGDVSTTAGGSAIEGSDVFLVNGQTRSKFYSSQRFIDDQRHCISGSAHRVCMILNQYESSSGGPFHRDINSNNGGDYNSLYWYMNSGHVQTESYRMGLHGPYSMYFSRSGTPGTNIDTSFFANLDIKGYVPASGRGTVTGKASGADSNFKWVVHWYNDAAQYWTYTASDGSFTSPAMKPGTYTMAYYQGEYRVAETSVTVSAGSSTTKNISGSVKTGTTIFKIGDWDGQPTGFLNADKQLRMHPSDSRMSSWGPVTYTVGSSSVGSFPMALFKSVNSPVTIKFTATSAQTGAATLRIGTTLSFAGGRPQATINSYTGPTPSAPTNLNSRGVTRGAYRGLGEVYDVSIPAGTIVAGTNTITINVISGSSGDDFLSPNFVSAYPFLTLMRC

SEQ ID NO: 5001 - protein, 655 aa, Aspergillus terreus
  strain NIH 2624 / FGSC A1156
MASVIALSLLLPAAFAADHSPLRARLQDGLARTPQMGWNTYNHYNCYPDEEIFRSNAKALVDFGLADLGYRYATIDCGWTLTERLANGSLTWNATRFPSGFPAIADYLHDLGLLFGVYGDAGIKLCGPSDEHEEQDAQTFAAWGADSLKYDNCFSEASLGYPNVEYAPSSPLKPRYEVMSNALQKLDRPILFQICEWGIDFPALWAPALGHSWRIGNDIIPAWRSVFRTLNQAVPQTDFAGPGQWPDLDMLMVGNGVYSVPEEETHFSLWAILKSPLIIGSALKDATTEINSESLRILKQKAVIGYNQDKLGVSASLRRRWTDQGYEVWSGPLSNGRTVAAVINWRGEARDLTLDLPDIGLQSAGLVKNIWAGSTSRNVQTSYTARVEGHGTMLLELRDTVPAGVYPKKIFGSSRGQGTVFKSVYAGSTSENYTLAINFAKTIPSASKITVQVGANRQKLSIAVPPSRQQVTATIPLVAGSNNTITISHSHPITAIQVTSPNGTYYPATQFSLTGAARHETCGEGFCQPVGSKVSYLSPNSTARGVIPASAGTKYVEIDYINNEVAFSSSWGWGANSRNLTISLNGGEPVRLEVPLSGRHSELFGPGKGWWDTATLGVSVDGWKEGDNEVVVGNVNGEKGFQPYAADFVGLRVFD

SEQ ID NO: 5002 - protein, 219 aa, Aspergillus terreus
  strain NIH 2624 / FGSC A1156
MILPSLLVASLSALAAAGPVPPSALEARQSESASDLENGICKPVVLIFARGSTESGNMGYIAGMPTCNALKTKLGSDQVACQGVGGAYTAGLIPNFLPNNTDQASIDEATKMFDLAHTQCPDAQIVAGGYSQGTAVMDGSIQALPDDIKSTVKGVVLFGFTRNLQDNGQIPNYPKDQTKVICAPGDLVCDGTLIITPAHLTYALYAGEAAEFLASKVSA

SEQ ID NO: 5003 - protein, 338 aa, Aspergillus terreus
  strain NIH 2624 / FGSC A1156
MKGAMLLAFSLTAVAQQTLYGQCGGSGWSGPTQCVSGACCMSQNPWYSQCLQGNCMTTTSVSTTRTTSVSVTTTTSTGSSPSSTSVSQGCGKSPTLSSGTHTMTVNGATRQYILTLPQGYDSSRPYKLIFGYHWLSGTMQNVVSGNYYGVQPLAGNSAIFVAPQGKNNGWANSGGEDITFTDQMLSTLQGDLCIDKTQIYSMGWSYGGSMSYALACARPNVFRGVAVMSGANLSGCSPGTQPVAYYAQHGVSDTVLSISLGRQIRDTFVKDNGCTAQNPPEPAAGSGTHIKSVYSGCSSGHPVWWIPFDGPHEPLATDRGASSSWTPGQIWDFISQFS

SEQ ID NO: 5004 - protein, 432 aa, Aspergillus terreus
  strain NIH 2624 / FGSC A1156
MPISKGIFLSLLSTLPLALAGHRSHRCVVPSSNGTRDDSPAIAKVFAQCATDSIIVFQEGVDYNVFQPIKAENLSNVEIRMHGNLHLPQNISAVQEIVKAGNSYWFTLEGPRVDWTGSEDINHGWINSYGQAWWDANPPNGTGIENRPHLLSYTTSDATIKYMRSRKPIAHNCRLHGDDITVTHAIVDAYSTGGFPFNTDGFDVAGTNIRISDSVMYNGDDAIAVGSGSHDIVFERNTIGYQSHGMSIGSLGKDPTDFANITNLRFEDVTVIDALYAARFKSWTGGQGLVKNVTWKNIRVFNVTFPIFVTQSYWDQGANRGDVDESSSVMMEDFTWSDFTGSINTYQPGDGSCASDPCWYNAGLPNLQHTEAIILECNTATSCKNFVTENIQLYPQSMDAPHLICMNATAELNPRLGFDCRNGMYTALSERH

SEQ ID NO: 5005 - protein, 364 aa, Aspergillus terreus
  strain NIH 2624 / FGSC A1156
MRRIIKILVVVAVLYLAIIFLFANTRRVVPIHRQTPFPPTHPADLKIHDPSILKVGDKYYSYSVGPRIVIHEAPTLSGPWKKTGHVLDKDSIIPKGDRKAPWAPTTIEVAGTYYCYYAVSQSGCRNSAIGVATSQSPGPGGWTDHGAIIHTGTGPGSDSAPFDRSNAIDASVILTPDGNGYLNFGSYWTGIWQVPLNADLVSISDVSTNAARHLAYEPHAFSPGGKNPNPLCGDRSGSHPIEGAFVSYRAPFYYLWFSWGKCCKYNPKALPPRGKEYQIRVGRSTHPQGPFVDRQGVDLIEGGGEVVYGSNRDVYAPGGQGVLTDEGTDILYYHYLNKTVSLDFWEARLGYNPLIYIDGWPVAQ

SEQ ID NO: 5006 - protein, 296 aa, Aspergillus terreus
  strain NIH 2624 / FGSC A1156
MSTFLQDNGDLSAVLVKFAPFAVAVIAILAAWKFTGSSKPRKVLNPSEFQNFVLKEKTDISHNVAIYRFALPRPTDILGLPIGQHISLAATIEGQPKEVVRSYTPISSDNEAGYFDLLVKAYPQGNISKYLTTLKIGDTLKVRGPKGAMVYTPNMCRHIGMIAGGTGITPMLQIIKAIIRNRPRNGGNDTTKIDLIFANVNEEDILLRDELEKLAKEDDGFRIFYVLNNPPPGWNGGFGFVTAEMIKEHLPAPAKDVKILLCGPPPMVSAMKKATESLGYTKARPVSKLEDQVFCF

SEQ ID NO: 5007 - protein, 378 aa, Aspergillus terreus
  strain NIH 2624 / FGSC A1156
MKFPAFITAIISIASLSSAISVSGAAEGFAKGVTGGGSATPVYPSTISELVSYLKDSQPRVVVLTKTFDFRGSEGTTTGTGCAPWGTASNCQLAINKDNWCTNYQPNAPSASVSYDNAGVLGITITSDKTLIGQGSSGVIKGKGIRIVSGAKNVIIQNIAITDINPKYVWGGDAITLNNCDMVWIDHVTTARIGRQHLVLGTSASNRVTVSNSYFNGVSDYSATCNGYHYWGIYFAGSNDMVTLKGNYIYHMSGRSPKVQSNTLLHAVNNYWYDISGHAFEIGAGGYVLAEGNVFQNVPTILEEDDGQLFTSPNSNTNQVCSTYLGHVCQVNGFGSSGTFSSADTGFLVNFQGKNVASASAYTVAQSSVPSNAGQGKL

SEQ ID NO: 5008 - protein, 229 aa, Aspergillus terreus
  strain NIH 2624 / FGSC A1156
MTAAAVFGCTGAVGSQILATLLASDAFSSVATVSRKLPTAESPKLQAIEEGDTSKWGTTIASLSPKPSVVFNAVGTTRAAAGGIQNQWKIDHDLCIEIAKAAKEAGVKTYVFISSGGTRGFLSRHVPYSKMKIGVEDAIKELGFEHAIILRPGMIIGREKSKAPLFEAIVGHLNKLGQGVQDRIGQDQLIIGRAAVAAARLAEDGKAPSKFWAVEMSDIVRLGRDEWKE

SEQ ID NO: 5009 - protein, 480 aa, Aspergillus terreus
  strain NIH 2624 / FGSC A1156
MTLIRTVLMAAALLGASAHAQGVVGKPFGFAAGTTGGGNAAPAAPSDIKELAQWLSDDTPRVILIDKEFDFTGSEGTCADCACCVPSSNTCGSSGQNAIETSFGWCGSSPNVTCTYDKAGTKGMDVGSDKSIVGVGSAGVIRGKGLRLTGGASNVIIQNIHITDINPEYIWGGDAISLDGTDKIWIDHVKISLVGRQMFVTGYESSGSVTISNSEFDGRTSWSASCDGHHYWTLLGLGKNEQITFARNYIHHTSGRSPKLGESSYWHSYNNYWSDNSGHAFDVESAGKSLIEGNVFSNVKTPLTKENLDGVFAVSADDESTCSGSLGRSCIPNVLTSSGELSSAGDGVFSGWLSDEGDLTLMPASQVASYVKAHAGVGKLGAGDYSSSAIPSSTPAPSSSALAKRHGGHDRHGLGHIPHLTEGGPGAWHTPGPAPSWSWRTIGVRSTALPTPSPSSSSCAIGKPTAGPPRFPIFGDLGIF

SEQ ID NO: 5010 - protein, 426 aa, Aspergillus terreus
  strain NIH 2624 / FGSC A1156
MSIEVDWKTATSGPDGEALAERIRSFIHDKFQQVALPRFIRSVQVHSFDFGTVPPDLEIKDFCEPFADFYEEDEDDETSEVSEELVSAHGNQWHRTHSELNEPPYRDEVTMNQPLRDPFDEGFHPSPLRSPMEHLNPHFLPRAGTPGIPGGTSTIGYHLMSLGGLSGTQTPLAAVAGGTPFANGWTDHNLGPGNRGHASGPAAGAMRQHRPEDIDSSNPTSRPSTSSTLPSHPSGSNRNSGDGSHPEEEHLDDPAEPDHPFRFPKMRERRPEDFQVMCRAKYAGDVRLSLTAEILLDYPMPSFVGLPLKLNITGVTFDGVAVVAYIRKRVNFCFLSAEDADALIGADDQETRDKDDHPRSGLDPTTSPKRQGGLLREIRVESEIGRKEDGKQVLKNVGKVERFVLAQVRRIFEEELVFPSFWTFLI

SEQ ID NO: 5011 - protein, 565 aa, Aspergillus terreus
  strain NIH 2624 / FGSC A1156
MAFNFNWSPLMADASFYTRAQDLLTAALNKSPKPPIIVDDIIVTELNLGSIPPELEILEIGDLAEDRFRGIFKMSYSGDAFLTLKTRVQANPLNTYLLTRPSFASPLPLAAATPLTIPLQITLSDFKLSGFVILVFSKQKGITVVFRNDPLESLKVSSTFDSIPFVRDFLQREIEAQLRILFMDELPAIIHRLSLRLWVPEYRAGEEDQDQNTNTAGEGPGQDPLASPPQDPVDALGNALNESEIASLSLDSSVETHSLFSQKNLLRLAALTDSQRTLSLFTPSIQEVVYRAWTSPSDQGDISGGVTSPLSPALSRTQSQVGGMSSFQDNASTISSYSRTSTSTHTFSTYGLNLGAGRHSKAHARKRKKRVVDLRRPKQPESETASVTDESSFTETTSAPSVRSAPLPRVNEQPDDPVTPPLSPDSDFHLPPIPERHRFSISRPALRRDIATEMLRETGESSSEPARRHAEVDDIDATPRTIIRHEPSRYEGEKQEAGPSRQLPSTILPFTEEKSTPGPVDQALVERIAGEIARRMREDKLMGTNSCAFWNRPGHEESPPPAYGQ

SEQ ID NO: 5012 - protein, 265 aa, Aspergillus terreus
  strain NIH 2624 / FGSC A1156
MRSSILLGVLGAAGALGSPLDKRAYVTDWTVVTVTTTITGAPPAQTYAPVQAVQISQHLRRPPPPLRLRRPRRVASSKSIESLFSRSSSTSTSSSAPAATPTDYQSAILYNHNVHRSNHSASSLAWSADLESSAHTLASRCVYQHDTSIAGGGYGQNIGYGVSADEIGVMITNLMYNNEMGYYSDLYGEATPDMTNFDLWGHFSQIVWKGTTHVGCATVTCPSLGNVDSSSAVPFTVCNYSPAGNYDGEYSSNVLAPLGHAMYVA

SEQ ID NO: 5013 - protein, 691 aa, Aspergillus terreus
  strain NIH 2624 / FGSC A1156
MFKVGSWLYGKKPGTASTQSLDSLTELRDSATLILNDDVDGAEDGLSEGISSFHNLGRGVVAFIRATLGFEQEIMRQASERLNIAETSAASDQHKAQHNSHAPNTYHSQIYVPGTEFALCQAMAQLMSAVVGVLNESLTESIKGFYKMRKAYITLDGILKMEQKFMQMKRSGELSPPELAQSSSRSSGQGADAKSNPTTPVEAGGLSQKLSELNVSREPTDSDMSVETSSEMLSHDPDSDIFRNQIDVFVHSGANFCFGILLLLISMVPPAFSKLLGIIGFHGDKERGLKMLWQASKFHNLIGAIAAFAMLGYYNGFVRYCDIMPDPVSREEGDVQAYPQERLEALLAKMRKQFPKSQLWLLEESRMEGANKNLERALELLCGEERSPLKQVEALRVFERSLNAMYLHRYQLCSESFIECVDLNSWSRSLYYYIAGAAHVSLYRSALGKDASEATKHAEQATEYFRTAPPLAGKKRFMARQLPFDVFVARKIAKWEARAKEWKVPLVDAVGVDPIEEMIFFWNGHSRMTQAHLEESLQHLAWSESDANKHWSREGPEEKAILQLVRAAVLRSMRKHSEAKDLLQRGILDHDKSLFVGHLKDNWIGPAAHFEMAANLWMERPTYIEIHGGPDEENPGEDAHQLERNKVRQCKEYLEKAARWESYELDARIGLKVTAALEAVHKWETAHSATS

SEQ ID NO: 5014 - protein, 504 aa, Aspergillus terreus
  strain NIH 2624 / FGSC A1156
MTTFTKLSEQEAPSLSVHPTRRISKINPNIYAGFTEHMGRCIYGGIYDPGNPLSDENGFRKDVLEALKELNIPVVRYPGGNFMATYHWIDGVGPKDQRPARPELAWLGTETNQFGTDEFLKWCEVLGTEPYFCLNFGTGTLDEALAWVEYCNGTRDTYYANLRRKNGREEPYNVKYWALGNETWGPWQVEQMTKEAYAHKAYQWAKALKLLDPSLVLVLCGQDGTASWDYYTLKQCLLPLNSPLSTSAVPLIDMHSIHLYTASSDHRANATAPLAAERAIEITSSLIDLARIENGVPADQLRPTICFDEWNVWDPIRAEGSKGAEECYTLSDALAVAVYLNVFVRKSKDLGMCCIAQSVNVISPLMTTKDGITKQTTWWPLYLFSRYMRGWTISAHLSCSTYEGETSPKWVRGVKDTPWLDVSATLGEDGYVNLAVVNVHDDKGIETQLEGPSGEVSVFTVTGDNVNVTNMKGKQEVGIVESTWDGKGKYVFPKHSFTLLRWKA

SEQ ID NO: 5015 - protein, 841 aa, Aspergillus tubingensis
MRGSNLFQLTLALLLSLVAAEDGYNGWLRYAPVSCDLHCRQALPSHIVLLNSTKGSPIETAGRELKAGFQSILSTNLTFHPFQCDSSASILVATLDEYRQKCRDINLPELDPDGFWLQSEGDTVRILGNNARGALYGAYEYLAMVAQRNFSRVAYTTNPHAPIRWVNQWDNMDGSIERGYGGASIFFKDGTVVEDMAPVEQYARLLASIRINAIVVNNVNANATLLLPENMKGLGRIADACRPYGVQIGISLNFASPESLGGLETYDPLDPGVIAWWQNITDSLYTYVPDMAGYLVKADSEGQPGPDTYNRTLSQGANLFARALQPHGGVLMYRAFVYNDNLNESDWKADRAKAAVEYFKDLDGQFYENVVVQIKYGPIDFQVREPTSPLFANLYQTNTAIELEVSQEYLGQQCHLVYLPPLWKTVLDFDLRVDHKPSMVRDILSGQRFNRTLGGWAAVVNVGTNRTWLGSHLAMSNLYAYGRLAWSPTDDSEQILKDWTRLTFGQNRQVIDTIADMPMTSWPAYENYTGNLGIQTLTDILYTHYGPNPATQDNNGWGQWTRADHNSVGMDRTISNGTGYTGQYPEEVARLYESLETTPDDLVLWFHHVPWTHRLHSGLTVIQHFYNAHYAGSEAAHGFIRQWESLKGLIDRERYEAMRSRLVYQAGHSIVWRDAINNFYYNMTGIPDVAGRVGHHPWRIEAESMRLDGYQTYTVSPFEAASNTTAIITTSNSTTGTARTTIKAPSGVYDIGVNYYDLYGGQSKWTLSVGDKVVGQWLGDMEHQSLGHTPSIYLDGHSATRITFHGVVVRQGDQLKIVGEANGVEPAPVDYVVLLPPGVVD

SEQ ID NO: 5016 - protein, 280 aa, Aspergillus tubingensis
MKQFSAKYAIAVVVTAGHALAASTQGISEDLYSRLVEMATISQAAYADLCNIPSTIIKGEKIYNSQTDINGWILRDDSSKEIITVFRGTGSDTNLQLDTNYTLTPFDTLPQCNSCEVHGGYYIGWISVQDQVESLVQQQVSQFPDYALTVTGHSLGASLAALTAAQLSATYDNIRLYTFGEPRSNQAFASYMNDAFQASSPDTTQYFRVTHANDGIPNLPPADEGYAHGVVEYWSVDPYSAQNTFVCTGDEVQCCEAQGGQGVNNAHTTYFGMTSGHCTW

SEQ ID NO: 5017 - protein, 331 aa, Aspergillus tubingensis
MVKSILASVLFAATALAASRMTAPSGAIVVAKSGGDYDTISAAVDALSTTSTETQTIFIEEGSYDEQVYIPALSGKLIVYGQTEDTTTYTSNLVNITHAIALADVDNDDETATLRNYAEGSAIYNLNIANTCGQACHQALAVSAYASEQGYYACQFTGYQDTLLAETGYQVYAGTYIEGAVDFIFGQHARAWFHECDIRVLEGPSSASITANGRSSESDDSYYVIHKSTVAAADGNDVSSGTYYLGRPWSQYARVCFQKTSMTDVINHLGWTEWSTSTPNTENVTFVEYGNTGTGAEGPRANFSSELTEPITISWLLGSDWEDWVDTSYIN

SEQ ID NO: 5018 - protein, 362 aa, Aspergillus tubingensis
MHSFASLLAYGLAASATLASASPIEARGSCTFKTAAAAKAGKAGCSTITLDNIEVPAGTTLDLTGLTSGTKVIFEGTTTFDYEEWAGPLISMSGKDITVTGASGHLINCDGARWWDGKGTSGKKKPKFFYAHGLDSSSITGLNIKNTPLMAFSVQADDITLTDITINNADGDTLGGHNTDAFDVGNSVGVNIIKPWVHNQDDCLAINSGENIWFTSGTCIGGHGLSIGSVGGRSNNVVKNVTIEHSTVSNSENAVRIKTVSGATGSVSEITYSNIVMSGISDYGVVIQQDYEDGKPTGKPTNGVTITDVKLESVTGTVDSKATDIYLLCGSGSCSDWTWDDVKVTGGKKSTACKNYPSVASC

SEQ ID NO: 5019 - protein, 211 aa, Aspergillus tubingensis
MKVTAAFAGLLVTAFAAPAPEPDLVSRSAGINYVQNYNGNLGDFTYDESAGTFSMYWEDGVSSDFVVGLGWTTGSSNAITYSAEYSASGSASYLAVYGWVNYPQAEYYIVEDYGDYNPCSSATSLGTVYSDGSTYQVCTDTRTNEPSITGTSTFTQYFSVRESTRTSGTVTVANHFNFWAHHGFGNSDFNYQVVAVEAWSGAGSASVTISS

SEQ ID NO: 5020 - protein, 332 aa, Aspergillus tubingensis
MKFFKAKGSLLSSGIYLIALTPFVNAKCALPSSYSWSSTDALATPKSGWTALKDFTDVVSDGKHIVYASTTDEAGNYGSMTFGAFSEWSNMASASQTATPFNAVAPTLFYFKPKSIWVLAYQWGSSTFTYRTSQDPTNVNGWSSEQALFTGKISDSSTNAIDQTVIGDDTNMYLFFAGDNGKIYRSSMSINDFPGSFGSQYEVILSGARNDLFEAVQVYTVDGGEGDTKYLMIVEAIGSTGHRYFRSFTASSLGGEWTAQAASEDQPFAGKANSGATWTEDISHGDLVRNNPDQTMTVDPCNLQLLYQGHDPNSSGDYNLLPWKPGVLTLKQ

SEQ ID NO: 5021 - protein, 435 aa, Aspergillus tubingensis; identical to SEQ ID NO: 4577

SEQ ID NO: 5022 - protein, 406 aa, Aspergillus tubingensis
MALYRNLYLLASLGLSSAAPSKVQRAPDSSIHARAVCTPTAGGDSSTDDVPAITEALSSCGNGGTIVFPEGSTYYLNSVLDLGSCSDCDIQVEGLLKFASDTDYWSGRTAMISVSNVDGLKLRSLTGSGVIDGNGQDAWDLFASDSSYSRPTLLYITGGSNLEISGLRQKNPPNVFNSVKGGATNVVFSNLKMDANSKSDNPPKNTDGFDIGESTYVTITEVTVVNDDDCVAFKPSSNYVTVDTISCTGSHGISVGSLGKSSDDSVKNIYVTGATMINSTKAAGIKTYPSGGDHGTSTVSNVTFNDFTVDNSDYAFQIQSCYGEDDDYCEENPGNAKLTDIVVSSFSGTTSDKYDPVVANLDCGADGTCGISISGFDVKAPSGKSEVLCANTPSDLGVTCTSGASG

SEQ ID NO: 5023 - protein, 350 aa, Aspergillus tubingensis
MIYPLLLSALPLLSSAALTYRGADISSLLIEEDAGISYKNLNGETQALEDILVNNGVNSIRQRVWVDPSDGSYDLDYNLKLAKRVQAAGMSIYLDLHLSDTWADPSDQTTPTGWSTTDIDTLTWQLYNYTLEVCNTFAENDIDVEIVSIGNEISSGLLWPLGKTSNYDNIAKLLHSGAWGVKDSDLTTTPKIMIHLDNGWDWDEQEYFYKTVLATGSLLSTDFDLMGVSYYPFYSSEATLSSLKTSLTNMQSNYDKPVVVVETNWPVSCPDPEYSFPSDLTSIPFSAAGQEEFLEKLAEVVEGVTDGLGIYYWEPAWIDNAGLGSSCADNLMVDVNTDEVLESVTVFEDL

SEQ ID NO: 5024 - protein, 521 aa, Bacillus subtilis
MGLGKKLSVAVAASFMSLTISLPGVQAAENPQLKENLTNFVPKHSLVQSELPSVSDKAIKQYLKQNGKVFKGNPSERLKLIDHTTDDLGYKHFRYVPVVNGVPVKDSQVIIHVDKSNNVYAINGELNNDASAKTANSKKLSANQALDHAFKAIGKSPEAVSNGNVANKNKAELKAAATKDGKYRLAYDVTIRYIEPEPANWEVTVDAETGKVLKKQNKVEHAAATGTGTTLKGKTVSLNISSESGKYVMRDLSKPTGTQIITYDLQNRQYNLPGTLVSSTTNQFTTSSQRAAVDAHYNLGKVYDYFYQTFKRNSYDNKGGKIVSSVHYGSKYNNAAWIGDQMIYGDGDGSFFSPLSGSMDVTAHEMTHGVTQETANLNYENQPGALNESFSDVFGYFNDTEDWDIGEDITVSQPALRSLSNPTKYGQPDHYKNYRNLPNTDAGDYGGVHTNSGIPNKAAYNTITKIGVKKAEQIYYRALTVYLTPSSSFKDAKAALIQSARDLYGSQDAASVEAAWNAVGL

SEQ ID NO: 5025 - protein, 521 aa, Bacillus subtilis
MGLGKKLSVAVAASFMSLTISLPGVQAAENPQLKENLTNFVPKHSLVQSELPSVSDKAIKQYLKQNGKVFKGNPSERLKLIDHTTDDLGYKHFRYVPVVNGVPVKDSQVIIHVDKSNNVYAINGELNNDASAKTANSKKLSANQALDHAFKAIGKSPEAVSNGNVANKNKAELKAAATKDGKYRLAYDVTIRYIEPEPANWEVTVDAETGKVLKKQNKVEHAAATGTGTTHKGKTVPLNISSESGKYVMRDLSKPTGTQIITYDLQNRQYNLPGTLVSSTTNQFTTSSQRAAVDAHYNLGKVYDYFYQTLKRNSYDNKGGKIVSSVHYGGKYNNAAWIGDQMIYGDGDGSFFSPLSGSMDVTAHEMTHGVTQETANLNYENQPGALNESFSDVFGYFNDTEDWDIGEDITVSQPALRSLSSPTKYGQPDHYKNYRNLPNTDAGDYGGVHTNSGIPNKAAYNTITKIGVKKAEQIYYRALTVYLTPSSSFKDAKAALIQSARDLYGSQDAASVEAAWNAVGL

SEQ ID NO: 5026 - protein, 277 aa, Bacillus subtilis; identical to SEQ ID NO: 4175

SEQ ID NO: 5027 - protein, 521 aa, Bacillus subtilis; identical to SEQ ID NO: 4152

SEQ ID NO: 5028 - protein, 271 aa, Bacillus subtilis
MKISMQKAAISLLVFTMFFTLMMSETVFAAGLNKDQKRRAEQLTSIFENGTTEIQYGYVERLDDGRGYTCGRAGFTTATGDALEVVEVYTKAVPNNKLKKYLPELRRLAKEESDDTSNLKGFASAWKSLANDKEFRAAQDKVNDHLYYQPAMKRSDNAGLKTALARAVMYDTVIQHGDGDDPDSFYALIKRTNKKAGGSPKDGIDEKKWLNKFLDVRYDDLMNPANHDTRDEWRESVARVDVLRSIAKENNYNLNGPIHVRSNEYGNFVIK

SEQ ID NO: 5029 - protein, 521 aa, Bacillus subtilis
  MOD_RES (338)..(338): Any amino acid
MGLGKKLSVAVAASFMSLTISLPGVQAAENPQLKENLTNFVPKHSLVQSELPSVSDKAIKQYLKQNGKVFKGNPSERLKLIDHTTDDLGYKHFRYVPVVNGVPVKDSQVIIHVDKSNNVYAINGELNNDASAKTANSKKLSANQALDHAFKAIGKSPEAVSNGNVANKNKAELKAAATKDGKYRLAYDVTIRYIEPEPANWEVTVDAETGKVLKKQNKVEHAAATGTGTTLKGKTVSLNISSENGKYVMRDLSKPTGTQIITYDLQNRQYNLPGTLVSSTTNQFTTSSQRAAVDAHYNLGKVYDYFYQTFKRNSYDNRGGKIVSSVHYGSRYNNAAWXGDQMIYGDGDGSFFSPLSGSMDVTAHEMTHGVTQETANLNYENQPGALNESFSDVFGYFTDTEDWDIGEDITVSQPALRSLSNPTKYGQPDHYKNYQNLPNTDAGDYGGVHTNSGIPNKAAYNTITKIGVKKAEQIYYRALTVYLTPSSSFKDAKAALIQSARDLYGSQDAASVEAAWNAVGL

SEQ ID NO: 5030 - protein, 506 aa, Bacillus subtilis
MSLSISLPGVQAAEGHQLKENQTNFLSKNAIAQSELSAPNDKAVKQFLKKNSNIFKGDPSKRLKLVESTTDALGYKHFRYAPVVNGVPIKDSQVIVHVDKSDNVYAVNGELHNQSAAKTDNSQKVSSEKALALAFKAIGKSPDAVSNGAAKNSNKAELKAIETKDGSYRLAYDVTIRYVEPEPANWEVLVDAETGSILKQQNKVEHAAATGSGTTLKGATVPLNISYEGGKYVLRDLSKPTGTQIITYDLQNRQSRLPGTLVSSTTKTFTSSSQRAAVDAHYNLGKVYDYFYSNFKRNSYDNKGSKIVSSVHYGTQYNNAAWTGDQMIYGDGDGSFFSPLSGSLDVTAHEMTHGVTQETANLIYENQPGALNESFSDVFGYFNDTEDWDIGEDITVSQPALRSLSNPTKYNQPDNYANYRNLPNTDEGDYGGVHTNSGIPNKAAYNTITKLGVSKSQQIYYRALTTYLTPSSTFKDAKAALIQSARDLYGSTDAAKVEAAWNAVGL

SEQ ID NO: 5031 - protein, 488 aa, Bacillus subtilis
FMSLTISLPGVQAAENPQLKENLTNFVPKHSLVQSELPSVSDKAIKQYLKQNGKVFKGNPSERLKLIDHTTDDLGYKHFRYVPVVNGVPVKDSQVIIHVDKSNNVYAINGELNNDASAKTANSKKLSANQALDHAFKAIGKSPEAVSNGNVANKNKAELKAAATKDGKYRLAYDVTIRYIEPEPANWEVTVDAETGKVLKKQNKVEHAAATGTGTTLKGKTVSLNISSENGKYVMRDLSKPTGTQIITYDLQNRQYNLPGTLVSSTTNQFTTSSQRAAVDAHYNLGKVYDYFYQTFKRNSYDNRGGKIVSSVHYGSRYNNAAWIGDQMIYGDGDGSFFSPLSGSMDVTAHEMTHGVTQETANLNYENQPGALNESFSDVFGYFTDTEDWDIGEDITVSQPALRSLSNPTKYGQPDHYKNYQNLPNTDAGDYGGVHTNSGIPNKAAYNTITKIGVKKAEQIYYRALTVYLTPSSSFKDAKAALIQSARD

SEQ ID NO: 5032 - protein, 383 aa, Bacillus subtilis
MNHSKTLLLTAAAGLMLTCGAVSSQAKHKLSDPYHFTVNAAAETEPVDTAGDAADDPAIWLDPKTPQNSKLITTNKKSGLVVYSLDGKMLHSYNTGKLNNVDIRYDFPLNGKKVDIAAASNRSEGKNTIEIYAIDGKNGTLQSMTDPDHPIATAINEVYGFTLYHSQKTGKYYAMVTGKEGEFEQYELKADKNGYISGKKVRAFKMNSQTEGMAADDEYGRLYIAEEDEAIWKFSAEPDGGSNGTVIDRADGRHLTRDIEGLTIYYAADGKGYLMASSQGNSSYAIYDRQGKNKYVADFRITDGPETDGTSDTDGIDVLGFGLGPEYPFGIFVAQDGENIDHGQKANQNFKIVPWERIADQIGFRPLANEQVDPRKLTDRSGK

SEQ ID NO: 5033 - protein, 596 aa, Bacillus subtilis
MKKVFSNKKFLVFSFIFAMILSLSFFNGESAKASSDKSYKIIGYYPSWGAYGRDFQVWDMDASKVSHINYAFADICWEGRHGNPDPTGPNPQTWSCQDENGVIDVPNGSIVMGDPWIDVQKSNAGDTWDEPIRGNFKQLLKLKKNHPHLKTFISVGGWSWSNRFSDVAADPAARENFAASAVNFLRKYGFDGVDLDWEYPVSGGLPGNSTRPEDKRNYTLLLQDVREKLDAAEAKDGKKYLLTTVSGASPEYVSNTELDKIAETVDWINIMTYDFNGGWQSISAHNAPLFYDPKAKEAGVPNAETFNIESTVKRYKEAGVKADKLVLGTPFYGRGWSNCEPADNGEYQKCGPAKEGTWEKGVFDFSDLEKNYINKNGYKRYWNDRAKVPFLYNAENGNFITYDDEESYGYKTDLIQSNGLSGAMFWDFSGDSNQTLLNKLAADLGFAPGGGNPEPPSSAPDNLRVTEKTATSISLAWDAPSDGANIAEYVLSYEGGAVSVKDTSATIGQLKPNTTYSFTVSAKDADGKLHTGPTIEAATNSDQTCGYNEWKDTAVYTGGDRVVFNGKVYEAKWWTKGEQPDQAGESGVWKLIGDCK

SEQ ID NO: 5034 - protein, 360 aa, Bacillus subtilis
MLKKLAVCLSIVLLLLGAASPISAHTVYPVNPNAQQTTKDIMNWLAHLPNRSENRVMSGAFGGYSDVTFSMTEENRLKNATGQSPAIYGCDYGRGWLETADITDTIDYCCNSSLISYWKSGGLPQVSLHLANPAFPSGNYKTAISNSQYKNILDPSTVEGKRLEALLSKIADGLTQLKNQGVTVLFRPLHEMNGEWFWWGLTGYNQKDNERISLYKELYKKIYRYMTETRGLDNLLWVYSPDANRDFKTDFYPGSSYVDITGLDAYFTDPYAISGYDEMLSLKKPFAFAETGPSGNIGSFDYAAFINAIRQKYPQTTYFLTWDEQLSPAANQGAQSLYQNSWTLNKGEIWNGGSLTPIAE

SEQ ID NO: 5035 - protein, 47 aa, Bacillus subtilis
AIKLVQSPNGNFAASFVLDGTKWIFKSKYYDSSKGYWVGIYEVWDRK

SEQ ID NO: 5036 - protein, 12 aa, Bacillus subtilis
  MOD_RES (1)..(2): Any amino acid
  MOD_RES (6)..(6): Any amino acid
XXKEIXWIFHDN

SEQ ID NO: 5037 - protein, 12 aa, Bacillus subtilis
  MOD_RES (1)..(2): Any amino acid
  MOD_RES (6)..(6): Any amino acid
XXKEIXHIFHDN

SEQ ID NO: 5038 - protein, 521 aa, Bacillus subtilis
MGLGKKLSVTVAASFMSLTISLPGVQAAENPQLKENLTNFVPKHSLVQSELPSVSDKAIKQYLKQNGKVFKGNPSERLKLIDHTTDDLGYKHFRYVPVVNGVPVKDSQVITHVDKSNNVYAINGELNNDASAKTANSKKLSANQALDHAFKAIGKSPEAVSNGNVANKNKAELKAAATKDGKYRLAYDVTIRYIEPEPANWEVTVDAETGKVLKKQNKVEHAAATGTGTTLKGKTVSLNISSENGKYVMRDLSKPTGTQIITYDLQNRQYNLPGTLVSSTTNQFTTSSQRAAVDAHYNLGKVYDYFYQTFKRNSYDNRGGKIVSSVHYGSRYNNAAWIGDQMIYGDGDGSFFSPLSGSMDVTAHEMTHGVTQETANLNYENQPGALNESFSDVFGYFTDTEDWDIGEGITVSQPALRSLSNPTKYGQPDHYKNYQNLPNTDAGDYGGVHTNSGIPNKAAYNTITKIGVKKAEQIYYRALTVYLTPSSSFKDAKAALIQSARDLYGSQDAASVEAAWNAVGL

SEQ ID NO: 5039 - protein, 341 aa, Bacillus subtilis
MRNLTKTSLLLAGLCTAAQMVFVTHASADQSIKYDHTYQTPSYIIEKSPQKPVQNTTQKESLFSYLDKHQTQFKLKGNANSHFRVSKTIKDPKTKQTFFKLTEVYKGIPIYGFEQAVAMKENKQVKSFFGKVHPQIKDVSITPSISEKKAIHAARRELEASIGKIEYLDGEPKGELYIYPHDGEYDLAYLVRLSTSEPEPGYWHYFIDAKNGKVIESFNAIHETAGTGIGVSGDEKSFDVREQNGRFYLADETRGKGINTFDAKNLNETLFTLLSQLIGYTGKEIVSSTSVFNEPAAVDAHANAQAVYDYYSKTFGRDSFDQNGARITSTVHVGKQWNNAA

SEQ ID NO: 5040 - protein, 423 aa, Bacillus subtilis
MMSSVKKTICVLLVCFTMMSVMLLGPGVTEVSAASDAKVNISADRQVIRGFGGMNHPAWIGDLTAAQRETAFGNGQNQLGFSVLRIHVDENRNNWYKEVETAKSAIKHGAIVFASPWNPPNDMVETFNHNGDTSAKRLRYDKYAAYAQHLNDFVNFMKSNGVNLYAISMQNEPDYAHEWTWWTPQEILRFMRENAGSINARVIAPESFQYLKNISDPILNDPQALRNMDILGTHLYGTQVSQFPYPLFKQKGGGKELWMTEVYYPNSDNNSADRWPEALGVSEHIHHSMVEGDFQAYVWWYIRRSYGPMKEDGMISKRGYNMAHFSKFVRPGYVRIDATKNPEPNVYVSAYKGDNKVVIVAINKNNTGVNQNFVLQNGTASQVSRWITSSSSNLQPGTDLKVTDNHFWAHLPAQSVTTFVVKR

SEQ ID NO: 5041 - protein, 113 aa, Bacillus subtilis
  strain 168
MDQEAGFMVNFINSYFIALGVLIGGALIGGLGAYLAGEPPLTAITKLANRLKIWALVAAIGGTFDAVYSFERGILEGNTRDIFKQLLLIISAMGGAQSGWLIISWLTQEHLSS

SEQ ID NO: 5042 - protein, 453 aa, Bacillus subtilis
  strain 168
MNPKRFLIGIDKTSENTLFLPSSLKQDGLLHAAFGTKVVRCHVAYRRHLEQTVLLSENLFHELLLPHRSRADILIHDHTVHIGPLVGIFTAGFTVSLERPFKDRSLFFSKLVTLHEQAGGYCFVFGAHQINWEEGTIEGLLYRENGWEKKIVPLPNVVYDRLPNRKIEDSLLLQHTKKRLIDEYQIPWFNKTFFNKWNVHQLLEKDPRTAPFLPRSELTPSVELIDELCGAYKKVYIKPANGALGTGIYQLTRTDGGLTVKHTNDAKTFTSIDYSDAASFLAEFQKHHNPSDFLIQQGVDLIEFQGKPADFRVHTNKNRKGKWTVTAIAVKISGKNSITTHLSNGGTVKTLAEVYDDPAERVEVIKKLSAAALTASHVLHDHIEGFIGEIGFDFGIDQNGKVWMFEANSRPGRSIFSHPNLHHVDSLTKRRSFEYASYLSEKAITSPEALWPS

SEQ ID NO: 5043 - protein, 43 aa, Bacillus subtilis
  strain 168
MKKAVIVENKGCATCSIGAACLVDGPIPDFEIAGATGLFGLWG

SEQ ID NO: 5044 - protein, 55 aa, Bacillus subtilis
  strain 168
MKRNQKEWESVSKKGLMKPGGTSIVKAAGCMGCWASKSIAMTRVCALPHPAMRAI

SEQ ID NO: 5045 - protein, 612 aa, Bacillus subtilis
  strain 168
MKPKKRQMEYLTRGLIAVQTEQGVFVSWRFLGTDHETTAFHLYRDGKRITRDPIAESTNFLDQNGTADSVYQVAAVNKGREEKLSKKARVWQENVLEVPLAKPEGGVTPDGKPYTYSANDASVGDIDGDGEYEMILKWDPSNSKDNAHDGYTGEVLIDAYKLDGTFLWRINLGRNIRAGAHYTQFMVYDLDGDGKAEIAMKTADGTTDGKGHIIGDEQADFRNEQGRILSGPEYLTVFKGETGEALTTVEYEPPRGKLEDWGDGYGNRMDRFLAGTAYLDGERPSLVMARGYYTRTVLVAYDFRNGRLKKRWVFDSNQPGHEAYAGQGNHSLSVADVDGDGKDEIIYGAMAVDHDGTGLYSTGLGHGDAMHVGDLDPSRKGLEVFQVHEDATKPYGLSLRDAGTGEILWGVHAGTDVGRGMAAHIDPSYKGSLVWGIDPPGNDGMSYGLFTSKGEKISDKAPSSANFAIWWDGDLVRELLDHDWDGTIGRPKIEKWDAENGCLKTIFQPAGVLSNNGTKGNPVLQANLFGDWREEVIWRTEDSSALRIYTTTHLTRHCFYTLMHDPVYRLGIAWQNTAYNQPPHTSFYLGTGMKKPPKPALYIAGSKAEAPL

SEQ ID NO: 5046 - protein, 165 aa, Bacillus subtilis
  strain 168
MLTKRLLTIYIMLLGLIAWFPGAAQAEEKQPAVPAVFLMKTIEGEDISIPNKGQKTILHFWTSWCPPCKKELPQFQSFYDAHPSDSVKLVTVNLVNSEQNQQVVEDFIKANKLTFPIVLDSKGELMKEYHIITIPTSFLLNEKGEIEKTKIGPMTAEQLKEWTEE

SEQ ID NO: 5047 - protein, 367 aa, Bacillus subtilis
  strain 168
MSVFTNSYIPVNKYTRPGLKLQGVKKCVLHYTANPGAGADNHRRYFSNAQVYASAHIFVDKAEAICIIPLNEVAYHANDIQQRDSAGNPYRGVAALKPNANFLSIGVEMCLEKDGSFHSDTVERTEDVFVELCNKFGLDPIDDIVRHYDITHKNCPAPWVSNSQKFVDFKNRVKAKMSGKSVSKASPTKPTTSSPSSSSAVSGSLKSKVDGLRFYSKPSWEDKDVVGTVNKGIGFPTVVEKVKVGSAYQYKVKNSKGTTYYITASDKYVDVTGSVKTSSSAPKTTSTSSSSSSIKSVGKIKIVGVSSAAIVMDKPDRNSSKNIGTVKLGSTISISGSVKGKNNSNGYWEVIYKGKRGYISGQFGSTI

SEQ ID NO: 5048 - protein, 105 aa, Bacillus subtilis
  strain 168
MKLRHLLLGAGLGICTAVVVRQYVMKPYISSEKALRIVKSAFKQRGPIDGSWIYTQPEPYNINGETVQVYKTGITRSAFGELEQYEVMVDAKTGEIVDVIDTIAS

SEQ ID NO: 5049 - protein, 282 aa, Bacillus subtilis
  strain 168
MARKKLKKRKLLISLFFLVSIPLALFVLATTLSKPIEISKETEEIDEQQVFIDSLSGHAQILYEKYHVLPSITIAQAILESDWGNSELAAKANNLFGVKGNYKGHHVTMETDEVEKGKRKTIRAKFRKYSTFFESMDDHAQLFVRGTSWNKKKYKPVLEAGNYKEAATALQTSGYATDPDYADKISAIVEKYDLDEYDEVNPSLKSVDLNASIKDSAVQDVWSKPSTDDRSIRLTSAQSYVGKDIKVVSKKQKGQSVWYQFQINDKLIGWIDDSAVEIKEAT

SEQ ID NO: 5050 - protein, 617 aa, Bacillus subtilis
  strain 168
MKGTFFHNQRFLCFSILFMWIKTYVIYKLGFDLQIDTLLEELMLLVNPLSFILPLFGIGLFLKENKQRAFLLIANLVLTVILISNTIFYGFYIDFITIPVLFQASNMSDMGSSVKELFHPLFIALFVDLVFLLLFARKTKHPQTKAAPHTIKRYYAASCGMLLCTLALAEVQQPKLLAHSFDREMLVKSIGLFQFHIYDTISQTVNISAKAFADEDSITAIKNYTEADYSKPDQSKFGLAKGRNVIFVTLESTQSFVLNEKVNGKEITPFMNDLIKKSYSFDHFYQQTEQGKTSDSEFIVANSLYPSLSGAVFFTKSDHQFHTMYKSLKQHDYYSAVFHANHKTFWNRDVMYDTFGIDRFFDVDDFHVTPGTSTSWGLKDKEFLEQSAKKLKSLPQPFYSSFITLTNHFPFEIDEKDQLIDEFDSSSDLLNRYVTTVRYEDEALKHFIKKLKDEGLYENSMIVFMGDHYGISEAHNEAMAEFLGKDEITPYDNVQLQRVPFIIHIPGITDQQPETIPDAGGQVDVRPTLMHLLGVETKGDIQFGNDLLSGDRTPFAVLRNGSFITNDYVYTKNTCYSQKTGEVLEDQDACLPYKEKANEELSLSDKILNGDLLRFSE

SEQ ID NO: 5051 - protein, 317 aa, Bacillus subtilis
  strain 168
MSIPVKKNLVSEAKYALKCPNAMSAEYITIHNTANDASAANEISYMIGNTSSTSFHFAVDDQEVIQGLPLNRNAWHTGDGTNGPGNRKSIGVEICYSKSGGPKYEAAEALAISFVAQLLKERGWGIDRVRKHQDWSGKYCPHRILSEGRWDQVKAAIEKELNGGVSAKKAAVSSSASEYHVKKGDTLSGIAASHGASVKTLQSINHITDPNHIKIGQVIKLPQTASASKSHAASSYPLPSGVIKVTSPLTQGTKVKQVQTALAALYFYPDKGAKNHGVDGVYGPKTANAVKRFQSVSGLTADGIYGPKTKAKMEEKL

SEQ ID NO: 5052 - protein, 354 aa, Bacillus subtilis
  strain 168
MFQKKTYAVFLILLLMMFTAACSGSKTSAEKKESETEKSSDIAQVKIKDVSYTLPSKYDKSTSDDQLVLKVNVAVKNTGKDPLNVDSMDFTLYQGDTKMSDTDPEDYSEKLQGSTINADKSVEGNLFFVVDKGKQYELNYTPESYGDKKPKSVTFKIDGKDKKILATADKLQDSAKALSAYVDVLLFGKDNADFEKITGANKNEIVNDFNESAKDGYLSASGLSSTYADSKALDNIVNGIKEGLSKNSSIQAKTTSISKDEAIVEATVKPVDASSLSDRIEDKVKDYYSKNSSASYEEAVKYALQVYPEEFKKLGPASSEKTVEVKMKKNDIDQWQLDMDDYRAAELVEAFIKE

SEQ ID NO: 5053 - protein, 226 aa, Bacillus subtilis
  strain 168
MTKTIKTVSFAAAAILVVIICTFLIIRQTHENVLSKETVVKKVEASYEGKVTKATQSKDKKTYDITLENPKGTYFVKADAISADILSMNRVKAVNPSAMTEKEAEHLALERVPGTVKKQTRQSQVATYTIQKEDGKTYEVKVDMQAKTVLSADQISSKDQQKTPITKKEAKTIAERKTGGTADDADLEESEGTLIFEVDVDLPDNKEATVKINAYTGKVANIVYED

SEQ ID NO: 5054 - protein, 472 aa, Bacillus subtilis
  strain 168
MKGAAFVKKEGLKQKALEIGRVPTHLKLEIEDYGGDDKRAHFCWADPQDENTGIIVELGPDGELESLSRDIEPESGERLSEEKLEDIMRQFVETHHPGALSAFVREENDRAYGDKVRFSYVQMEAGLPLPMSGFMADVSLSGEIVYFRYYGEAGSIIKPKRVADVEEALAFIKKDVEFDLLFEVLHRSVYKNGDDQPHLVYEPEGRAITVPADLVQEEQAVDDDDDYREPESFPLPLFEGIREKADPDSMIGIENGFVKEREADLGDGRIGIVWRNPDDPVYQPADKSMDSWFKGRTHQVLKTIYNKETGKLEGVMSFMEKKGPLTVTLAECEKIALRFLFALFPNADQYFRIRYDEKDEEENAVAGFTFEAHCHGVPLRFGQIRICVSRQTGYITVYMGPDIDPNKLATIDPVPAISVEQAKSIFWQHFKVELGWEREYGDDEEHSYRLVYKPVYPHFIDAHTGEPVFSIW

SEQ ID NO: 5055 - protein, 345 aa, Bacillus subtilis
  strain 168
MKRLCLWFTVFSLFLVLLPGKALGAVDFPNTSTNGLLGFAGNAKNEKGISKTGTTGGKNGQIVYIQSVNDLKTHLGGSTPKILVLQNDLSASAKTTVTIGSNKTLVGSYAKKTLKNIYLTTSSAFGNVIFQNLTFEHSPQINGNNDIQLYLDSGMNYWIDHVTFSGHSYNASGSDLDKLVYIGKSADYITISNSKFANHKYGLILGYPDDSQHQYDGYPHMTIANNYFENLYVRGPGLMRYGYFHVKNNYSNNFNQAITIATKAKIYSEYNYFGKGSEKGGILDDKGTGYFKDIGSYPSLNKQTSPLTSWNPGSNYSYRVQTPEYTKEFVTKYAGSQSTTLVFGY

SEQ ID NO: 5056 - protein, 649 aa, Bacillus subtilis
  strain 168
MKTFIKERGLAFFLIAVVLLWIKTYVGYVLNFNLGIDNTIQKILLFVNPLSSSLFFLGFGLLFKKKLQQTAIIVIHFLMSFLLYANIVYYRFFNDFITIPVIMQAKTNGGQLGDSAFSLMRPTDAFYFIDTIILIILAIKVNKPAETSSKKSFRIIFASSILVFLINLAVAESDRPELLTRSFDRNYLVKYLGTYNFTIYDAVQNIKSNSQRALADSSDVTEVENYMKANYDVPNNVYFGKAEGKNVIYVSLESLQSFIIDYKIDGKEVTPFLNKLAHDNETFYFDNFFHQTGQGKTSDAEFMMENSLYPLAQGSVFVNKAQNTLQSVPAILKSKNYTSATFHGNTQTFWNRNEMYKAEGIDKFFDSAYYDMNEENTKNYGMKDKPFFKESMPLLESLPQPFYTKFITLSNHFPFGMDEGDTDFPAGDFGDSVVDNYFQSAHYLDQSIEQFFNDLKKDGLYDKSIIVMYGDHYGISENHNKAMAKVLGKDEITDYDNAQLQRVPLFIHAAGVKGEKVHKYAGDVDVAPTILHLLGVDTKDYLMSGSDILSKEHREVIPFRNGDFISPKYTKISGKYYDTKTGKELDESEVDKSEDSLVKKELEMSDKIINGDLLRFYEPKGFKKVNPSDYDYTKHDEDSSETSKDNEDK

SEQ ID NO: 5057 - protein, 304 aa, Bacillus subtilis
  strain 168
MRINHNIAALNTLNRLSSNNSASQKNMEKLSSGLRINRAGDDAAGLAISEKMRGQIRGLEMASKNSQDGISLIQTAEGALTETHAILQRVRELVVQAGNTGTQDKATDLQSIQDEISALTDEIDGISNRTEFNGKKLLDGTYKVDTATPANQKNLVFQIGANATQQISVNIEDMGADALGIKEADGSIAALHSVNDLDVTKFADNAADTADIGFDAQLKVVDEAINQVSSQRAKLGAVQNRLEHTINNLSASGENLTAAESRIRDVDMAKEMSEFTKNNILSQASQAMLAQANQQPQNVLQLLR

SEQ ID NO: 5058 - protein, 473 aa, Bacillus subtilis
  strain 168
MNIKKFAKQATVLTFTTALLAGGATQAFAKETNQKPYKETYGISHITRHDMLQIPEQQKNEKYQVPEFDSSTIKNISSAKGLDVWDSWPLQNADGTVANYHGYHIVFALAGDPKNADDTSIYMFYQKVGETSIDSWKNAGRVFKDSDKFDANDSILKDQTQEWSGSATFTSDGKIRLFYTDFSGKHYGKQTLTTAQVNVSASDSSLNINGVEDYKSIFDGDGKTYQNVQQFIDEGNYSSGDNHTLRDPHYVEDKGHKYLVFEANTGTEDGYQGEESLFNKAYYGKSTSFFRQESQKLLQSDKKRTAELANGALGMIELNDDYTLKKVMKPLIASNTVTDEIERANVFKMNGKWYLFTDSRGSKMTIDGITSNDIYMLGYVSNSLTGPYKPLNKTGLVLKMDLDPNDVTFTYSHFAVPQAKGNNVVITSYMTNRGFYADKQSTFAPSFLLNIKGKKTSVVKDSILEQGQLTVNK

SEQ ID NO: 5059 - protein, 677 aa, Bacillus subtilis
  strain 168
MKKRLIQVMIMFTLLLTMAFSADAADSSYYDEDYRPQYHFTPEANWMNDPNGMVYYAGEYHLFYQYHPYGLQWGPMHWGHAVSKDLVTWEHLPVALYPDEKGTIFSGSAVVDKNNTSGFQTGKEKPLVAIYTQDREGHQVQSIAYSNDKGRTWTKYAGNPVIPNPGKKDFRDPKVFWYEKEKKWVMVLAAGDRILIYTSKNLKQWTYASEFGQDQGSHGGVWECPDLFELPVDGNPNQKKWVMQVSVGNGAVSGGSGMQYFVGDFDGTHFKNENPPNKVLWTDYGRDFYAAVSWSDIPSTDSRRLWLGWMSNWQYANDVPTSPWRSATSIPRELKLKAFTEGVRVVQTPVKELETIRGTSKKWKNLTISPASHNVLAGQSGDAYEINAEFKVSPGSAAEFGFKVRTGENQFTKVGYDRRNAKLFVDRSESGNDTFNPAFNTGKETAPLKPVNGKVKLRIFVDRSSVEVFGNDGKQVITDIILPDRSSKGLELYAANGGVKVKSLTIHPLKKVWGTTPFMSNMTGWTTVNGTWADTIEGKQGRSDGDSFILSSASGSDFTYESDITIKDGNGRGAGALMFRSDKDAKNGYLANVDAKHDLVKFFKFENGAASVIAEYKTPIDVNKKYHLKTEAEGDRFKIYLDDRLVIDAHDSVFSEGQFGLNVWDATAVFQNVTKES

SEQ ID NO: 5060 - protein, 87 aa, Bacillus subtilis
  strain 168
MEPIFIIGIILGLVILLFLSGSAAKPLKWIGITAVKFVAGALLLVCVNMFGGSLGIHVPINLVTTAISGILGIPGIAALVVIKQFII

SEQ ID NO: 5061 - protein, 272 aa, Bacillus subtilis
  strain 168
MAIKVVKNLVSKSKYGLKCPNPMKAEYITIHNTANDASAANEISYMKNNSSSTSFHFAVDDKQVIQGIPTNRNAWHTGDGTNGTGNRKSIGVEICYSKSGGVRYKAAEKLAIKFVAQLLKERGWGIDRVRKHQDWNGKYCPHRILSEGRWIQVKTAIEAELKKLGGKTNSSKASVAKKKTTNTSSKKTSYALPSGIFKVKSPMMRGEKVTQIQKALAALYFYPDKGAKNNGIDGVYGPKTADAIRRFQSMYGLTQDGIYGPKTKAKLEALLK

SEQ ID NO: 5062 - protein, 124 aa, Bacillus subtilis
  strain 168
MYRTRGFIYPAVLFVSALVLLIVNFVAAQYISRCMFEKETKELYIGENLLQNGVLLSIRHVLEERKGQEGTQQFLYGRVSYYIHDTSIKEQKEINLRVSTDSGTERTAQIVFDQKQKKLLRWTE

SEQ ID NO: 5063 - protein, 264 aa, Bacillus subtilis
  strain 168
MSHRADEIRKRLEKRRKQLSGSKRFSTQTVSEKQKPPSWVMVTDQEKHGTLPVYEDNMPTFNGKHPLVKTDSIILKCLLSACLVLVSAIAYKTNIGPVSQIKPAVAKTFETEFQFASASHWFETKFGNPLAFLAPEHKNKEQQIEVGKDLIAPASGKVQQDFQDNGEGIKVETSSDKIDSVKEGYVVEVSKDSQTGLTVKVQHADNTYSIYGELKDVDVALYDFVDKGKKLGSIKLDDHNKGVYYFAMKDGDKFIDPIQVISFE

SEQ ID NO: 5064 - protein, 288 aa, Bacillus subtilis
  strain 168
MNKWLDLILKIHVHPFLWIIAALGLLTGHMKALLCLLLIVLIHELGHAALAVFFSWRIKRVFLLPFGGTVEVEEHGNRPLKEEFAVIIAGPLQHIWLQFAAWMLAEVSVIHQHTFELFTFYNLSILFVNLLPIWPLDGGKLLFLLFSKQLPFQKAHRLNLKTSLCFCLLLGCWVLFVIPLQISAWVLFVFLAVSLFEEYRQRHYIHVRFLLERYYGKNRELEKLLPLTVKAEDKVYHVMAEFKRGCKHPIIIEKSGQKLSQLDENEVLHAYFADKRTNSSMEELLLPY

SEQ ID NO: 5065 - protein, 256 aa, Bacillus subtilis
  strain 168
MQTETIHNIPYVNSNLTSFIDYLEKHYIDQKIGAVISTVNPEIAFAAIKDRDYFDVLSSSNFILPDGIGVVMMSRLTNNRLQSRIAGYDVFKELLGVANKKKKRIFLYGAKKDVIKGVVSKISSEYPNIKIAGYSDGYVQDRTLVAKQIARANPDMVFVALGYPHQEKFIHNYRHLFPKAVSIGLGGSFDVFSGNVKRAPSWMIRLNLEWFYRLILNPWRWKRMLSIPKYALTVLKEEKNKKTFYPKPEKDHTKQI

SEQ ID NO: 5066 - protein, 382 aa, Bacillus subtilis
  strain 168
MRIFKKAVFVIMISFLIATVNVNTAHAAIDVSAKSAIIIDGASGRVLYAKDEHQKRRIASITKIMTAVLAIESGKMDQTVTVSANAVRTEGSAIYLTEGQKVKLKDLVYGLMLRSGNDAAVAIAEHVGGSLDGFVYMMNQKAEQLGMKNTRFQNPHGLDDHENHYSTAYDMAILTKYAMKLKDYQKISGTKIYKAETMESVWKNKNKLLTMLYPYSTGGKTGYTKLAKRTLVSTASKDGIDLIAVTINDPNDWDDHMKMFNYVFEHYQTYLIAKKGDIPKLKGTFYESKAFIKRDITYLLTEEEKENVKINTTLLKPKKAWEKDASKIPDIVGHMEIMFNDATIAKVPIYYENERHQKPKKQFFETFKSIFLNAAGGAKWSI

SEQ ID NO: 5067 - protein, 87 aa, Bacillus subtilis
  strain 168
MMDMFFAYLLVASATPLFIWLDNKKVALSAIPPIILMWVFFFFYATESLSPLGHTLMIILFAVNVIVAHIAAFIIYGLPYLRRKRSS

SEQ ID NO: 5068 - protein, 498 aa, Bacillus subtilis
  strain 168
MVTRITGLASGMDIDDIVSKLMQTERAPLDKLTQKKQTLEWQRDSYREVNSKIKELQDYMSKNTLTYPSTYQSKTVTSSNESVLTATGSVSAPNSSSTVEVASLATAATYKANNYTGYTQGDYNLAFNVVAPGETTAKTVNISVTSADTIDNVISKLNSSDLGVSAFKDKIWNGTEYVETIAFSSKATGAGGSIQAADSATADFMSGQLGFSLDADNKLTAYKEGTNAKVTINGFEMEKLTNNFTVNGVTYSIKNTTAATGPVTTSVSTDVDGIYNQIKEFVDKYNELVDSLNEKLKEEKYRDYTPLTSEQKEAMSDKEVELWEEKAKSGLLRNDSSISTGTNQMRTDFYTQVNADGKTYQLTEFGITTSSAYQLRGHLEINEEKLKAKIAEDPQGVANLFTSGTNDSNYSDKGIMKRITNTLRSTVKSIEAKAGNSTMGASSYSIGKNLNSISTEITDMQDRLNTIENRYYSKFSAMDSAIQKMNEQASYLSQLLVQ

SEQ ID NO: 5069 - protein, 297 aa, Bacillus subtilis
  strain 168
MVNIIQDFIPVGANNRPGYAMTPLYITVHNTANTAVGADAAAHARYLKNPDTTTSWHFTVDDTEIYQHLPLNENGWHAGDGNGSGNRASIGIEICENADGDFAKATANAQWLIKTLMAEHNISLANVVPHKYWSGKECPRKLLDTWDSFKAGIGGGGSQTYVVKQGDTLTSIARAFGVTVAQLQEWNNIEDPNLIRVGQVLIVSAPSAAEKPELYPLPDGIIQLTTPYTSGEHVFQVQRALAALYFYPDKGAVNNGIDGVYGPKTADAVARFQSVNGLTADGIYGPATKEKIAAQLS

SEQ ID NO: 5070 - protein, 880 aa, Bacillus subtilis
  strain 168
MKKRLIAPMLLSAASLAFFAMSGSAQAAAYTDYSLYKVEPSNTFSTESQASQAVAKLEKDTGWDASYQASGTTTTYQISASGIHSESEAKAILSGLAKQTSITGTSSPVGSKQPYVTISSGAISGEKQANTILAKLKQETGVAGAVKAYGAAQPYMNVMTSDIADETKVKALIQSLAKQTGIKSSYQPITHTVSVTTIQSGTIVGDSRAAQIKNAFQKESGLQASLKETVKGQAYYTFTTAAISGEANAKTLLQQLKQSTGITGSYKSINQKTTVESYNVQSAYFKGLSTVKDAISQIKKNTGVSGSYQQVGKSTSYTVNMKGITKQQLQKIDTFFKKKKWHYTSSSVKKTTTSAAYQITTAKILGEQQANKAAAFFAQKKVKAAKTAAGSTAENQYQLISEETSDQAKVTKGLNILKKNQLSASAKSVKKQIADTFKITTESLLDQTKVNQALTFFKSNHISVASQKTGQTAASSYQITTEAIISQEEIDRVLTFFKQNHIAVTTSKTGQTAYTQYKIVTTQLSSKTALNNGLTYLKSKSVTPSYTTKSNTLYKISVNEQFTGNDTAAAASTKLKQLYGWTSSIVKIKNGPQIMKTNYNLSLRDMVQKQMTVSPQTDGAAYVSLTYINTATSTVTADVLNIRSTPEVSPTNVIGQFKKGDKVKVIGQINGWAKINLGWRNASSDEVVQYVDPNNFSRDSKYYFQFLKLSQTAGLSVTEVNQKVLAGKGILTGRAKAFIDAANQYSINELYLISHALLETGNGTSALANGLTYNGKTVYNMYGIGAYDSNPNYYGAKYAYEQGWFTPEAAIIGGAKFIGSSYIHNTAYNQDTLYKMRWSATATHQYATDIGWAYKQVNRMYSLYSLLDGYTLYFDVPEYR

SEQ ID NO: 5071 - protein, 473 aa, Bacillus subtilis
  strain 168
MRKSLITLGLASVIGTSSFLIPFTSKTASAETLDEKKQKIESKQSEVASSIEAKEKELTELQENQSKIEKELKDINDKALDTSNKIEDKKEENDKTKEEIKKLKKEIKETEARIEKRNEILKKRVRSLQESGGSQGYIDVLLGSTSFGDFISRATAVSSIVDADKDLIKQQEQDKAKLEDSEADLNDKLKEVQAALAKLETMQKDLDKQLNEKDKLFDEAKASQKKTAKAISELKSEASELANQKANTEAEQARIKKEQEAAAALIKKQEEAQKASDETQTDDSQTATTESSKASSSDDSSDNSSDNSSNGSSNSSSNGSSSKKSSGSNSNSGGTVISNSGGIEGAISVGSSIVGQSPYKFGGGRTQSDINNRIFDCSSFVRWAYASAGVNLGPVGGTTTDTLVGRGQAVSASEMKRGDLVFFDTYKTNGHVGIYLGNGTFLNDNTSHGVSVDSMSNPYWKAAFKGVVRRVVQ

SEQ ID NO: 5072 - protein, 410 aa, Bacillus subtilis
  strain 168
MVKSFRMKALIAGAAVAAAVSAGAVSDVPAAKVLQPTAAYAAETVFSQNNGASGFLPGRYDVQAMAPAMFNWSRESRFAGNTDGTLKWQNDIRTTPQNGAGAVIDGDGTVYLHSRDGEMKAFNPDGSVKWVTGNLGKTYTQSPVLGTNGVIYLASYDKKIYFIDKETGEILTTVPLSGGPSSETVIGSDGTLYFSTLDNYVHAIKPTSKSTWTERWKLKTNGVVSSVPVLAKNGTVYVGTYNYVFYAINSGTGQVKWSRTTSNAFKGYPVIDKDGNIYAGNQDGQLYAYTSTGSLKWTFPLNGFSSSSPAIDHNGNIYIGSGSGELFSISKNGDMNWSFYTDGPVRTAPLIDAKGTVYFGSDDMKVYAADANGNELWSYQTDSNVVSSPQLAEDGTLYIGSYTKLMAFGK

SEQ ID NO: 5073 - protein, 311 aa, Bacillus subtilis
  strain 168
MRNQEIIRKAEMSLSALKSGGLMNPAQASAFIRMVQNTPTIFSESRVIQMENDSQKFEKIGFGQRILRAAQEGKALSNDELTVPTTSTVQLNTKEVIAEINITYDTLENNIEKDGLQQTIMQILAERAAVDIEELIVNGDTASADPYLAQLDGIRKQAVSHIVDMNGEELSRATFKKGLKAVPPKYLRIPQEFRFYTSHGLEVEWKDRVADRQTNLGDQAVQGGLSTAFGVPVKGVSNIQPYTVGEGDAQYDASDIILTHPKNIILGFSRNIRIEVDKDIRSRKFIIVLTAKLDSKFEEEDACAKLINVKE

SEQ ID NO: 5074 - protein, 161 aa, Bacillus subtilis
  strain 168
MRKKALIFTVIFGIIFLAVLLVSASIYKSAMAQKEEGHEAAAAEAKKETDLAHVDQVETFVGKEKYYVVKGTDKKGTALYVWVPADKKAKILSKEAKEGISEDKAAKIIKDEGLVSKQKEVHLAREGNVLLWEVTYLDKEGQYSLSYVDFTTGKILKNITP

SEQ ID NO: 5075 - protein, 587 aa, Bacillus subtilis
  strain 168
MKRTWNVCLTALLSVLLVAGSVPFHAEAKKPPKSYDEYKQVDVGKDGMVATAHPLASEIGADVLKKGGNAIDAAVAIQFALNVTEPMMSGIGGGGFMMVYDGKTKDTTIIDSRERAPAGATPDMFLDENGKAIPFSERVTKGTAVGVPGTLKGLEEALDKWGTRSMKQLITPSIKLAEKGFPIDSVLAEAISDYQEKLSRTAAKDVFLPNGEPLKEGDTLIQKDLAKTFKLIRSKGTDAFYKGKFAKTLSDTVQDFGGSMTEKDLENYDITIDEPIWGDYQGYQIATTPPPSSGGIFLLQMLKILDHFNLSQYDVRSWEKYQLLAETMHLSYADRASYAGDPEFVNVPLKGLLHPDYIKERQQLINLDQVNKKPKAGDPWKYQEGSANYKQVEQPKDKVEGQTTHFTVADRWGNVVSYTTTIEQLFGTGIMVPDYGVILNNELTDFDAIPGGANEVQPNKRPLSSMTPTILFKDDKPVLTVGSPGGATIISSVLQTILYHIEYGMELKAAVEEPRIYTNSMSSYRYEDGVPKDVLSKLNGMGHKFGTSPVDIGNVQSISIDHENGTFKGVADSSRNGAAIGINLKRK

SEQ ID NO: 5076 - protein, 99 aa, Bacillus subtilis
  strain 168
MKRLTLVCSIVFILFILFYDLKIGTIPIQDLPVYEASAKTAVQEPAYKTVKVKPGDTVMSIVGSAGSPDDIVKDFEALNPNVKANAIQAGTAYKFPVYP

SEQ ID NO: 5077 - protein, 638 aa, Bacillus subtilis
  strain 168
MRKTFFSKISFMLIAILLMWLKTYAVYKTSFHIKIDNLTQEFILFINPLSFLLLIFGLSLFLKGKNRNRYIIAMSCLVTFVLLANMVFYRFYNDFLTIPVLFQTSNMGDLGSSIGTLLEPTDLLLAVDIAVLIWLHIRQKAFQSDIPSTKNERAAYFLFVASVYFFNLGLSEAERPQLLTRSFDREMLVKNISLFNFHIYDGVLQSKQSAQRALADSNSLTEIENYVTANAKDANKRLFGAAKGRNVILVSLESTQSFVINEKLNGEEITPFLNDFIKQSYNFNNVYHQTGQGKTSDSEFIVDNSLYPLGRGAVFFTNAGNQYMAAPEILKNSGYYSAVLHANNKSFWNRDLMYDSFGYDSFFDINSYDVTDENSVGWGLKDKEFFEQSSELMKNLPQPFYSRLITLTNHFPFDLDEEDQLIDEYDSNSQTLNKYFPTVRYQDEALKRFIEKLKEDGLYDNSVIVLYGDHYGISENHNEAMGQFLGKEITPFEEVQLQKVPLVIHIPGITDKKPQTIETVGGQIDIRPTLMNLLGIDTKDQIQFGNDLLSDEKLDFTVLRDGSFITDQVVYTDGACYDKETGKPLEETKQCEAFADKAKQELSLSDEIIYGDLLRFYDQKRLDNSSKRKEKQMLDQAS

SEQ ID NO: 5078 - protein, 261 aa, Bacillus subtilis
  strain 168
MGMKKKLSLGVASAALGLALVGGGTWAAFNDIKSKDATFASGTLDLSAKENSASVNLSNLKPGDKLTKDFQFENNGSLAIKEVLMALNYGDFKANGGSNTSPEDFLSQFEVTLLTVGKEGGNGYPKNIILDDANLKDLYLMSAKNDAAAAEKIKKQIDPKFLNASGKVNVATIDGKTAPEYDGVPKTPTDFDQVQMEIQFKDDKTKDEKGLMVQNKYQGNSIKLQFSFEATQWNGLTIKKDHTDKDGYVKENEKAHSEDKN

SEQ ID NO: 5079 - protein, 137 aa, Bacillus subtilis
  strain 168
MKKWIVLFLVLIAAAISIFVYVSTGSEKPFYNDINLTQYQKEVDSKKPKFIYVYETSCPPCQEIKPELNEVIKKEKLKVQALNIEEKENYNTEFLDKYNLNKTPTILYYKDGKEKDRLEGYRSASQIEKFFDKNGDR

SEQ ID NO: 5080 - protein, 56 aa, Bacillus subtilis
  strain 168
MEKLFKEVKLEELENQKGSGLGKAQCAALWLQCASGGTIGCGGGAVACQNYRQFCR

SEQ ID NO: 5081 - protein, 323 aa, Bacillus subtilis
  strain 168
MKKKKTWKRFLHFSSAALAAGLIFTSAAPAEAAFWGASNELLHDPTMIKEGSSWYALGTGLTEERGLRVLKSSDAKNWTVQKSIFTTPLSWWSNYVPNYGQNQWAPDIQYYNGKYWLYYSVSSFGSNTSAIGLASSTSISSGGWKDEGLVIRSTSSNNYNAIDPELTFDKDGNPWLAFGSFWSGIKLTKLDKSTMKPTGSLYSIAARPNNGGALEAPTLTYQNGYYYLMVSFDKCCDGVNSTYKIAYGRSKSITGPYLDKSGKSMLEGGGTILDSGNDQWKGPGGQDIVNGNILVRHAYDANDNGIPKLLINDLNWSSGWPSY

SEQ ID NO: 5082 - protein, 468 aa, Bacillus subtilis
  strain 168
MRKWYFILLAGVLTSVILAFVYDKTKANEEGSGDYLYVSPNGSDQNEGTKEKPFRTLAHASEKAAAGTTVMIREGTYHETLDVKHSGTDGKPITFRNYENENVVISGESVANAEYETPLIRIHDKHDIAISGLTIQDLSVSSEEATAIGIYVSGSSSHIAIKDNHIRGIKTTADEGNAHGIAVYGTGSMKDIRIEDNTVEKLTLGASEAVVLNGNIDGFTVAGNVVRNNNNIGIDLIGYEGTADKNDYVRNGVVENNTVYQNSTYGNPAYGDEYSAGGIYVDGGHDIEIKNNTVYDNDIGIEATSEHKGKYANAIQITDNKVYNNAYTGISIGGYDKKRGGTSNSLIARNIMYRNDTKGLYGGQLLLQYDTKNNTIEKNILTAGDSRLFIGNDFTENEGNTVNHNVYHKEADQDGIWMWKKKEYDSFSSYRKATKNDQQSIYADPMFRDEASYDFSLDPDSPARPVIE

SEQ ID NO: 5083 - protein, 178 aa, Bacillus subtilis
  strain 168
MNKPTKLFSTLALAAGMTAAAAGGAGTIHAQQPETTVSIDDLYSYPIDSYLVSAEALNVRTKPSASSQKADTLHLGDSLKLISFSNADWAKVKYKNGKTGFVSTHYIVKAATTVKTKTKTKVYTSADGKSIKTLPADTSVSFLGWSKTNKGGFDFDWVFVDYGGTTGYMKTKDLHMTK

SEQ ID NO: 5084 - protein, 413 aa, Bacillus subtilis
  strain 168
MNTLANWKKFLLVAVIICFLVPIMTKAEIAEADTSSELIVSEAKNLLGYQYKYGGETPKEGFDPSGLIQYVFSKADIHLPRSVNDQYKIGTAVKPENLKPGDILFFKKEGSTGTVPTHDALYIGDGQMVHSTQSKGVIITNYKKSSYWSGTYIGARRIAADPATADVPVVQEAEKYIGVPYVFGGSTPSEGFDCSGLVQYVFQQALGIYLPRSAEQQWAVGEKVAPQNIKPGDVVYFSNTYKTGISHAGIYAGAGRFIQASRSEKVTISYLSEDYWKSKMTGIRRFDNLTIPKENPIVSEATLYVGEVPYKQGGVTPETGFDTAGFVQYVYQKAAGISLPRYATSQYNAGTKIEKADLKPGDIVFFQSTSLNPSIYIGNGQVVHVTLSNGVTITNMNTSTYWKDKYAGSIRVQ

SEQ ID NO: 5085 - protein, 705 aa, Bacillus subtilis
  strain 168
MKSCKQLIVCSLAAILLLIPSVSFAADSNISVKLLNYIGNKSSISLSPTGFYKVTGDNVAVTDRFAGASRYETATLASNSQWKNPNTVILVNRDIFIDALPVIPLAKKLNAPVLFTQPDTLTKTTERQIAKFNPDNILIIGGARSISKDVENKLKSYGAVKRISGKNRYVLSENIAKQMGSYDKAIVVTGRVFQDALAIAPYAAAHGYPILLTEKDKLPDYDLPKQVIIIGSSFSVSDSVENQIKKTSTVQRIPGSTRYELTANIIKQLKLKADKVVMTNGTKYADVLIGASLASKKNSQILFVKQDSVPAAAKSITKDKATYAYDFIGSTSSISAEVENSLADEFYLADGGTYNLKINSGKLNLENIKTYGNSLRIKPENYSTSNRISLDGKQYLGTVNFSIESTKYIRPVNENIPFEDYLKGVIPNEMPASWSLEALKAQTVAARTYSITKTGTTVPDTTAFQVYGGYSWNSNTNKAVEQTKGKVLKYNGSLITAAYSSSNGGYTEASNEVWSSSVPYLIAKKDTKDPQIGWTLTLSKQQLDTKSLDLTKPSSWWSSATETDSARLSGVKNWILKNKETSADSVKIASIDDLSFSGTTQGQRAKTASMKVKYFVKSSTGSYNLSKITTISVPTSELRTMIGATVFKSTYVTVKKDTSKYTISGKGYGHGIGMSQYGAKARAEAGDSYSSILKFYYPGTTLTSY

SEQ ID NO: 5086 - protein, 496 aa, Bacillus subtilis
  strain 168
MRSYIKVLTMCFLGLILFVPTALADNSVKRVGGSNRYGTAVQISKQMYSTASTAVIVGGSSYADAISAAPLAYQKNAPLLYTNSDKLSYETKTRLKEMQTKNVIIVGGTPAVSSNTANQIKSLGISIKRIAGSNRYDTAARVAKAMGATSKAVILNGFLYADAPAVIPYAAKNGYPILFTNKTSINSATTSVIKDKGISSTVVVGGTGSISNTVYNKLPSPTRISGSNRYELAANIVQKLNLSTSTVYVSNGFSYPDSIAGATLAAKKKQSLILTNGENLSTGARKIIGSKNMSNFMIIGNTPAVSTKVANQLKNPVVGETIFIDPGHGDQDSGAIGNGLLEKEVNLDIAKRVNTKLNASGALPVLSRSNDTFYSLQERVNKAASAQADLFLSIHANANDSSSPNGSETYYDTTYQAANSKRLAEQIQPKLAANLGTRDRGVKTAAFYVIKYSKMPSVLVETAFITNASDASKLKQAVYKDKAAQAIHDGTVSYYR

SEQ ID NO: 5087 - protein, 2334 aa, Bacillus subtilis
  strain 168
MKKRKRRNFKRFIAAFLVLALMISLVPADVLAKSTEEENGNRIAADDPEETLQKEQTEEAVPFDPKDINKEGEITSERTENTKLYYEGDGVYKQEVYLDPIHTKETPDADWEDISPELKESTSKQVETENAILNSDFQKQMKNGLYATFEHNDHKVTYSLAEAKGPNKTSLTPKDTSADYKTDSNEIVYPDVFPNIDLQTFTFNENIKEDLVLHQYNGYNTFTFQLKTDLQAKEQEDGSIDFSDEKGKVVFSVPKPFMTDSKLDELSGEVERSDKVSYKLEKNEEGYLLHLTADENWLKDPERVYPVSIDPSTSLSVSSDTFVMSAYPTTNYSASSQKWDANLKAYVLKTGYYDKTTGTNYAFMKFNNLKPIQNMTVTKATLKTYVAHSYYGTKATGLWLDTVNSNYDNAKVTWNTKPASKNIGKADVHKGQWASYDVTAAVKSWNSGGANYGFKLHTNGNGKEYWKKLISSANSANKPYIEVTYTIPKGNTPTIKAYHNGDSTGYFDISWKKVEGAKGYKVWIYNGKEYQAISAGNVTSWSTKGKKIWPTSAEIASKRYKLHLDGKDGAELALDPSPVYKNSGGSYATSKNYWIGVSAIFDQGEGAMSAPAKPVIPNVGKAQAPSAKGYNNGNATGYFDLSWKAVSGATGYKVQVFNGKGFETLDLGNQTSWTTKGKKIWPTSAEIKAGKYALHLKDGSGAELPINPGPTYKNAGGDGAKRNYSFKIIAYNKDGEAIASPAATPALPDIARPKNVTGYLYTNTKSSQTGYVNLIWEKVQNAKGYKVNIYNGKEYQSFDVGDADHWTTQNKNIWPTSEEIKAGSYKLHTDGKGGELALDPSPVYNNANGNYKGKKNYSFTLVAYDANGETIPTAPFNPTFHEGAEFLGTEEYWSIIDIPSGQLNGATGNVIVNEEDLSIDGRGPGLGLSRTYNSLDSSDHLFGQGWYADAETSVISTDGGAMYIDEDATTHRFTKKADGTYQPPTGVYLELTETADQFILKTKDQTNAYFNKKGGKLQKVVDGHNNATVYTYNDKNQLTAITDASGRKLTFTYDENGHVTSITGPKNKKVTYSYENDLLKKVTDTDGTVTSYDYDSEGRLVKQYSANSTEAKPVFTEYQYSGHRLEKAINAKKETYVYSYDADKKTLLMTQPNGRKVQYGYNEAGNPIQVIDDAEGLKITTNTKYEGNNVVEDVDPNDVGTGKATESYQYDKDGNVTSVKDAYGTETYEYNKNNDVTKMKDTEGNVTDIAYDGLDAVSETDQSGKSSSAAVYDKYGNQIQSSKDLSASTNILKDGSFEAQKSGWNLTASKDSGKISVIADKSGVLSGSKALEVLSQSTSAGTDHGYSSATQTVELEPNTTYTLSGKIKTDLAKSRAYFNIDLRDKDQKRIQWIHNEYSALAGKNDWTKRQITFTTPANAGKAVVYMEVDHKDKDGKGKAWFDEVQLEKGEVSSSYNPVQNSSFTSATENWNVSGASVDSEEGFNDDVSLKAARTSASQAGSVTKQTVVLGQSANDKPVYLTLTGMSKASSVKFTDEKDYSLQANVTYADGSTGIYNAKFPSGTQEWNRAAVVIPKTKPINKVDISILFQKSATGTVWFDDIRLIEGSLLTKSTYDSNGNYVTKEEDELGYATSTDYDETGKKTSETDAKGEKTTYTYDQADQLTNMTLSNGTSILHSYDKEGNEVSKTIRAGADQTYKFEYDVMGKLVKTTDPLGNVLASEYDANSNLTKTISPNGNEVSLSYDGTDRVKSKSYNGTEKYIFTYDKNGNETSVVNKEQNTTKKRTFDNKNRLTELTDRGGSQTWTYPSDSDKLKTFSWIHGDQKGTNQFTYNKLDQMIEMKDSTSSYSFDYDENGNVQTFITGNGGGTSFSYDERNLVSSLHIGDKNGGDILTESYEYDANGNRTTINSSASGKVQYEYGKLNQLVKETHEDGTVIEYTYDGFGNRKTVTTIKDGSSKTVNASFNIMNQLTKVNDESISYDKNGNRTSDGKFTYTWDAEDNLTAVTKKGEDKPFATYKYDEKGNRIQKTVNGKVTNYFYDGDSLNVLYETDADNNVTKSYTYGDSGQLLSYTENGKKYFYHYNAHGDIIAISDSTGKTVAKYQYDAWGNPTKTEASDEVKDNRYRYAGYQYDEETGLYYLMARYYEPRNGVFLSLDPDPGSDGDSLDQNGYAYGNNNPVMNVDPDGHWVWLVVNAGFAAYDGYKAYKSGKGWKGAAWAAASNFGPGKIFKGASRAYKFTKKAVKITGHTRHGLNQSIGRNGGRGVNLRAKLNAVRSPKKVIKQPNGATKYVGKKATVVLNKRGKVITAYGSSRAKGSKHVFHTHGKGNKSKRRR

SEQ ID NO: 5088 - protein, 422 aa, Bacillus subtilis
  strain 168
MIPRIKKTICVLLVCFTMLSVMLGPGATEVLAASDVTVNVSAEKQVIRGFGGMNHPAWAGDLTAAQRETAFGNGQNQLGFSILRIHVDENRNNWYKEVETAKSAVKHGAIVFASPWNPPSDMVETFNRNGDTSAKRLKYNKYAAYAQHLNDFVTFMKNNGVNLYAISVQNEPDYAHEWTWWTPQEILRFMRENAGSINARVIAPESFQYLKNLSDPILNDPQALANMDILGTHLYGTQVSQFPYPLFKQKGAGKDLWMTEVYYPNSDTNSADRWPEALDVSQHIHNAMVEGDFQAYVWWYIRRSYGPMKEDGTISKRGYNMAHFSKFVRPGYVRIDATKNPNANVYVSAYKGDNKVVIVAINKSNTGVNQNFVLQNGSASNVSRWITSSSSNLQPGTNLTVSGNHFWAHLPAQSVTTFVVNR

SEQ ID NO: 5089 - protein, 513 aa, Bacillus subtilis
  strain 168
MRKKCSVCLWILVLLLSCLSGKSAYAATSTTIAKHIGNSNPLIDHHLGADPVALTYNGRVYIYMSSDDYEYNSNGTIKDNSFANLNRVFVISSADMVNWTDHGAIPVAGANGANGGRGIAKWAGASWAPSIAVKKINGKDKFFLYFANSGGGIGVLTADSPIGPWTDPIGKPLVTPSTPGMSGVVWLFDPAVFVDDDGTGYLYAGGGVPGVSNPTQGQWANPKTARVIKLGPDMTSVVGSASTIDAPFMFEDSGLHKYNGTYYYSYCINFGGTHPADKPPGEIGYMTSSSPMGPFTYRGHFLKNPGAFFGGGGNNHHAVFNFKNEWYVVYHAQTVSSALFGAGKGYRSPHINKLVHNADGSIQEVAANYAGVTQISNLNPYNRVEAETFAWNGRILTEKSTAPGGPVNNQHVTSIQNGDWIAVGNADFGAGGARSFKANVASTLGGKIEVRLDSADGKLVGTLNVPSTGGAQTWREIETAVSGATGVHKVFFVFTGTGTGNLFNFDYWQFTQR

SEQ ID NO: 5090 - protein, 639 aa, Bacillus subtilis
  strain 168
MKKLFSYKLSFFVLAVILFWAKTYLSYKTEFNLGVKGTTQEILLIFNPFSSAVFFLGLALLAKGRKSAIIMLIIDFLMTFVLYANILFYRFFDDFLTFPNIKQSGNVGNMGDGIFSIMAGHDIFYFLDIIILIAVLIWRPELKEYKMKKRFASLVILSGIALFFINLHYAEKDRPQLLTRTFDRNYIVKYLGLYNYTIYDGVQTAQTETQRAYASSDDLTSVENYTTSHYAKPNAEYFGSAKGKNIIKIHLESFQSFLIDYKLNGEEVTPFLNKLAHGGEDVTYFDNFFHQTGQGKTSDAELTMDNSIFGLPEGSAFVTKGENTYQSLPAILDQKEGYTSAVLHGDYKSFWNRDQIYKHIGYDKFFDASTYDMSDENVINMGLKDKPFFTESIPKLESLKQPFYAHLITLTNHYPFNLDEKDASLKKATTGDNTVDSYFQTARYLDEALEQFFKELKEAGLYDNSVIMIYGDHNGISENHNRAMKEILGKEITDYQNAQNQRVPLMIRVPGKKGGVNHTYGGEIDVMPTLLHLEGIDSQKYINFGTDLFSKDHDDTVAFRNGDFVTPKYTSVDNIIYDTKTGEKLKANEETKNLKTRVNQQLSLSDSVLYKDLLRFHKLNDFKAVDPSDYHYGKEKEIK

SEQ ID NO: 5091 - protein, 210 aa, Bacillus subtilis
  strain 168
MKKVLMAFIICLSLILSVLAAPPSGAKAESVHNPVVLVHGISGASYNFFAIKNYLISQGWQSNKLYAIDFYDKTGNNLNNGPQLASYVDRVLKETGAKKVDIVAHSMGGANTLYYIKYLGGGNKIQNVVTLGGANGLVSSTALPGTDPNQKILYTSIYSLNDQIVINSLSRLQGARNIQLYGIGHIGLLSNSQVNGYIKEGLNGGGLNTN

SEQ ID NO: 5092 - protein, 430 aa, Bacillus subtilis
  strain BSn5
MPYIVDVYAREVLDSRGNPTVEVEVYTETGAFGRALVPSGASTGEYEAVELRDGDKDRYLGKGVLTAVNNVNEIIAPELLGFDVTEQNAIDQLLIELDGTENKGKLGANAILGVSMACARAAADFLQIPLYQYLGGFNSKTLPVPMMNIVNGGEHADNNVDIQEFMIMPVGAPNFREALRMGAQIFHSLKSVLSAKGLNTAVGDEGGFAPNLGSNEEALQTIVEAIEKAGFKPGEEVKLAMDAASSEFYNKEDGKYHLSGEGVVKTSAEMVDWYEELVSKYPIISIEDGLDENDWEGHKLLTERLGKKVQLVGDDLFVTNTKKLSEGIKNGVGNSILIKVNQIGTLTETFDAIEMAKRAGYTAVISHRSGETEDSTIADIAVATNAGQIKTGAPSRTDRVAKYNQLLRIEDQLAETAQYHGINSFYNLNK

SEQ ID NO: 5093 - protein, 161 aa, Bacillus subtilis; identical to SEQ ID NO: 5074
  strain BSn5

SEQ ID NO: 5094 - protein, 236 aa, Bacillus subtilis
  strain BSn5
MRRILSIFVFAIMLAGCSSNASTEKQHAGGEKTVKAEPQSTSSQKDSTDDYQPNSQVTDDRSLLKVGQTFSDDKGKAVLKDIKQVNKTYKIGDVELTVKEMKLIHLRPDYSMIDYFHELTHDEEFDFVKVFVDIKNTSSKKVNVAPIALMKTNTGETFEWNKDIYLEELNGELEGGAEKSGNLGFIVNASSRHAHDKAEDAEKKTKEIKWIEITTSDVFDHNHKKISDAQKIKIKF

SEQ ID NO: 5095 - protein, 221 aa, Bacillus subtilis
  strain BSn5
MKKFVSILFMFGLVMGFSQFQSSTAFAADKVVHETIIVPKNTTYDGKGQRFVAGKELGDGSQSENQDPVFRVEDGATLKNVVLGAPAADGVHTYGNVNIQNVKWEDVGEDALTVKKEGKVTIDGGSAQKASDKIFQINKASTFTVKNFTADNGGKFIRQLGGSTFHVDVIIDKCTITNMKEAIFRTDSKTSTVRMTNTRYSNVGQKWIGVQHIYENNNTQF

SEQ ID NO: 5096 - protein, 240 aa, Bacillus subtilis
  strain BSn5
MCAQLNACGGSSRGPTGPTGATGATGPTGATGITGATGPAGVTGATGITGPTGATGPTGATGATGATGATGATGITGATGITGATGPTGVTGATGITGPTGTGGSVTGNSMYASNTVGSTIAVVLGGSPVPLPNNQSLDGFTVNGGNNMFTVPVAGRYYLSYQINTTLSLLAGSRLMRNGDPIPGSIISPAVSTSSYNDDVFATLDAGDRISLQLFGVVATVILLGGGSTGAALTIIRLN

SEQ ID NO: 5097 - protein, 271 aa, Bacillus subtilis
  strain BSn5
MKISMQKAAISLLVFTMFFTLMMSETVFAAGLNKDQKRRAEQLTSIFENGTTEIQYGYVERLDDGRGYTCGRAGFTTATGDALEVVEVYTKAVPNNKLKKYLPELRRLAKEESDDTSNLKGFASAWKSLANDKEFRAAQDKVNDRLYYQPAMKRSDNAGLKTALARAVMYDTVIQHGDGDDPDSFYALIKRTNKKAGGSPKDGIDEKKWLNKFLDVRYDDLMNPANHDTRDEWRESVARVDVLRSIAKENNYNLNGPIHVRSNEYGNFVIK

SEQ ID NO: 5098 - protein, 1197 aa, Bacillus subtilis
  strain BSn5
MRRILHIVLITALMFLNVMYTCEAVKAAAAEPQQPISIEKAIQQKEGQALVEGYAVGQAVSPQHYKLTSPFSNDYNVALADRKNETSPEHILPVQIPSAFRSQFGLQTNPLLLGKKITVQGKLENYFNTTGLKNVQSMNVTDDTKTPPAEQPVTINEARGRLNEEVTIKGIITADQNAIGGGKLSTFLQDETGGINIYSPSPEQFPELKEGMDVTVTGKITSYQGLKEIVPNSSGIKINQSNQSLPAPKHLTINELINGSLGDKYEGRLVKLTAFVSSIPSSPAGGGYNVTMIDDDHQAMTLRVMNETAVINELDEGKWYEFTGVLSRYQTFQLLPRKSADLKLLEEQPAPPSAEGEYEGIVDRVVDGDTIHLKSPVLGTTKIRFVNVDTPETYHTPKNDADENQLRFGKKASDYLKTVLSPGDKITVKVGSEAKDSYGRLLGQVITESGSNVNLELVKNGYAPTYFIWPVDNEEDYQQFQAAVAAAKKDQKGIWNENDPLMEMPFEFRAREQGKGLTRYVGDSSNKTYVQPADWKKVAVENRIFFASASEAESAGYKKRQTAPQEHVPLRILSMNDLHGKIDQQYELDLDGNGIADGTFGRMDYAAAYLKEKKAEKKNSLIVHAGDMIGGSSPVSSLLQDEPTVELMEDIGFDVGTVGNHEFDEGTDELLRILNGGDHPKGTSGYDGQNFPLVCANCKMKSTGEPFLPAYDIINVEGVPVAFIGVVTQSAAGMVMPEGIKNIEFTDEVTAVNKAAEELKKKGVKAIAVLAHMSAGQNGNAITGESADLANKTDSEIDMIFAAHNHQVVNGEVNGKLIVQAFEYGKAIGVVDVEIDKTTKDIVKKSAEIVYVDQSKIEPDVSASAILKKYETIAEPIISEVVGEAAVDMEGGYSNDGDTPLGNLIADGMRAAMKTDFALMNGGGIREALKKGPITWGDLYNIQPFGNVLTKLEIKGKDLREIINAQISPVFGPDYSISGFTYTWDKETGKAVDMKMADGTEIQPDATYTLTVNNFMATATGTKYQPIGLLGKNPVTGPEDLEAAVEYVKSFDEPIAYTKEGRIKLAAASDIEDPVTEDPITEEPGDDPGTEDPIKEDPRPDEDLHDIKETPGTAPVHQLPPSAISRFNEIPINNTKTADTANSISTLPLQTETAESGSDHQLPDTSAGYYNFMVIGAAVTLSGTYLYVRRKRSASRT

SEQ ID NO: 5099 - protein, 538 aa, Bacillus subtilis
  strain BSn5
MRNLTKTSLLLAGLCTAAQMVFVTHASADQSIKYDHTYQTPSYIIEKSSQKPVQNTTQKESLFSYLDKHQTQFKLKGNANSHFRISKTIKDPKTKQTFFKLTEVYKGIPIYGFEQAVAMKENKQVKSFFGKVHPQIKDVSITPSISEKKAIHTARRELEASIGKIEYLDGEPKGELYIYPHDGEYDLAYLVRLSTSEPDPGYWHYFIDAKNGKVIESFNAIHEAAGTGIGVSGDEKSFDVTEQNGRFYLADETRGKGINTFDAKNLNETLFTLLSQLIGYTGKEIVSGTSVFNEPAAVDAHANAQAVYDYYSKTFGRDSFDQNGARITSTVHVGKQWNNAAWNGVQMVYGDGDGSKFKPLSGSLDIVAHEITHAVTQYSAGLLYQGEPGALNESISDIMGAMADRDDWEIGEDVYTPGIAGDSLRSLEDPSKQGNPDHYSNRYTGTEDYGGVHINSSIHNKAAYLLAEGGVHHGVQVEGIGREASEQIYYRALTYYVTASTDFSMMKQAAIEAANDLYGEGSKQSASVEKAYEAVGIL

SEQ ID NO: 5100 - protein, 105 aa, Bacillus subtilis; identical to SEQ ID NO: 5048
  strain BSn5

SEQ ID NO: 5101 - protein, 214 aa, Bacillus subtilis
  strain BSn5
MKKVLLLLFVLTIGLALSACSQSSDASEKEKPKEKKSQEELEKELDKELKKGGEPKTKKDDQIHKIGETIKVNDINFTVNKVDREQKGQYGDLGGKDYDKTKTVKDNEERLIIEVTLEYVGKGSMEYNRLGLDLKDKKNKSVRSVISLEDKGKMFLGGNLASGKKVTGVVSYVIPKGEQKNYTLVYNPFLIDTGSDRIEESAKYNIDYLIKLEK

SEQ ID NO: 5102 - protein, 226 aa, Bacillus subtilis
  strain BSn5
MTKTIKIVSFAAAAILVVIICTFLIIRQTHENVLSKETVVKKVEASYEGKVTKATQSKDKKTYDITLENPKGTYFVKADAISADILSMNRVKAVNPSAMTEKEAEHLALERVPGTVKKQTRQSRVATYTIQKEDGKTYEVKVDMQAKTVLSADQISSKDQQKTPITKKEAKTIAERKTGGTADDADLEESEGTLIFEVDVDLPDNKEATVKINAYTGKVANIVYED

SEQ ID NO: 5103 - protein, 170 aa, Bacillus subtilis
  strain BSn5
MLKKKWMVGLLAGCLAAGGFSYNAFAKENNENRQASSKTDALTEQEAEAIAKTVVDGTVEDIDRDLYNGKEVYEVEIEKEGEDYDVYVDIHTKQALNDPLKEKAEQVAITKEEAEEIALKQTGGTVTESKLDEDDGAYIYEMEIQTKQGTETEFEISAKDGRIIKQEIDD

SEQ ID NO: 5104 - protein, 354 aa, Bacillus subtilis; identical to SEQ ID NO: 5052
  strain BSn5

SEQ ID NO: 5105 - protein, 472 aa, Bacillus subtilis
  strain BSn5
MKGAAFVKKEGLKQKALEIGRVPTHLKLEIEDYGGDDKRAHFCWADPQDENTGIIVELGPDGELESLSRDIEPESGERLSEEKLEDIMRQFVETHHPGALSAFVREENDRAYGDKVRFSYVQMEAGLPLPMSGFMADVSLSGEIVYFRYYGEAGSIIKPKRVADVEEALAFIKKDVEFDLLFQVLHRSVYKNGDDQPHLVYEPECRAITVPADLVQEEQAVDDDDDYREPESFPLPLFEGIREKADPDSMIGIEKGFVKEREADLGNGRIGIVWRNPDDPVYQPADKSMDSWFKGRTHQVLKTIYHKETGKLEGVMSFMEKKGPLTVTLAECEKIALRFLFALFPNADQYFRIRYDENDEEENAVAGFTFEAHCHGVPIRFGQIRICVSRQTGYITVYMGPDIDPNKLATIDPVPAISVEQAKSIFWQHFKVELGWEREYGDDEEHSYRLVYKPVYPHFIDAHTGEPVFSIW

SEQ ID NO: 5106 - protein, 521 aa, Bacillus subtilis; identical to SEQ ID NO: 4152
  strain BSn5

SEQ ID NO: 5107 - protein, 381 aa, Bacillus subtilis
  subsp. amylosacchariticus
MRSKKLWISLLFALTLIFTMAFSNMSAQAAGKSSTEKKYIVGFKQTMSAMSSAKKKDVISEKGGKVQKQFKYVNAAAATLDEKAVKELKKDPSVAYVEEDHIAHEYAQSVPYGISQIKAPALHSQGYTGSNVKVAVIDSGIDSSHPDLNVRGGASFVPSETNPYQDGSSHGTHVAGTIAALNNSIGVLGVSPSASLYAVKVLDSTGSGQYSWIINGIEWAISNNMDVINMSLGGPSGSTALKTVVDKAVSSGIVVAAAAGNEGSSGSSSTVGYPAKYPSTIAVGAVNSSNQRASFSSAGSELDVMAPGVSIQSTLPGGTYGAYNGTSMATPHVAGAAALILSKHPTWTNAQVRDRLESTATYLGNSFYYGKGLINVQAAAQ

SEQ ID NO: 5108 - protein, 521 aa, Bacillus subtilis; identical to SEQ ID NO: 4152
  subsp. amylosacchariticus

SEQ ID NO: 5109 - protein, 521 aa, Bacillus subtilis
  subsp. natto
MGLGKKLSVAVAASFMSLSISLPGVQAAEGHQLKENQTNFLSKNAIAQSELSAPNDKAVKQFLKKNSNIFKGDPSKRLKLVESTTDALGYKHFRYAPVVNGVPIKDSQVIVHVDKSDNVYAVNGELHNQSAAKTDNSQKVSSEKALALAFKAIGKSPDAVSNGAAKNSNKAELKAIETKDGSYRLAYDVTIRYVEPEPANWEVLVDAETGSILKQQNKVEHAAATGSGTTLKGATVPLNISYEGGKYVLRDLSKPTGTQIITYDLQNRQSRLPGTLVSSTTKTFTSSSQRAAVDAHYNLGKVYDYFYSNFKRNSYDNRGSKIVSSVHYGTQYNNAAWTGDQMIYGDGDGSFFSPLSGSLDVTAHEMTHGVTQETANLIYENQPGALNESFSDVFGYFNDTEDWDIGEDITVSQPALRSLSNPTKYNQPDNYANYRNLPNTDEGDYGGVHTNSGIPNKAAYNTITKLGVSKSQQIYYRALTTYLTPSSTFKDAKAALIQSARDLYGSTDAAKVEAAWNAVGL

SEQ ID NO: 5110 - protein, 381 aa, Bacillus subtilis
  subsp. natto
MRSKKLWISLLFALTLIFTMAFSNMSAQAAGKSSTEKKYIVGFKQTMSAMSSAKKKDVISEKGGKVQKQFKYVNAAAATLDEKAVKELKKDPSVAYVEEDHIAHEYAQSVPYGISQIKAPALHSQGYTGSNVKVAVIDSGIDSSHPDLNVRGGASFVPSETNPYQDGSSHGTHVAGTIAALNNSIGVLGVAPSASLYAVKVLDSTGSGQYSWIINGIEWAISNNMDVINMSLGGPTGSTALKTVVDKAVSSGIVVAAAAGNEGSSGSTSTVGYPAKYPSTIAVGAVNSSNQRASFSSVGSELDVMAPGVSIQSTLPGGTYGAYNGTSMATPHVAGAAALILSKHPTWTNAQVRDRLESTATYLGNSFYYGKGLINVQAAAQ

SEQ ID NO: 5111 - protein, 214 aa, Bacillus subtilis; identical to SEQ ID NO: 5101
  subsp. natto BEST195

SEQ ID NO: 5112 - protein, 83 aa, Bacillus subtilis
  subsp. natto BEST195
MQAKTVLSADQISSKDQQKTPITKKEAKTIAERKTGGTADDADLEESEGTLIFEVDVDLPDDKEATVKINAYTGKVANIVYED

SEQ ID NO: 5113 - protein, 170 aa, Bacillus subtilis; identical to SEQ ID NO: 5103
  subsp. natto BEST195

SEQ ID NO: 5114 - protein, 521 aa, Bacillus subtilis; identical to SEQ ID NO: 5109
  subsp. natto BEST195

SEQ ID NO: 5115 - protein, 161 aa, Bacillus subtilis
  subsp. natto BEST195
MRKKALIFTVIFGIIFLAVLLVSASIYKSAMAQKEEGHEAAAAEAKKETDLANVDQVETFVGKEKYYVVKGTDKKGTALYVWVPADKKAKILSKEAKEGISEDKAAKIIKDEGLVSKQKEVHLAREGNVLLWEVTYLDKEGQYSLSYVDFTTGKILKNITP

SEQ ID NO: 5116 - protein, 271 aa, Bacillus subtilis; identical to SEQ ID NO: 5028
  subsp. natto BEST195

SEQ ID NO: 5117 - protein, 105 aa, Bacillus subtilis
  subsp. natto BEST195
MKLRHLLLGAGLGICAAVVVKQYVMKPYISSEKALRIVKSAFKQRGPIDGSWIYTQPEPYNINGETVQVYKTGITRSAFGELEQYEVMVDAKTGEIVDVIDTIAS

SEQ ID NO: 5118 - protein, 430 aa, Bacillus subtilis; identical to SEQ ID NO: 5092
  subsp. natto BEST195

SEQ ID NO: 5119 - protein, 221 aa, Bacillus subtilis; identical to SEQ ID NO: 4187
  subsp. natto BEST195

SEQ ID NO: 5120 - protein, 360 aa, Bacillus subtilis
  subsp. natto BEST195
MRRKNECFRKKTYAVFLILLLMMFTAACSGSKTSAEKKESETEKSSDIAQVKIKDVSYTLPSKYDKSTSDDQLVLKVNVAVKNTGKDPLNVDSMDFTLYQGDTKMSDTDPEDYSEKLQVSTINADKSVEGNLFFVVDKGKQYELNYTPKSYGDKKPKSVTFKIDGKDKKILTTADKLQDSAKALSAYVDVLLFGKDNADFEKITGANKNEIVNDFNESAKDGYLSASGLSSTYADSKALDNIVNGIKEGLSKNSSIQAKTTSISKDEAIVEATVKPVDASSLSDRIEDKVKDYYSKNSSASYEEAVKYALQVYPEEFKKLGPASSEKTVEVKMKKNDIDQWQLDMDDYRAAELVEAFIKE

SEQ ID NO: 5121 - protein, 473 aa, Bacillus subtilis
  subsp. natto BEST195
MKGAAFVKKEGLKQKALEIGRVPTHLKLEIEDYGSDDKRAYFCWTDPQDENIGIIVELGPDGELESLSRDIEPESGKRLSEEKLEDIMRQFVETHHPGALSAFVREENDHAYGDKVRFSYVQMEAGLPLPMSGFMADVSLSGEIVYFRYYGEAGSIIKPKRVADVEEALAFIKKDVEFDLLFEVLHRSVYKNGDDQPHLVYEPECRAITVPADLVQEEQGGVDNDDDYREPESFPLPLFEGIREKADPDSMIGIENGFVKEREADLGDGRIGIVWRNPDDPVYQPADKSMDSWFKGRTHQVLKTIYNKETGKLEGVMSFMEKKGPLTVTLAECEKIALRFLFALFPNADQYFRIRYDEKDEEENAVAGFTFEAHCHGVPIRFGQIRICVSRQTGDITVYMGPDIDPNKLAAIDPIPAISVEQAKAIFWQHFKVELGWEREYGDDEEHSYRLVYKPVFPRFIDAHTGEPVFSSW

SEQ ID NO: 5122 - protein, 250 aa, Bacillus subtilis
  subsp. natto BEST195
MYEVTGSLFNGGIIMRRILSIFVFAIMLAGCSSNASTEKQHAGGEKTVKAEPQSTSSQKDSTDDYQPNSQVTDDRSLHKVGQTFSDDKGKAVLKDIKQVNKTYKIGDVELTVKEMKLIHLRPDYSMIDYFHELTHDEEFDFVKVFVDIKNTSTKKVNVAPIALMKTNTGETFDWNKDIYLEELNGELEGGAEKSGNLGFIVNASSGHAHDKAADAEKKTKKIEWIEITTSDVFDHNHKKISDAQKIKIKF

SEQ ID NO: 5123 - protein, 1196 aa, Bacillus subtilis
  subsp. natto BEST195
MMRRILHIVLITALMFLNVMYTFEAVKAAEPQQPISIEKAIQQKEGQALVEGYAVGQAVSPQHYKLTSPFSNDYNVALADRKNETSPDHILPVQIPSAFRSQFGLQTNPLLLGKKITVQGKLDNYFNTTGLKNVQSMNVTDDTKTPPAEQQVTINEARGRLNEEVTIKGIITADQNAIGGGKLSTFLQDETGGINIYSPSPEQFPELKEGMDVTVTGKITSYQGLKEIVPSSSGIKINQSNQSLPAPKHLTINELINGSLGDQYEGRLVKLTAFVSSIPSSPAGGGYNVTMIDDDHHAMTLRVMNETGVIDELDEGKWYDFTGVLSRYQTFQLLPRKSADLKLLEEQPAPPSAEGEYEGIVDRVVDGDTIHLKSPVLGTTKIRFVNVDTPETYHTPKNDADENQLRFGKKASDYLKTVLSPGDKITVKVGSEAKDSYGRLLGQVLTESGSNVNLELVKNGYAPTYFIWPVDNEEDYQQFQAAVAAAKKDQKGIWNENDPLMEMPFEFRAREQGKGLTRYVGDSSNKTYVQPADWKKIAVENRIFFASASEAESAGYKKTQTAPQEHVPLRILSMNDLHGKIDQQYELDLDGNGIADGTFGRMDYAAAYLKEKKAEKKNSLIVHAGDMIGGSSPVSSLLQDEPTVELMEDIGFDVGTVGNHEFDEGTDELLRILNGGDHPKGTNGYDGQNFPLVCANCKMKSTGEPFLPAYDIINVEGVPVAFIGVVTQSAAGMVMPEGIKNIEFTDEVTAVNEAANELKKKGVKAIAVLAHMSAEQNTNAITGESADLANKTDSEIDVIFAAHNHQVVNGEVNGKLIVQAFEYGKAIGVVDVEIDKTTKDIVKKSAEIVYVDQSKIEPDVSASAILKKYETIAEPIISEVVGEAAVDMEGGYSNDGDTPLGNLIADGMRAAMKTDFALMNGGGIREALKKGPITWGDLYNIQPFGNVLTKLEIKGKDLREIINAQISPVFGPDYSISGFTYTWDKETGKAVDLKMADGTEIQPDATYTLTVNNFMATATGAKYQPIGLLGKNPVTGPEDLEATVEYVKSFDEPIAYTKEGRIKLAEASDIEDPVTEDPITEKPGDDPVTEDPIKEDPRPGEDLPDIKETPGTAPVHQLPPSAISRFNEIPINNTKTADTANSISTLPLQTETAESGSDHQLPDTSAGYYNFMVIGAAVTLSGTYLYVRRKRSASRT

SEQ ID NO: 5124 - protein, 190 aa, Bacillus subtilis
  subsp. spizizenii
  strain ATCC 23059 / NRRL B-14472 / W23
MGATGATGEAGPAGATGATGATGDVGPAGATGATGEAGPTGATGATGATGTGAAGLSEYGYIYNLSAQTVAIEADVIFDSTGITTPGITHAPGTSQIAITTPGDYEVTFSVSGVEPNQFTLFLNGAPITNTVYGSGAGTQQNNGQAIIAIAAGDVLTLRNHTSAAAVTLQTLAGGTQTNVNASIVIKKLD

SEQ ID NO: 5125 - protein, 235 aa, Bacillus subtilis
  subsp. spizizenii
  strain ATCC 23059 / NRRL B-14472 / W23
MKRILSIFVFAIVLAGCSSNANTEKQSAGGEQAKATPQSTSSQKDSIDEYQPNSQVTDDRSLLKVGQTFSDDKGKAVLKDIKQVNQTYKIGDVELTVKEMKLIHLRPDYSMIDYFHVLTHDEEFDFVKVFVDIKNTSSKKVNVAPIALMKTNTGETFDWNKDIYLEELNGELEGGAEKSGNLGFIVNASSGHAHDEDADNKKKEKEIKWIEITTSDVFDHNHKKISDAQKIKIEF

SEQ ID NO: 5126 - protein, 1980 aa, Bacillus subtilis
  subsp. spizizenii
  strain ATCC 23059 / NRRL B-14472 / W23
MRTRSFPLGLKKSGRIVMIISLAIFFFFSQIASYTLTAQAVDVTSSDSQFFDSVTIKEGNDQVVDGAKGNEPALKPGDEVTLTYEWSLKKDKDTESEQDINVEIPKNFTFDKGAAGEIKSADQVIGSYQVPAGDNTMTVKLTTASADSPEAKGAITLSATFTADVKDDEHTVAALFQLGGGKTQQVIIPVKKDETPDAETEEPKNDSSETAGDQEGTDDKSAPSVSKEQKEEEQQASADTKGGDSSKSDDSNKVSSSSQSAFKSLQTEEKQITQTILTGVTLTDENGKPYDKGNRADTNSPVKISIDWAIPDDLGKTINAGDTYEFDLPKEFIMHNDIVNLPLSAGDTTFGTFSIDTNGHVVMTFNGEVKDSSNVKGTLVINTQFNEKKITGSTTQKIPFPVNSDTPETTVYFKPNVSKTIDKSGALDKGINPGKVTWTVDVNKKLDQVKNAKLTESLPDGLIYRSVKVYELNVNIDGSVSRGNEVSSGYSVDSKGNVTFNGTIDSAYRLVYETDIDNSAKPSEGGNMTLTNKAAFSGDNLEPISAEATVAAKYGKMIAKSSTGYDGESQTFSWALSYNYGEKQIDQSKASIKDSFGTGDLHLVKDSLKVIPITFGQNGSEQAGTPLKEGEDYTLIDNGSGFEVKFNKNITSAYKITYQTKVNSGVIIDKSTTYTNSVVTGTGDSKEASGIAIQQNLIKGYSNVDYEKKTADWTITVNKNNYEMNNWTLDDQFESGGLVLIDDSFKIQDTTNNKTLQKDKDYTLTKKPEHKGFTLALIGDYAKTDSQFKITYTTTFNADYSNESVKNTAQSTWTDQYGNERTNKVSSGFTPNHQTTNNGFKNGSYNAVSKEITWKIGVNYNGEPTKNPYIKDAITDPQQFVPGSVVIKSYTINKNGSITEGNALDPSKYEVEEPSEKNERTLTVHLKTGDSVPYLIEFKTSLKGKVIDQNKYTNKATYHNDGYADRTLTGSVSVVDGGSLIFKGGKQNGSYIDWSINVNSSQSTLDDVKVTDTPDENQILDADSFKVYQAKYDENGVVKDSSGNLIAGDVELQKDKDYTLNIKTDNTTGEQSFVLEFIGSYKQIDRAYVIKYRSLINIAGTSGHVKNKVSISGTNVKEQTQETSSSIFVAISSGDGSGSGEKGSLTIFKTGEDNNALEGADFQLWSEDAKQLLRTGTTDSGGKLTFGNIRYGSYVLKEIKAPDGYTISHAYAKGVSVKIDSNSSKTGALYKVVNQQNKVTLIKQDEHNNPLAGAVFKLEKKSNDGTYTLIRTDIKSDKNGKVEMNGLPAGYYRLTETQAPAGFIVNTKAIHFSIAKNEKNQVSDVNLGAMTNYQGKVSLTKENAEGQKLEGAVFNIVDQDGNIVKEKLTSDKDGKVEASGLTPGRYAFVETKAPSGYVLNTKKKEFTISESAAGKPEAADAGIAVNDKGSVELTKEEADGQKLEGAVFRIIDKEGNTVQEGLTSDENGRVTASGLAPGHYAFVETKAPSGYVLNTEKIEFAISDSAAGKPDPADAGIAINYKGSVELTKENTEGQKLEGAVFNIVDQEGNTVQEELTSDKDGKVKASGLAPGRYAFVETKAPSGYVLNTEKKEFTISESAAGKPEPAEAGIVVNYLGSVQLTKEDQDGKGLAGAVFKITDTNGETVRDDLVSKEDGKIEVDGLAPGSYQFVEKQAPDGYLLSEKPVSFTIKAEYGGKPEQVKVTAVNTKNLVVLTKVDQHDKNKVLQGAEFNLTDANGKVLKSGLTTDEKGQITVHGLKAGEYQFVETKAPKDYHLDQTPISFKITNTDTKPVKITAENILAPGDVKVTKVDQDDKTTVLEGAEFKLLDASGKPVKTDGYGKELPELWKTDKKGQFTVKGLAPGSYQFIETKAPEGYKLDETPIEFTIEKGQPKAVELVVSNQKVKTPTPDKPDKPTPDGNVNGDGHHSKTNGTDGDSKTDKSLPKTGDADSTLTVMIGILLLMAGGGLAVASRKKQRKG

SEQ ID NO: 5127 - protein, 212 aa, Bacillus subtilis
  subsp. spizizenii
  strain ATCC 23059 / NRRL B-14472 / W23
MAGKLVPCKACGQEIAKGVKKCPNCGKDQRNFFMRHKIITFILAVVVIIIIANIGGGGGSEATSKTSSSSKAETEKTYNIGDTVKTEKTEVTVTKVEDRDTVGTQYVEKKASDGGTIVAVQYTIKNVSKKPISSFSIPTVKLVDADGTSYDSDIDASVNYATETKVDNSKILSDLNPNIKVTGVKAFEVDKEAYAKGTWKLKFSNDVIVKIK

SEQ ID NO: 5128 - protein, 1194 aa, Bacillus subtilis
  subsp. spizizenii
  strain ATCC 23059 / NRRL B-14472 / W23
MRRILHIVLITALMFLNVMYTCEAVKAAEPQQPISVDKAIQQKEGQALVEGYAVGQAVSPQHYKLTSPFSNDYNVALADSKNETLSDHILPVQIPSAFRSQFGLQTNPLLFGKKITVQGKLEDYFNTTGLKNVQSMELTDDTKTPPAEQPVTINEARGRLNEEVTIKGIVTADQGAIGGGKLSTFMQDETGGINIYSPSPKPFPELKEGMDITVTGKITTYQGLTEIVPNSSGIKINQTNQSIPAPKHLTINELMNSSLGDQFEGRLVTLKAFVSSIPNSPAGGGYNVTMVDEVHHAMTLRVMNETGVIDELDEGKWYEFTGVLSRYQSFQLLPRKSSDLKLLEEQPSPPSAEGEYEGIVDRVVDGDTIHLKTPVLGTTKIRFVNVDTPETYHTPKNEADENQLRFGKKASDYLKTVLSPGDKITVKVGSEAKDNYGRLLGQVITESGSNVNLELVKNGYAPTYFIWPVDNEEDYQQFQTAVAAAKKEQKGIWNEDDPLLEMPFEFRAREQGKGLTRYVGDSSNKTYVQPADWKQVAVENRIFFASASEAENAGYKKSQTAPQENVPLRILSMNDLHGKIDQQYELDLDGNGTADGTFGRMDYAAAYLKEKKAEKKNTLIVHAGDMIGGSSPVSSLLQDEPTVELMEDIGFDVGTVGNHEFDEGTDELLRILNGGDHPKGTSGYDGQNFPLVCANCKMKSTGEPFLPAYDIINVEGIPVAFIGVVTQSAAGMVMPDGIKNIEFTDEVTAVNKAAEELKKKGVKAIAVLAHMSAEQNGAAITGESADLANKTDSEIDVIFAAHNHKVVNGEVNGKLIVQAFEYGKAIGVVDVELDKTTKDIVKKSADIVYVDQSKIEPDASASAILKKYQTLAEPIISEVVGEAAVDMEGGYSNDGDTPLGNLIADGMRAAMKTDFALMNGGGIREALKKGPITWGDLYNIQPFRNVLTKLKIKGKDLREIINAQISPVFGPDYSISGFTYTWDKETGKAVDIKLADGTEIQPDATYTLTVNNFMATATGTKYQPIGLLGKNPVTGPEDLEATVAYVKGFDEPIAYTKEGRIKLAEASDIEDPVTDDPVTEEPGGDPGTEQPFKEDPEPGEGQTDIKETPSTVPVHQLTPSDILRLGEMPSGEKNANTAGKISTLPLQNDTAERGPDHQLPDTSAGYYNFMVIGAAVTLSGTYLYVRRKRSASRT

SEQ ID NO: 5129 - protein, 105 aa, Bacillus subtilis
  subsp. spizizenii
  strain ATCC 23059 / NRRL B-14472 / W23
MKLRHLLLGAGLGICTAVVVKQYVMKPYISSEKALRIVKSAFKQRGPIDGSWIYTQPEPYNVNGETVQVYKTGITRSAFGELEQYEVMVDAKTGEIVDVIDTIAS

SEQ ID NO: 5130 - protein, 212 aa, Bacillus subtilis
  subsp. spizizenii
  strain ATCC 23059 / NRRL B-14472 / W23
MKKVLLLLFVLTIGFALSACSQSSDASEKEKPKEKTQEELEKELDKELKEGNVSKSKKDDQIHKIGETFKAGHTNLTVNKVDRVQKGEYTEVGGAVDAKPKTIKNEEERLIIEVTIENIGKDSISYNFIGFDLKDKNDQSIRPVFSIEEKDRILMGGTLVPGKKVTGVVSYVIPKGEQKNYTLVYNPFFADTTSSNIEERVKDDIDYLVKLD

SEQ ID NO: 5131 - protein, 161 aa, Bacillus subtilis
  subsp. spizizenii
  strain ATCC 23059 / NRRL B-14472 / W23
MRKKALIFTAIFGIIFLAVLLVSASIYKSAMAQKEEGHEAAAAEAKKETDLANVDQVETFVGKEKYYVVKGTDKKGTTLYVWVPANKKAKILSKEAKEGISEDKAAKIIQDEGLVSKQKEVHLAREGNVLLWEVTYLDKEGQYSLSYVDFTTGKILKNITP

SEQ ID NO: 5132 - protein, 354 aa, Bacillus subtilis
  subsp. spizizenii
  strain ATCC 23059 / NRRL B-14472 / W23
MFQKKTYAVFLILLLMMFTAACSGSKTSAEKKNSETEKSSDIAQVKIKDVSYTLPSKYDKSTSDDQLVLKVNVAVKNTGKEPLNVDSMDFTLYQDDTKMSDTDPEDYNEKLRSSTINADKSVEGSLFYVVDKGKKYELNYTPESYGDKKPKSVTFKIDGKDKKILATADQLQDSAKALSAYVDVLLFGKDNADFEKITGDNKNKIVSDFNESAKDGYLSASGLSSTYADSKALDNIVNGIKEGLSKNSSIQAKTTSISKDEAIVEATIKPVDASSLSDRIEDRVKDYYSKNSGASYEDAVKYALQVYPEEFKKLGPASSEKTVEVKMKKNDIDQWQLDMDDYRAAELVEAFIKE

SEQ ID NO: 5133 - protein, 465 aa, Bacillus subtilis
  subsp. spizizenii
  strain ATCC 23059 / NRRL B-14472 / W23
MKKEELKQKALEIGRVPTHLKLEIEDYGDDEKRGHFCWTDPQDEHIGIIVELGPDGQLKSLSRDIEPESGERLSEEKLEDIMRQFVETHYPGALSVFVREEENCTSDDKVRFSYVQMEDGLPLPMSGFMGEVSLSGEIIYFRYYGKAGSIIKPKRVADEEEAFAFIKKDVEFDLLFEVLHRSVYKNGDDQPHLVYEPECRAVTVPADLVKEEQAFDDDDDREPESFPLPLFEGIHEKADLGSMIGIEKGFVKERETDLGDGRIRTVWRNPDDPVYQPADKSMDSWFRGRVHQVLKTIHNKETGKLEGVMSFMEKKGPLTVTEAECEKRALRFLFALFPNADQYFKIKYDEPDEEENEVAGFTFEAHCHGVPLRFGQIRICVSRQTGHITVYMAPDIDPKELEAIHPVPAISAEQAKSIFWQHFKVELGWEREYRDDEEHSYRLVYKPVYPRFIEAHTGEPVFSSW

SEQ ID NO: 5134 - protein, 224 aa, Bacillus subtilis
  subsp. spizizenii
  strain ATCC 23059 / NRRL B-14472 / W23
MNIKAVFAAGAAVLAVIICAVLIIRQTHEDVLSKEAVVKKVEASYEGKVTKVTQSKDKKTYDMTLENPKGTYFIKADAKSANILSMNRVKAMNPSAMTEKEAEHLALERVPGTVKKQTQQNRVATYTIQKEDGETYEVKIDMNAKAVVSADRISGEDQQKTPITKKEAKTIAERETGGTADDADLEKSEGTLIFEVDVDLPDDKEATVKINAYTGKVANIVYED

SEQ ID NO: 5135 - protein, 171 aa, Bacillus subtilis
  subsp. spizizenii
  strain ATCC 23059 / NRRL B-14472 / W23
MLKKRWMVGLLAGCLAAGGFSYNAFAKENNENTQSVSSKTDALTEQEAKSIAKTVVDGTVDDIDRDIYNGKEVYEVEIEKDGEDYDVYVDINTKQALNDPLKEKAEQVIITKKEAEEIALKQTNGTVTESKLDEDDGAYIYEVEIQTKQGTEAEFDISAKDGRIIKQEIDD

SEQ ID NO: 5136 - protein, 430 aa, Bacillus subtilis
  subsp. spizizenii
  strain ATCC 23059 / NRRL B-14472 / W23
MPYIVDVYAREVLDSRGNPTVEVEVYTETGAFGRALVPSGASTGEYEAVELRDGDKDRYLGKGVLTAVNNVNEIISPELLGFDVTEQNAIDQLLIELDGTENKGKLGANAILGVSMACARAAADFLQIPLYQYLGGFNSKTLPVPMMNIVNGGEHADNNVDIQEFMIMPVGAPNFREALRMGAQIFHSLKSVLSAKGMNTAVGDEGGFAPNLGSNEEALQTIVEAIEKAGFIPGEEVKLAMDAASSEFYNKEDGKYHLSGEGVVKTSAEMVDWYEEMVSKYPIISIEDGLDENDWEGHKLLTERLGKKVQLVGDDLFVTNTKKLAEGIKNGVGNSILIKVNQIGTLTETFDAIEMAKRAGYTAVISHRSGETEDSTIADIAVATNAGQIKTGAPSRTDRVAKYNQLLRIEDQLAETAQYHGINSFYNLNK

SEQ ID NO: 5137 - protein, 221 aa, Bacillus subtilis
  subsp. spizizenii
  strain ATCC 23059 / NRRL B-14472 / W23
MKKIMSILFMFSLVMGFSQFQSSTAFAADKVVHETIIVPKNTTYDGKGQRFVAGKELGDGSQSENQKPVFHVEDGATLKNVVLGTPAADGVHTYGNVNIQNVKWEDVGEDALTVKKEGKVTIDGGSAQKASDKIFQINKASTFTVKNFTADNGGKFIRQLGGSTFHVDVVIDKCTITNMKEAIFRTDSKTSTVRMTNTRYSNVGQKWIGVQHIYENNNTQF

SEQ ID NO: 5138 - protein, 521 aa, Bacillus subtilis
  subsp. spizizenii
  strain ATCC 23059 / NRRL B-14472 / W23
MGLGKKLSVAVAASFMSLSISLPGVQAAESHHLKENQTNFLSKNAIAQSELSAPNDKAVKQFLKKNSNIFKGDPAKRLKLVESTTDALGYKHFRYAPVVNGVPIKDSQVIVHVDKSDNVYAVNGELHNQSAAKTENSQKVSSEKALALAFKAIGKSPDAVSNGKAKNSNKAELKAVETKDGSYRLAYDVTIRYIEPEPANWEVLVDAETGSILKQQNKVEHAAATGSGTTLKGATVPLNISYESGKYVLRDLSKPTGTQIITYDLQNRQSRLPGTLVSSTTNTFTSSSQRAAVDAHYNLGKVYDYFYSTFKRNSYDNKGSKIVSSVHYGTRYNNAAWTGDQMIYGDGDGSFFSPLSGSLDVTAHEMTHGVTQETANLIYENQPGALNESFSDVFGYFNDTEDWDIGEDITVSQPALRSLSNPTKYGQPDNYANYRNLPNTDEGDYGGVHTNSGIPNKAAYNTITKLGVSKSQQIYYRALTTYLTPSSTFKDAKAALIQSARDLYGSTDAAKVEAAWNAVGL

SEQ ID NO: 5139 - protein, 257 aa, Bacillus subtilis
  subsp. spizizenii
  strain ATCC 23059 / NRRL B-14472 / W23
MQTKPINQLDFVDSELTSFVSHLETTYLDQNKGAFIVTANPEIGFEAMQNPRYEAVLSSADFILPDGIGVVMVSKLIGKPLQSRIAGYDLFTSLLDKADQKKKRVFFYGAAKHVIAETIERVKRDFPGIEIAGYSDGYVKDQREVADKIAASTPDMVFVALGYPNQEFFIHKYRHLFPQAVAVGLGGSFDVFSGNVKRAPSFFIRFHLEWMYRLLTNPARWRRMLSIPKYVTAVLKHERASAKPHYTGQVKDQSRHL

SEQ ID NO: 5140 - protein, 224 aa, Bacillus subtilis; identical to SEQ ID NO: 5134
  subsp. spizizenii ATCC 6633

SEQ ID NO: 5141 - protein, 171 aa, Bacillus subtilis; identical to SEQ ID NO: 5135
  subsp. spizizenii ATCC 6633

SEQ ID NO: 5142 - protein, 212 aa, Bacillus subtilis; identical to SEQ ID NO: 5127
  subsp. spizizenii ATCC 6633

SEQ ID NO: 5143 - protein, 221 aa, Bacillus subtilis; identical to SEQ ID NO: 5137
  subsp. spizizenii ATCC 6633

SEQ ID NO: 5144 - protein, 430 aa, Bacillus subtilis; identical to SEQ ID NO: 5136
  subsp. spizizenii ATCC 6633

SEQ ID NO: 5145 - protein, 212 aa, Bacillus subtilis; identical to SEQ ID NO: 5130
  subsp. spizizenii ATCC 6633

SEQ ID NO: 5146 - protein, 521 aa, Bacillus subtilis; identical to SEQ ID NO: 5138
  subsp. spizizenii ATCC 6633

SEQ ID NO: 5147 - protein, 1980 aa, Bacillus subtilis; identical to SEQ ID NO: 5126
  subsp. spizizenii ATCC 6633

SEQ ID NO: 5148 - protein, 105 aa, Bacillus subtilis; identical to SEQ ID NO: 5129
  subsp. spizizenii ATCC 6633

SEQ ID NO: 5149 - protein, 354 aa, Bacillus subtilis; identical to SEQ ID NO: 5132
  subsp. spizizenii ATCC 6633

SEQ ID NO: 5150 - protein, 465 aa, Bacillus subtilis; identical to SEQ ID NO: 5133
  subsp. spizizenii ATCC 6633

SEQ ID NO: 5151 - protein, 1194 aa, Bacillus subtilis; identical to SEQ ID NO: 5128
  subsp. spizizenii ATCC 6633

SEQ ID NO: 5152 - protein, 161 aa, Bacillus subtilis; identical to SEQ ID NO: 5131
  subsp. spizizenii ATCC 6633

SEQ ID NO: 5153 - protein, 235 aa, Bacillus subtilis; identical to SEQ ID NO: 5125
  subsp. spizizenii ATCC 6633

SEQ ID NO: 5154 - protein, 266 aa, Bacillus subtilis
  subsp. spizizenii ATCC 6633
ATGATGATGEAGPAGATGATGEAGPAGATGATGEAGPTGATGATGEAGPAGATGATGEAGPTGATGATGATGDVGPAGATGATGEAGPTGATGATGATGDVGPAGATGATGEAGPTGATGATGATGTGAAGLSEYGYIYNLSAQTVAIEADVIFDSTGITTPGITHAPGTSQIAITTPGDYEVTFSVSGVEPNQFTLFLNGAPITNTVYGSGAGTQQNNGQAIIAIAAGDVLTLRNHTSAAAVTLQTLAGGTQTNVNASIVIKKLD

SEQ ID NO: 5155 - protein, 250 aa, Bacillus subtilis
  subsp. spizizenii TU-B-10
MYEVTGSLFNGGIIMKRILSIFVFAIVLAGCSSNANTEKQSAGGEQAVKATPQSTSSQKDSIDEYQPNSQVTDDRSLLKVGQTFSDDKGKAVLKDIKQVNQTYQIGDVELTVKEMKLIHLRPDYSMIDYFHVLTHDEEFDFVKVFVDIKNTSSKKVNVAPIALMKTNTGETFDWNKDIYLEELNGELEGGAEKSGNLGFIVNASSGHAHDEDADDKKKEKEIKWIEITTSDVFDHNHKKISDAQKIKIKF

SEQ ID NO: 5156 - protein, 195 aa, Bacillus subtilis
  subsp. spizizenii TU-B-10
MKKALFILFVLTIGFALSACSQSSDASAEQKTEKKEATATEKKTEEKEIKTDEKVHKVGETFKASSTNFSVNKVYTTAEQGEYKTKIGDKEKTINNNEEFLIAEVTIENTSDKSFNYTSGGFELKDSKDQSIRANIVSTADLKTSLKSGKLASGKKVTGTVSFVIPKGEKNLNLSYNPSFLNFETEDITYFVKLN

SEQ ID NO: 5157 - protein, 161 aa, Bacillus subtilis
  subsp. spizizenii TU-B-10
MRKKALIFTAIFGIIFLAVLLVSASIYKSAMAQKEEGHEAAAAEAKKETDLANVDQVETFVGKEKYYIVKGTDKKGTTLYVWVPADKKAKILSKEAKEGISEDKAAKIIQDEGLVSKQKEVHLAREGNVLLWEVTYLDKEGQYSLSYVDFTTGKILKNITP

SEQ ID NO: 5158 - protein, 354 aa, Bacillus subtilis
  subsp. spizizenii TU-B-10
MFQKKTYAVFLILLLMMFTAACSGSKTSAEKKNSETEKSSDIAQVKIKDVSYTLPSKYDKSTSDDQLVLKVNVAVKNTGKEPLNVDSMDFTLYQDDTKMSDTDPEDYNEKLRSSTINADKSVEGSLFYVVDKGEKYELNYTPESYGDKKPKSVTFKIDGKDKKILATADQLQDSAKALSAYVDVLLFGKDNADFEKITGDNKNKIVSDFNESAKDGYLSASGLSSTYADSKALDNIVNGIKEGLSKNSSIQAKTTSISKDEAIVEATIKPVDASSLSDRIEDRVKDYYSKNSGASYEDAVKYALQVYPEEFKKLGPASSEKTVEVKMKKNDIDQWQLDMDDYRAAELVEAFIKE

SEQ ID NO: 5159 - protein, 471 aa, Bacillus subtilis
  subsp. spizizenii TU-B-10
MKGATLVKKKELKQKALEIGRVPTHLKLEIEDYGDDEKSAHFIWTDPQDEHIGIIVELGPDGQLKSLSRDIEPESGERLSEEKLEDIMRQFVETHFPGALSVFVREENDRTYDDKVRFSYVQIEAGLPLPMSGFMAEVSLSGEIIYFRYYGKAGSIIKPMRVADYEEAFAFIKKDVEFNLLFEVLHRSVYKNGDDQPHLVYEPECRAVTVPADLVKEEQAFDDDDDREPESFPLPLFEGIHEKADLGSMIGIEKGFVKERETDLGDGRIRTVWRNPADPVYQPADKSMDSWFRGRVHQVLKTIHNKETGKLEGVMSFMEKKEPLTVTEAECEKIALRFLFALFPNADQYFKIKYDEPDEEENAVAGFTFEAHCHGVPLRFGQIRICVSRQTGHITVYMAPDIDPKELEAIHPVPAISAEQAKSIFWQHFKVELGWEREYRDDEEQSYRLVYKPVYPRFIEAHTGEPVFSSW

SEQ ID NO: 5160 - protein, 1195 aa, Bacillus subtilis
  subsp. spizizenii TU-B-10
MMRRILHIVLITALMFLHVMYTCEAVKAAEPQQPISVDKAIQQKEGQALVEGYAVGQAVSPQNYKLTSPFSNDYNVALADSKTETSSDHILPVQIPSAFRSQFGLQTNPLLLGKKITVQGKLENYFNTTGLKNVQSMDLTDDAKTPPAEQPMTINEARGRLNEEVTIKGIVTADQSAIGGGKLSTFMQDKTGGINIYSPSPKQFPELKEGMDVTVTGKVTTYRGLTEIVPNSSGIKINQSNQPIPAPKHLTINELINSSLGDQFEGRLVTLKAFVSSIPNSPAGGGYNVTMVDEDHHAMTLRVMNETGVIDELDEGKWYEFTGVLSRYQSFQLLTRKSSDLKLLKEQPAPPSAEGEYEGIVDRVVDGDTIHLKTPVLGTTKIRFVNVDTPETYHTPKNEADENQIRFGKKASDYLKTVLSPGDKITVKVGSEAKDNYGRLLAQVITESGSNVNLELVKNGYAPTYFIWPVDNEGDYQQFQAAVAAAKKEQKGIWNEDDPLLEMPFEFRAREQGKGLTRYVGDSSNKTYVQPADWKQVAVENRIFFASVSQAENAGYKKRQTAPQESVPLRILSMNDLHGKIDQQYELDLDGNGTADGTFGRMDYAAAYLKEKKAEKKNTLIVHAGDMIGGSSPVSSLLQDEPTVELMEDIGFDVGTVGNHEFDEGTDELLRILNGGDHPKGTSGYDGQNFPLVCANCKMKSTGEPFLPAYDIINVEGIPVAFIGVVTQSAAGMVMPDGIKNIEFTDEVTAVNEAAEELKKKGVKAIAVLAHMSAEQNGAAITGESADLANKTDSEIDVIFAAHNHKVVNGEVNGKLIVQAFEYGKAIGVVDVELDKTTKDIVNKSADIVYVDQSKIKPDASASAILKKYQTLAEPIISEVVGEAAVDMEGGYSNDGDTPLGNLIADGMRAAMKTDFALMNGGGIREALKKGPITWGDLYNIQPFGNVLTKLEIKGKDLREIINAQISPAFGPDYSISGFTYTWDKETGKAVDIKLADGTEIQPEATYTLTVNNFMATATGTKYQPIGLLGKNPVTGPEDLEATVAYVKSFDEPIAYTKEGRIKLAEASDIEDPVTEDPVTDEPGDAPGTEQPVKEDPEPGEDQTDIKETPDTVPVHQLKPTDILRLGEIPSGEKYTDTAGKISTLPLQNGTAKGGSDHQLPDTSAGYYNFMVIGAAVTLSGTYLYVRRKRSASRT

SEQ ID NO: 5161 - protein, 226 aa, Bacillus subtilis
  subsp. spizizenii TU-B-10
MNKTIKVASAAAAAVLAVIICAFLIIRQTHEDVLSKEAVVKKVEASYEGEVTKVTQSKDKKTYDMTLENPKGTYFIKADAKSADILSMNRVKALNPSALTENEAEHLALKRVPGTVKKQTQQNRVATYTIQKEDGETYEVKVDMQAKAVVSADRIIGEDQPKTPITKKEAKTIAERETGGTADDADLEKSEGTLIFEVDVDLPDDKEATVKINAYTGKVANIVYED

SEQ ID NO: 5162 - protein, 171 aa, Bacillus subtilis
  subsp. spizizenii TU-B-10
MLKKRWMVGLLAGCLAAGGFSYNAFAKENNENTQPASSKTDALTEQEAKSIAKTVVDGTVDDIDRDIYNGKEVYEVEIEKDGEDYDVYVDINTKQALNDPLKEKAEQVVITKEEAEKIALKQTNGTVTESKLDENDGAYTYEIEIQTKQGTEEEFDISAKDGRIIKQEIDD

SEQ ID NO: 5163 - protein, 521 aa, Bacillus subtilis
  subsp. spizizenii TU-B-10
MGLGKKLSVAVAASFMSLSISLPGVQAAESHQLKENQTNFLSKNAIAQSELSAPNDKAVKQFLKKNSNIFKGDPAKRLKLVESTTDALGYKHFRYAPVINGVPIKDSQVIVHVDKSDNVYAVNGELQNQSAAKTENSQKVSSEKALALAFKAIGKSPDAVSNGTAKNSNKAELKAVETKDGSYRLAYDVTIRYIEPEPANWEVLVDAETGSIVKQQNKVEHAAATGSGTTLKGATVPLNISYESGKYVLRDLSKPTGTQIITYDLQNRQSRLPGTLVSSTTNTFTSSSQRAAVDAHYNLGKVYDYFYSTFKRNSYDNKGSKIVSSVHYGTRYNNAAWTGDQMIYGDGDGSFFSPLSGSLDVTAHEMTHGVTQETANLIYENQPGALNESFSDVFGYFNDTEDWDIGEDITVSQPALRSLSNPTKYDQPDNYANYRNLPNTDEGDYGGVHINSGIPNKAAYNTITKLGVSKSQQIYYRALTTYLTPSSTFKDAKAALIQSARDLYGSTDAAKVEAAWNAVGL

SEQ ID NO: 5164 - protein, 278 aa, Bacillus subtilis
  subsp. spizizenii TU-B-10
MKISLNKKADFWKKAVISSLVFTVFFTLMMSETVFAAGLNKDQKRRAEQLTSIFENGTTEIQYGYVEPLDDGRGYTCGRAGFTTATGDALEVVEVYTKAVPNNKLKKYLPELRRLAKEESDDISNLKGFASAWHSLGNDKDFRAAQDEVNDRLYYQPAMKRSDQAGLKTALARAVMYDTVIQHGDGDDPDSFYALIKRTNKKAGGSPKDGKDEKKWLNKFLDVRYDDLMNPADPDTRDEWRESVARVDVLRSIAKENNYNLNGPIHVQSKEYGHFVIK

SEQ ID NO: 5165 - protein, 213 aa, Bacillus subtilis
  subsp. spizizenii TU-B-10
MAGKLVPCKACGQEIAKGVKKCPNCGKDQRNFFMRHKIITFILAVVVIIIIGNVIGGGGGSEATSKTSSSSKAETEKTYNIGDTVKTEKTEVTVTKVEDRDTVGTQYVEKKASDGGTIVAVQYTIKNVSKKPISSFSIPTVKLVDADGTSYDSDIDASVNYATETKVDNSKILSDLNPNIKVTGVKAFEVDKEAYAKGTWKLKFSNDVIVKIK

SEQ ID NO: 5166 - protein, 299 aa, Bacillus subtilis
  subsp. spizizenii TU-B-10
MNITKVLSGAALGTIISISSFTSAHAAVIQKDDASAKVETKQQASITIAKAKQVALNKCKGTVQSAQMKKVNGTYVYVVKVLGEDGKQHTMNVNCDSGKVVKHDVQKKQSYISKSKAHSLALKNCQGAVQSSELKKENGVYVYVVKVLGEDGSLHSFHINGENGKVAKHEQKKQAHLSKTKAHQIALNKYKGAVQSSELKKENGVYIYLVKVLGEDGSTHTIHVNCDSGKIVKQEVQKKNAAITKTKAHQIALNKCKGTVKSSALKKENGKYVYVIKITAQNHTEQTVKVNAENGSICK

SEQ ID NO: 5167 - protein, 166 aa, Bacillus subtilis
  subsp. spizizenii TU-B-10
MNVKILSAAALGAVISISSLSSTHAAVLHKEDTAKVQTQQQASITLSKAKTIALHNCNGAVQSAQMKKVNGVYVYVIKVLGEDGKVHTFNVNCSNGKVVKHHVDNKQAAVTKAKAQSIALNKCKGTVKSSALKKENGIYVYIIKITASNHTVQTIKVNAENGSICS

SEQ ID NO: 5168 - protein, 105 aa, Bacillus subtilis
  subsp. spizizenii TU-B-10
MKLRHLLLGAGLGICTAVVVKQYVMKPYISSEKALRIVKSAFKQRGPIDGSWIYTQPEPYNVNGETVQVYKTGITRSAFGELEQYEVMVDAKTGIIVDVIDTIAS

SEQ ID NO: 5169 - protein, 430 aa, Bacillus subtilis
  subsp. spizizenii TU-B-10
MPYIVDVYAREVLDSRGNPTVEVEVYTETGAFGRALVPSGASTGEYEAVELRDGDKDRYLGKGVLTAVNNVNEIISPELLGFDVTEQNAIDQLLIELDGTENKGKLGANAILGVSMACARAAADFLQIPLYQYLGGFNSKTLPVPMMNIVNGGEHADNNVDIQEFMIMPVGAPNFREALRMGAQIFHSLKSVLSAKGMNTAVGDEGGFAPNLGSNEEALQTIVEAIEKAGFKPGEEVKLAMDAASSEFYNKEDGKYHLSGEGVVKTSAEMVDWYEEMVSKYPIISIEDGLDENDWEGHKLLTERLGKKVQLVGDDLFVTNTKKLAEGIKNGVGNSILIKVNQIGTLTETFDAIEMAKRAGYTAVISHRSGETEDSTIADIAVATNAGQIKTGAPSRTDRVAKYNQLLRIEDQLAETAQYHGINSFYNLNK

SEQ ID NO: 5170 - protein, 194 aa, Bacillus subtilis
  subsp. spizizenii TU-B-10
MKKIVSILFMFSLVMGFSQFQSSTAFAADKVVHETIIVPKNTTYDGKGQRFVAGKELGDGSQSENQEPVFRVEDGATLKNVVLGTPAADGVHTYGNVNIQNVKWEDVGEDALTVKKEGKVTIDGGSAQKASDKIFQINKASTFTVKNFTADTGGKFIRQLGGSTFHVDVIIDKCTITNMKEAISGQTAKQARLE

SEQ ID NO: 5171 - protein, 1980 aa, Bacillus subtilis
  subsp. spizizenii TU-B-10
MRTRSFPLGLKKSGRIVMIISLAIFFFFSQIASYTLTAQAVDVTSSDSQFFDSVTVKEGNDKIVDGSKGNEPAVTPGDEVTLTYEWSLKKDKDAESEKDINVEIPKSFTFDKGAEGEIKSADQVIGSYQVPAGGSTMTVKLTTASADSPDAKGAITLSATFTADVKDDEHTVAALFQLGGGKTQQVIIPVKKDETPDAEAEEPKNDSSETAGDQEGTDDKSTPSVSKDQKEEEQQPSADSKSSDSSKSDDSKKVSSSSQSAFKSLQTEEKQITQHILTGVTLTDENGEPYDKSNRASTNAPVKISIDWAIPDDLGKTINAGDTYEFDLPKEFIMHNDIVNLPLRAGDTTYGTFSIDTNGHVVMTFNGEVKETSNVKGTLVINTQFNEKKITGSTTQKIPFPVNSDTPETTVYFKPNVSKTIDKSGALDKGINPGKVTWTVDVNKKLDQVKNAKLTESLPDGLIYRSVKVYELNVNIDGSVSRGNEVSSGYSVDSKGNVTFNGTIDSAYRLVYETDIDNSAKPSQGGNVTLTNKAAFSGDNLEQISAEATVTAKYGKMIAKSSTGYNGESQTFSWAIAYNYGEKQIDQSKASIKDSFGTGDLHLVKDSLKVIPITFGQNGSEQAGTPLKEGEDYTLTDNGSGFEIKFNKPVTSAYKITYQTKVNSGVIIDKSTTYTNSVVTGTGDTKEASGIAIQQNLIKGYSNVDYEKKTVDWTITVNKNNYEMNNWTLDDQFESGGLVLIDDSFKIQDTTNNKTLQKDKDYTLTKKPEHKGFTLALIGDYAKTNSQFKITYTTTFNADYSNEIVKNTAQSTWTDQYGNERTNKVSSSFTPNHQTTNNGFKNGSYNAVSKEITWKIGINYNGEPTKNPYIKDVITDPQQFVPGSVVVKSYTINKNGSITEGDALDPSKYEVEEPSEKNERTLTVHLKTGDSVPYLIEFKTSLKGQVIDQNQYTNKATYHNDGYADRTLTGSVSVTNGGSLVFKGGKQNGSYIDWNINVNSSQSTLDDVKVTDTPDENQILDADSFKVYQAKYDENGVVKDSSGNLTARDVELQKDKDYTLDIKTDNTTGEQSFVLKFIGSYKQIDRAYVIKYRSLINIAGTNGHVKNKVSISGTNVKEQTQENSSSIFVAISSGDGSGSGDKGSLTIFKTGEDDKALEGAEFQLWSEDSKQLLRTGTTDAGGKLTFGNIRYGSYVLKEIKAPDGYTISDAYAKGVSVKIDSNSSKTGALYKVVNQQNKVTLIKQDEQNNPLAGAVFKLEKKSNDGTYTLIRTDIKSDKNGKVEMNGLPAGYYRLTETQAPAGFIVNTKAIHFSIAKNEKNQVSDVNLGAMTNYQGKVSLTKENAEGQKLEGAVFNIVDQDGNIVKEKLTSDKDGKVEASGLAPGRYAFVETKAPSGYVLNTTKKEFTISESAAGKPEAADAGIAVNDKGSVQLTKEDADGQKLEGAVFRIIDKEGNTVQEGLTSDENGRVAASGLAPGHYAFVETKAPSGYVLNTEKIEFTISDSAAGKPEPVNAGTAINYKGSVELTKENTEGQKLEGAVFNIVDQEGNTVQEKLTSDKDGKVKASDLAPGRYAFIETKAPSGYVLNTEKIEFIISESAAGKPESADAGIVVNDKGSVQLTKQDQDGKGLAGAVFKITDSNGKTVRDDLVSKEGGKIEVDGLAPGSYQFVEKQAPDGYLLSESPVSFTIKGEYSGKPEQVKVTAVNTKNLVVLTKVDQHDKNKVLQGAEFNLTDANGKVLKSGLTTDDKGQLTVHGLKAGEYQFVETKAPKDYHLDQTPISFKITNTDTKPVDITAENILTPGDVNVTKVDQDDKTTVLEGAEFKLLDASGKPVKTDGYGKELPELWKTDKKGQFTVKGLTPGSYQFIETKAPEGYKLDETPIEFTIEKGQPKAVELVVSNQKVKTPTPDKSDKPTPDGNVNGDGHHSKTSGTDGDSKTDKSLPKTGDADSTLTVMIGILLLMAGGGLAVASRKKQRKG

SEQ ID NO: 5172 - protein, 105 aa, Bacillus subtilis
  subsp. subtilis str. RO-NN-1
MKLRHLLLGAGLGICTAVVVKQYVMKPYISSEKALRIVKSAFKQRGPIDGSWIYTQPEPYNINGETVQVYKTGITRSAFGELEQYEVMVDAKTGEIVDVIDTIAS

SEQ ID NO: 5173 - protein, 430 aa, Bacillus subtilis; identical to SEQ ID NO: 5092
  subsp. subtilis str. RO-NN-1

SEQ ID NO: 5174 - protein, 1970 aa, Bacillus subtilis
  subsp. subtilis str. RO-NN-1
MIISLAIFFFFSQIASYTLTAQAVDVTSSDSQFFDSVTVKDAKGQIVDGSKGNKPALTPGDEVTLTYEWSLKKDKKADSEQDINVEIPKSFTFDKGAEGEIKSADQVIGSYQVPAGSSTMTVKLTTASADSPDAKGTITLPAKFTADVKDDEHTAAALFQLGGGKTQQVIIPVKKEETPDAEAEEPKNDSSDTAGDQEGKDDKPAPSVSKDQKEEEQQPSDDSKSGEASKSDDSKKVSSSSQSAFKSLQTEEKQITQNILTGVTLTDENGKPYDKGNRANTNSPVKISIDWAIPDNLGKTINAGDKYEFDLPKEFIMHNDIVNLPLSAGDTTYGTFSIDTNGHVVMTFNGEVKDSSNVKGTLVINTQFNEKKITGSTTQKVPFPVNSDTPETTVYFKPNVSKTIDKSGVLDKGINPGKVTWTVDVNKKLDQVKNAKLTESLPDGLIYRSVKVYELNVNIDGSVSKGNEVSSGYSVDSKGNVTFDGTIDSAYRLVYETDIDNSAKPSEGGNVTLTNKAAFSGDNLEPISAEATVAAKYGKMIAKSSTGYDGESQTFSWALSYNYGEKQIDQSKASIKDSFGTGDLHLVKDSLKVIPITFGQNGSEQAGTPLKEGEDYTLIDNGSGFEIKFNKTITSAYKITYQTKVNSGVIIDKSTTYTNSVVTGTGDSKEASGIAIQQNLIKGYSNVDYEKKTADWTITVNKNKYFMNNWTLDDQFESGGLVLLDESFKLQDTTNNKTLQKDKDYTLTKKPDHKGFTLALIGDYAKTDSQFKITYTTTFNADYSNEGVKNTAQSTWTDQNGNERTNKVSSGFTPNHQTTNNGFKNGSYNAVSKEITWKIGVNYNGEPTKNSYIKDAITDPQQFVPGSVVVKSYTINKNGSITEGDALDPSKYEVEEPSAKNERTLTVHLKTGDSVPYLIEFKTSLKGQVIDQNQYTNKATYYNDGYADRTLTGSVSVTNGGSLVFKGGKQNGSYIDWSINVNSSQSTLDDVKVTDTPDENQILDADSFKVYQAKYDENGVVKDSSGNLTAGDVELQKDKDYTLDIKTDNTTGEQSFVLKFIGSYKQIDRAYVIKYRSLINIAGTNGHVKNKVSISGTNVKEQTQENTSSIFVAISSGDGSGSGDKGSLTIFKTGEDDKALEGAEFQLWSEDSKQLLRTGTTDVGGKLTFGNIRYGSYVLKEVKAPDGYTISDAYAKGVSVKIDSNSSKTGALHKVINQQNKVTLIKQDEQNNPLAGAVFKLEKKSNDGTYTLIRTDIKSDKNGKVEMNGLPAGYYRLTETQAPEGFIVNTKAIHFSVAKNEKNQVSDVNLGKMTNYQGKVLLTKENAEGQKLEGAVFNIVDQDGKVVQEKLTSDKDGKIEASGLAPGRYAFVEIKAPAGYVLNTKKKVFTISESAAGQPEAADAGIAVNDKGSVELTKEDADGQKLEGAVFKIIDKEGNIVQEGLTSDKNGKVAASGLAPGHYAFVETKAPAGYVLNTEKIEFEISDSSEGKPEATDAGIATNHKGSVELTKENAEGKKLEGAVFNIVDEKGNTVQEELTSDKDGKVKASGLAPGRYAFVETKAPAGYVLNTEKKEFTISESAAGKPKSADAGIAVNYQGSVQLMKEDQDGKGLAGAVFKITDSNGNTVRDDLVSKEGGKIEVDGLAPGSYQFVEKQAPDGYLLSEKPVSFTIKAEYGGKPEQVKATAVNTKNLVVLTKVDQHDQHKVLQGAEFNLTDANGKVLKSGLVTDDKGQITVHGLKAGEYQFVETKAPKDYELDQTPISFKITNTDTKTVEITAENILAPGDVNVKKVDQDDKNTVLEGAEFKLLDESGKPVKTDGYGKELSELWKTDQNGQFTVKGLAPGSYQLIETKAPEGYKLDETPIEFTIEKGQSKAVEIVVSNQKVKTPAPDKHDHPDKPTPGGNGKDDGDHPNTNGTDGSSDGQSNTDKTLPKTGDTDSMLTAMIGILLLMAGGGLAVASRKKQRKG

SEQ ID NO: 5175 - protein, 1195 aa, Bacillus subtilis
  subsp. subtilis str. RO-NN-1
MRRILHIVLITALMFLNVMYTFEAVKAAEPQQPISIEKAIQQKEGQALVEGYAVGQAVSPQHYKLTSPFSNDYNVALADRKNETSPDHILPVQIPSAFRSQFGLQTNPLLLGKKITVQGKLENYFNTTGLKNVQSMNVTDDTKTPPAEQPVTINEARGRLNEEVTIKGIITADQNAIGGGKLSTFLQDETGGINIYSPSPEQFPELKEGMDVTVTGKITSYQGLKEIVPSSSGIKINQSNQSLPAPKHLTINELINGSLGDQYEGRLVKLTAFVSSIPSSPAGGGYNVTMIDDDHHAMTLRVMNETGVINELDEGKWYEFTGVLSRYQTFQLLPRKSADLKLLEDQPAPPSAEGEYEGIVDRVVDGDTIHLKSPVLGTTKIRFVNVDTPETYHTPKNDADENQLRFGKKASDYLKTVLSPGDKITVKVGSEAKDSYGRLLGQVITESGSNVNLELVKNGYAPTYFIWPVDNEEDYQQFQAAVATAKKDQKGIWNENDPLMEMPFEFRAREQGKGLTRYVGDSSNKTYVQPADWKKVAVENRIFFASASEAESAGYKKRQTAPQEHVSLRILSMNDLHGKIDQQYELDLDGNGTVDGTFGRMDYAAAYLKEKKAEKKNSLIVHAGDMIGGSSPVSSLLQDEPTVELMEDIGFDVGTVGNHEFDEGTDELLRILNGGDHPKGTSGYDGQNFPLVCANCKMKSTGEPFLPAYDIINVEGVPVAFIGVVTQSAAGMVMPEGIKNIEFTDEATAVNKAAKELKKKGVKAIAVLAHMSAEQNGNAITGESADLANKTDSEIDVIFAAHNHKVVNGEVNGKLIVQAFEYGKAIGVVDVEIDKTTKDIVKKSAEIVYVDQSKIEPDVSTSAILKKYETIAEPIISEVVGEAAVDMEGGYSNDGDTPLGNLIADGMRTAMKTDFALMNGGGIREALKKGPITWGDLYNIQPFGNVLTKLEIKGKDLREIINAQISPVFGPDYSISGFTYTWDKETGKAVDLKMADGTEIQPDATYTLTVNNFMATATGAKYQPIGLLGKNPVTGPEDLEATVEYVKSFDEPIAYTKEGRIKLAEASDIEDPVTEDPITEEPGDDPVTEDPIKEDPRPGEDLPDIKETPGTAPVHQLPPSAISRFNEIPINNTKTADTANSISTLPLRNEGGESGSEHPLPDTSANYYNFMVIGAAVTLSGTYLYVRRKRSASRT

SEQ ID NO: 5176 - protein, 225 aa, Bacillus subtilis
  subsp. subtilis str. RO-NN-1
MTKTIKTVSFAAAAILVVIICTLLIIRQTHENVLSKETVVKKVEASYEGKVTKATQSKDKKTFDITLENPKGTYFVKADAISADILSMNRVKALNPSAMTEKEAEHLALERVPGTVKKQTRQSRVAIYTIQNEDGKTYEVKVDMQAKAVLSADQISKDQQKTPITKKEAKTIAERKTGGTADDADLEESEGTLIFEVDVDLPDDKEATVKINAYTGKVANIVYED

SEQ ID NO: 5177 - protein, 170 aa, Bacillus subtilis
  subsp. subtilis str. RO-NN-1
MLKKRWMVGLLAGCLAAGGFSYNAFAKENDENRQASSKTDALTEQEAEAIAKTVVDGTVEEIDTDLYNGKEVYEVEIEKEGEDYDVYVDIHTKQALNDPLKEKAEQVAITKEEAEEIALKQTDGTVTESKLDEDDGAYIYEMEIQTKQGTETEFEISAKDGRIIKQEIDD

SEQ ID NO: 5178 - protein, 161 aa, Bacillus subtilis; identical to SEQ ID NO: 5115
  subsp. subtilis str. RO-NN-1

SEQ ID NO: 5179 - protein, 271 aa, Bacillus subtilis
  subsp. subtilis str. RO-NN-1
MKISMQKAAISLLVFTMFFTLMMSETVFAAGLNKDQKRRAEQLTSIFENGTTEIQYGYVERLDDGRGYTCGRAGFTTATGDALEVVEVYTKAVPNNKLKKYLPELRRLAKEESDDTSNLKGFASAWKSLANDKEFRAAQDKVNDHLYYQPAMKRSDNAGLKTALARAVMYDTVIQHGDGDDPDSFYALIKRTNKKAGGSPKDGIDEKKWLNKFFDVRYDDLMNPANHDTRDEWRESVARVDVLRSIAKENNYNLNGPIHVRSNEYGNFVIK

SEQ ID NO: 5180 - protein, 241 aa, Bacillus subtilis
  subsp. subtilis str. RO-NN-1
MQVADASLAKNERYPGRILSLKKIVSILFMFGLVMGFSQFQSSTAFAADKVVHETIIVPKNTTYDGKGQRFVAGKELGDGSQSENQDPVFRVEDGATLKNVVLGAPAADGVHTYGNVNIQNVKWEDVGEDALTVKKEGKVTIDGGSAQKASDKIFQINKASTFTVKNFTADNGGKFIRQLGGSTFHVDVIIDKCTITNMKEAIFRTDSKTSTVRMTNTRYSNVGQKWIGVQHIYENNNTQF

SEQ ID NO: 5181 - protein, 213 aa, Bacillus subtilis
  subsp. subtilis str. RO-NN-1
MAGKLVPCKACGQEIAKGVKKCPNCGKDQRNFFMRHKIITFILAVVVIIIIGNMIGGGGGSEATSKTSSSSKAETEKTYNIGDTVKTEKTEVTVTKVEDRDTVGTQYVEKKASEGGTIVAVQYTIKNVSKKPISSFSIPTVKLVDADGTSYDSDIDASVNYATETKVDNSKILSDLNPNIKVTGVKAFEVDKEAYAKGTWKLKFSNDVIVKIK

SEQ ID NO: 5182 - protein, 236 aa, Bacillus subtilis
  subsp. subtilis str. RO-NN-1
MRRIVSIFVFAIMLAGCSSNASTEKQHAGGEKTVKAEPQSTSSQKDSTDDYQPNSQVTDDRSLLKVGQTFSDDKGKAVLKDIKQVNETYKIGDVELTVKEMKLIHLRPDYSMIDYFHELTHDEEFDFVKVFVDIKNTSSKKVNVAPIALMKTNTGETFDWNKDIYLEELNGELEGGAEKSGNLGFIVNASSGHAHDKAADAEKKTKEIKWIEITTSDVFDHNHKKISDAQKIKIKF

SEQ ID NO: 5183 - protein, 354 aa, Bacillus subtilis
  subsp. subtilis str. RO-NN-1
MFQKKTYAVFLILLLMMFTAACSGSKTSAEKKESETEKSSDIAQVKIKDVSYTLPSKYDKSTSDDQLVLKVNVAVKNTGKDPLNVDSMDFTLYQGDTKMSDTDPEDYSEKLQGSTINADKSVEGNLFFVVDKGKQYELNYTPESYGDKKPKSVTFKIDGKDKKILATADKLQDSAKALSAYIDVLLFGKDNADFEKITGANKNEIVNDFNESAKDGYLSASGLSSTYADSKALDNIVNGIKEGLSKNSSIQAKTTSISKDEAIVEATVKPVDASSLSDRIEDKVKDYYSKNSSASYEEAVKYALQVYPEEFKKLGPASSEKTVEVKMKKNDIDQWQLDMDDYRAAELVEAFIKE

SEQ ID NO: 5184 - protein, 473 aa, Bacillus subtilis
  subsp. subtilis str. RO-NN-1
MKGAAFVKKEELKQKALEIGRVPTHLKLEIEDYGGDDKRAHFCWADPQDENTGIIVELGPDGELESLSRDIEPESGERLSEEKLEDIMRQFVETHHTGALSSFVREENDCAYGDKVRFSYVQMEAGLPLPMSGFMADVSLSGEIVYFRYYGEAGSIIKPERVADVEEALAFIKKEVEFDLLFQVLHRSVYKNGDDQPHLVYEPECRAITVPADLVQEEQGGVDDDDDYREPESFPLPLFEGIHEKADPGSMIGIEKGFVKEREADLGDGRLGIVWRNPDDPMYQPADKSMDSWFKGRTHQVLKTIYNKETGKLEGVMSFMEKEGPLTVTEAECEKIAVRFLFALFPNADQYFRIRYDEKDEEENAVAVFTFEAHCHGVPIRFGQIRICVSCQTGYITVYTGPDIDPNKLATIDPVPAISVEQAKSIFWQHFKVELGWEREYGDDEEHSYRLVYKPVYPHFIDAHTGEPVFSIW

SEQ ID NO: 5185 - protein, 521 aa, Bacillus subtilis
  subsp. subtilis str. RO-NN-1
MGLGKKLSVAVAASFMSLSISLPGVQAAEGHQLKENQTNFLSKNAIAQSELSAPNDKAVKQFLKKNSNIFKGDPAKRLKLVESTTDALGYKHFRYAPVVNGVPIKDSQVIVHVDKSDNVYAVNGELHNQSAAKTDNSQKVSSEKALALAFKAIGKSPDAVSNGAAKNSNKAELKAIETKDGSYRLAYDVTIRYVEPEPANWEVLVDAETGSILKQQNKVEHAAATGSGTTLKGATVPLNISYEGGKYVLRDLSKPTGTQIITYDLQNRQSRLPGTLVSSTTKTFTSSSQRAAVDAHYNLGKVYDYFYSNFKRNSYDNKGSKIVSSVHYGTQYNNAAWTGDQMIYGDGDGSFFSPLSGSLDVTAHEMTHGVTQETANLIYENQPGALNESFSDVFGYFNDTEDWDIGEDITVSQPALRSLSNPTKYNQPDNYANYRNLPNTDEGDYGGVHTNSGIPNKAAYNTITKLGVSKSQQIYYRALTTYLTPSSTFKDAKAALIQSARDLYGSTDAAKVEAAWNAVGL

SEQ ID NO: 5186 - protein, 214 aa, Bacillus subtilis
  subsp. subtilis str. RO-NN-1
MKKVLLLLFVLTIGLALSACSQSSDASEKEKPKVKKSQEELEKELDKELKKGGEPKTEKDDQIHKIGETIKVNDINFTVNKVDREQNGQYGDLGGKEYDKIKTLKGNEERLIIEVTLEYVGKGSMEYNRLGLDLKDKKNKSVRSVISLEDKGKMFLGGNLASGKKVTGVVSYVIPKGEQKNYTLVYNPFLTDTRSDRIEESAKYNMDYLIKLEK

SEQ ID NO: 5187 - protein, 166 aa, Bacillus subtilis
  subsp. subtilis str. SC-8
MNMKICSAAALGAIISISSLSSAHAAVLHKEDTAKVQTQQQASITLSKAKTVALKNCKGAVQSAQMKKADGVYVYVIKVLGEDGKIHTFNINRNSGKIVKHHVEHKQAAITKAKAQSIALNKCKGTVTSSALKKENGTYVYIITITASNHTVQTIKVNAENGGICS

SEQ ID NO: 5188 - protein, 299 aa, Bacillus subtilis
  subsp. subtilis str. SC-8
MNITKVLSGAALGTIISISSFTSAHAAVIQKDDTSTKVETKQQASITIAKAKQVALNKCKGTVQTAQMKKVNGTYVYVVKVLGEDGKQHTMNVNCNSGKVVKHDVQKKQSYISKTKAQSIALKNCKGAVQSSELKQENGVYAYVVKVMGEDGSLHTFHINGENGKVAKHEQKKQAHLSKTKAHQIALNKCKGAVQSSELKKENGAYIYVVKVLGEDGSTHKIHVNCDSGKIVKQEVQKKNAAVTKTKAHQIALNKCKGTVKSTDLKKENGTFVYVIKITAQNHTEQTVKVNAENGSICK

SEQ ID NO: 5189 - protein, 180 aa, Bacillus subtilis
  subsp. subtilis str. SC-8
MRHKIITFILAVVVIIIIGNMIGGGGGSEATSKTSSGSKAETEKTYNIGDTVKTEKTEVTVTKVEDRDTVGTQYVEKKASDGGTIVAVQYTIKNVSKKPISSFSIPTVKLVDADGTSYDSDIDASVNYATETKVDNSKILSDLNPNIKVTGVKAFEVDKEAYAKGTWKLKFSNDVIVKIK

SEQ ID NO: 5190 - protein, 212 aa, Bacillus subtilis
  subsp. subtilis str. SC-8
MFGLVMGFSQFQSSTAFAADKVVHETIIVPKNTTYDGKGQRFVAGKELGDGSQSENQDPVFRVEDGATLKNVVLGAPAADGVHTYGNVNIQNVKWEDVGEDALTVKKEGKVTIDGGSAQKASDKIFQINKASTFTVKNFTADNGGKFIRQLGGSTFHVDVIIDKCTITNMKEAIFRTDSKTSTVRMTNTRYSNVGQKWIGVQHIYENNNTQF

SEQ ID NO: 5191 - protein, 430 aa, Bacillus subtilis; identical to SEQ ID NO: 5092
  subsp. subtilis str. SC-8

SEQ ID NO: 5192 - protein, 105 aa, Bacillus subtilis; identical to SEQ ID NO: 5048
  subsp. subtilis str. SC-8

SEQ ID NO: 5193 - protein, 277 aa, Bacillus subtilis; identical to SEQ ID NO: 4175
  subsp. subtilis str. SC-8

SEQ ID NO: 5194 - protein, 161 aa, Bacillus subtilis; identical to SEQ ID NO: 5074
  subsp. subtilis str. SC-8

SEQ ID NO: 5195 - protein, 459 aa, Bacillus subtilis
  subsp. subtilis str. SC-8
MKKNSNIFKGDPSKRLKLVESTTDALGYKHFRYAPVVNGVPIKDSQVIVHVDKSDNVYAVNGELHNQSAAKTDNSQKVSSEKALALAFKAIGKSPDAVSNGAAKNSNKAELKAIETKDGSYRLAYDVTIRYVEPEPANWEVLVDAETGSILKQQNKVEHAAATGSGTTLKGATVPLNISYEGGKYVLRDLSKPTGTQIITYDLQNRQSRLPGTLVSSTTKTFTSSSQRAAVDAHYNLGKVYDYFYSNFKRNSYDNKGSKIVSSVHYGTQYNNAAWTGDQMIYGDGDGSFFSPLSGSLDVTAHEMTHGVTQETANLIYENQPGALNESFSDVFGYFNDTEDWDIGEDITVSQPALRSLSNPTKYNQPDNYANYRNLPNTDEGDYGGVHTNSGIPNKAAYNTITKLGVSKSQQIYYRALTTYLTPSSTFKDAKAALIQSARDLYGSTDAAKVEAAWNAVGL

SEQ ID NO: 5196 - protein, 170 aa, Bacillus subtilis; identical to SEQ ID NO: 4240
  subsp. subtilis str. SC-8

SEQ ID NO: 5197 - protein, 226 aa, Bacillus subtilis
  subsp. subtilis str. SC-8
MTKTIKIVSFAAAAILVVIICTFLIIRQTHENVLSKETVVKKVEASYEGKVTKATQSKDKKTYDITLENPKGTYFVKADAISADILSMNRVKAVNPSAMTEKEAEHLALERVPGTVKKQTRQSQVATYTIQKEDGKTYEVKVDMQAKTVLSADQISSKDQQKTPITKKEAKTIAERKTGGTADDADLEESEGTLIFEVDVDLPDNKEATVKINAYTGKVANIVYED

SEQ ID NO: 5198 - protein, 213 aa, Bacillus subtilis
  subsp. subtilis str. SC-8
MKKVLLLLFVLTIGLALSACSQSSDASEKEKPKEKKSQEELEKELDKELKKGGEPKTKKDNQIHKIGETFKAGHTNFTVNKVDRVQKGEYMNVGGAVNEETKTIKDDEERLIIEVTMENIGEDSISYNFIGFDLRDKNDQSVRPVFSIEEKGRILMGGTLVSGKKVTGVLSYVIPKGEQKHYTLVYNPFLADTNSSNTEERVKDDIDYLVKLD

SEQ ID NO: 5199 - protein, 519 aa, Bacillus subtilis
  subsp. subtilis str. SC-8
MVFVTHASADQSIKYDHTYQTPSYIIEKSPQKPVQNTTQKESLFSYLDKHQTQFKLKGNANSHFRVSKTIKDPKTKQTFFKLTEVYKGIPIYGFEQAVAMKENKQVKSFFGKVHPQIKDVSITPSISEKKAIHAARRELEASIGKIEYLDGEPKGELYIYPHDGEYDLAYLVRLSTSEPEPGYWHYFIDAKNGKVIESFNAIHETAGTGIGVSGDEKSFDVREQNGRFYLADETRGKGINTFDAKNLNETLFTLLSQLIGYTGKEIVSSTSVFNEPAAVDAHANAQAVYDYYSKTFGRDSFDQNGARITSTVHVGKQWNNAAWNGVQMVYGDGDGSKFKPLSGSLDIVAHEITHAVTQYSAGLLYQGEPGALNESISDIMGAMADRDDWEIGEDVYTPGIAGDSLRSLEDPSKQGNPDHYSNRYTGTEDYGGVHINSSIHNKAAYLLAEGGVHHGVQVEGIGREASEQIYYRALTYYVTASTDFSMMKQAAIEAANDLYGEGSKQSVSVEKAYEAVGIL

SEQ ID NO: 5200 - protein, 1177 aa, Bacillus subtilis
  subsp. subtilis str. SC-8
MYTFEAVKAAEPQQPISIEKAIQQKEGQALIEGYAVGQAVSPQHYKLTSPFSNDYNVALADRKNETSPDHILPVQIPSAFRSQFGLQTNPLLLGKKITVQGKLENYFNTTGLKNVQSMNVTDDTKTPPAEQPVTINEARGRLNEEVTIKGIIKADQNAIGGGKLSTFLQDETGGINIYSPSPEQFPELKEGMDVTVTGKIASYQGLKEIVPSSSGIKINQSNQSLPAPKHLTINELINGSLGDQYEGRLVKLTAFVSSIPSSPAGGGYNVTMIDDDHHAMTLRVMNETGVINELDEGKWYDFTGVLSRYQTFQLLPRKSADLKLLEEQPAPPSAEGEYEGIVDRVVDGDTIHLKSPVLGTTKIRFVNVDTPETYHTPKNDADENQLRFGKKASDYLKTVLSPGDKITVKVGSEAKDSYGRLLGQVITESGSNVNLELVKNGYAPTYFIWPVDNEEDYQQFQAAVAAAKKDQKGIWNENDPLMEMPFEFRAREQGKGLTRYVGDSSNKTYVKPADWKKVAVENRIFFASASEAESAGYKKRQTAPQEHVPLRILSMNDLHGKIDQQYELDLDGNGTVDGTFGRMDYAAAYLKEKKAEKKNSLIVHAGDMIGGSSPVSSLLQDEPTVELMEDIGFDVGTVGNHEFDEGTDELLRILNGGDHPKGTSGYDGQNFPLVCANCKMKSTGEPFLPAYDIINVEGVPVAFIGVVTQSAAGMVMPEGIKNIEFTDEATAVNKAAKELKKKGVKAIAVLAHMSAEQNGNAITGESADLANKTDSEIDVIFAAHNHKVVNGEVNGKLIVQAFEYGKAIGVVDVEIDKTTKDIVKKSAEIVYVDQSKIEPDVSASAILKKYETIAEPIISEVVGEAAVDMEGGYSNDGDTPLGNLIADGMRTAMKTDFALMNGGGIREALKKGPITWGDLYNIQPFGNVLTKLEIKGKDLREIINAQISPVFGPDYSISGFTYTWDKETGKAVDLKMADGTEIQPDATYTLTVNNFMATATGTKYQPIGLLGKNPVTGPEDLEATVEYVKSFDEPIAYTKEGRIKLAEASDIEDPVTEDPITEEPGDDPVTEDPIKEDPRPGEDLPDIKETPGTAPVHQLPPSAISRFNEIPINNTKNADTANSISTLPLRNEGGESGSEHPLPDTSANYYNFIVIGAAVTLSGTYLYVRRKRSASRT

SEQ ID NO: 5201 - protein, 250 aa, Bacillus subtilis
  subsp. subtilis str. SC-8
MYEVTGSLFNGGIIMRRILSILVFAIMLAGCSSNASTEKQHAGGEKTVKAEPQSTSSQKDSTDDYQPNSQVTDDRTLHKVGQTFSDDKGKAVLKDIKQVNKTYKIGDVELTVKEMKLIHLRPDYSMIDYFHELTHDEEFDFVKVFVDIKNTSTKKVNVAPIALMKTNTGETFDWNKDIYLEELNGELEGGAEKSGNLGFIVNASSGHAHDKAADAEKKTKEIKWIEITTSDVFDHNHKKISDAQKIKIKF

SEQ ID NO: 5202 - protein, 473 aa, Bacillus subtilis
  subsp. subtilis str. SC-8
MKGAAFVKKEGLKQKALEIGRVPTHLKLEIEDYGGDDKRAYFCWTDPQDENTGIIVELGPDGELESLSRDIEPESGERLSEEKLEDIMRQFVETHYPEALSAFVREENDRAYGDKVRFSYVQMEAGLPLPMSGFMADVSLSGEIVYFRYYGEAGSIIKPKRVADVEEALAFIKKDVEFDLLFEVLHRSVYRNGDDQPHLVYEPECRAITVPADLVQEEQGGVDDDDDYREPESFPLPLFEGIREKADPDSMIGIENGFVKEREADLGDGRIGIVWRNPDDPVYQPADKSMDSWFKGRTHQVLKTIYNKETGKLEGVMSFMEEKGPLTVTLAECEKIALRFLFALFPNADQYFRIRYDEKDEEENAVAGFTFEAHCHGVPLRFGQIRICVSRQTGYITVYMGPDIDPNKLATIDPVPAISVEQAKSIFWQHFKVELGWEREYGDDEEHSYRLVYKPVYPHFIDAHTGEPVFSIW

SEQ ID NO: 5203 - protein, 354 aa, Bacillus subtilis; identical to SEQ ID NO: 5052
  subsp. subtilis str. SC-8

SEQ ID NO: 5204 - protein, 313 aa, Chrysosporium lucknowense
MKLLGKLSAALALAGSRLAAAHPVFDELMRPTAPLVRPRAALQQVTNFGSNPSNTKMFIYVPDKLAPNPPIIVAIHYCTGTAQAYYSGSPYARLADQKGFIVIYPESPYSGTCWDVSSRAALTHNGGGDSNSIANMVTYTLEKYNGDASKVFVTGSSSGAMMTNVMAAAYPELFAAGIAYSGVPAGCFYSQSGGTNARNSSCANGQINSTPQVWAKMVFDMYPEYDGPRPKMQIYHGSADGTLRPSNYNETIKQWCGVFGFDYTRPDTTQANSPQAGYTTYTWGEQQLVGIYAQGVGHTVPIRGSDDMAFFGL

SEQ ID NO: 5205 - protein, 384 aa, Chrysosporium lucknowense
MRTLTFVLAAAPVAVLAQSPLWGQCGGQGWTGPTTCVSGAVCQFVNDWYSQCVPGSSNPPTGTTSSTTGSTPAPTGGGGSGTGLHDKFKAKGKLYFGTEIDHYHLNNNALTNIVKKDFGQVTHENSLKWDATEPSRNQFNFANADAVVNFAQANGKLIRGHTLLWHSQLPQWVQNINDRNTLTQVIENHVTTLVTRYKGKILHWDVVNEIFAEDGSLRDSVFSRVLGEDFVGIAFRAARAADPNAKLYINDYNLDIANYAKVTRGMVEKVNKWIAQGIPIDGIGTQCHLAGPGGWNTAAGVPDALKALAAANVKEIAITELDIAGASANDYLTVMNACLQVSKCVGITVWGVSDKDSWRSSSNPLLFDSNYQPKAAYNALINAL

SEQ ID NO: 5206 - protein, 413 aa, Chrysosporium lucknowense
MHSKAFLAALLAPAVSGQLNDLAVRAGLKYFGTALSESVINSDTRYAAILSDKSMFGQLVPENGMKWDATEPSRGQFNYASGDITANTAKKNGQGMRCHTMVWYSQLPSWVSSGSWTRDSLTSVIETHMNNVMGHYKGQCYAWDVINEAINDDGNSWRDNVFLRTFGTDYFALSFNLAKKADPDTKLYYNDYNLEYNQAKTDRAVELVKMVQAAGAPIDGVGFQGHLIVGSTPTRSQLATALQRFTALGLEVAYTELDIRHSSLPASSSALATQGNDFANVVGSCLDTAGCVGVTVWGFTDAHSWIPNTFPGQGDALIYDSNYNKKPAWTSISSVLAAKATGAPPASSSTTLVTITTPPPASTTASSSSSATPTSVPTQTRWGQCGGIGWTGPTQCESPWTCQKLNDWYWQCL

SEQ ID NO: 5207 - protein, 278 aa, Chrysosporium lucknowense
MVALSSLLVAASAAAVAVAAPSEALQKRQTLTSSQTGFHDGFYYSFWTDGAGNVRYTNEAGGRYSVTWSGNNGNWVGGKGWNPGAARNISFTGQYNPNGNSYLAVYGWTRNPLIEYYIVENFGTYDPSTGAQRLGSITVDGSTYNILKTTRVNQPSIEGTSTFDQFWSVRTNKRSSGSVNVKAHFDAWAQAGLRLGTHDYQIMATEGYFSSGSATITVGEGTSSGGGGDNGGGNNGGGGNTGTCSALYGQCGGQGWTGPTCCSQGTCRVSNQWYSQCL

SEQ ID NO: 5208 - protein, 876 aa, Chrysosporium lucknowense
MRSLLVLAAIGLAAAEDGLNGWLRYARIKGARDFHDRLPSTIVALNATEGLPVYTAGQELAQGIEGIFGKKVDLDVDLATAGAGKSNGKGKGNGKGKGKGNNGHGHDRDTTATVGTVAAYVDSNPGAAAAGIPELADDGFYLRVSRGNVLILGQNERGALYGAFHYLSLLAQGNASDYTLASNPDAPIRWVNQWDNMQDGGTHGSVERGYGGDSIFFWDGKVRDDLTRAGLYARLLASIGVNAVVVNNVNADPKTLTPENMDGLARIANAFRPYGVQLGVSLNFASPQTLGGLDSFDPLDERVVEWWRDITDALYERIPDMAGYLVKASSEGQPGPLTYNRTLADGANLFARALKPHGGRVLFRAFVYDHTSLDEDKDWKADRAKAAVEYFDGLDGKFEDNVVIQIKYGPIDFQVREPASPLFSRLVRTASALELQITQEYLGQQAHLVYLAPMWKEILDFDFRVDGRPSRTADILNGKRFGRRRAGGYAGVANVGTNTTWLGSHLAMSNLYAFGRLAWDPSSEPESVLRDWIRLTFGDDPKVLDVITRMSMASWPAYENYSGNLGIQTLTDILLGHYGPNPASQDGNPWGQWTRADADSIGMDRTVWNGTGFSGQYPPEVAARFERIETTPDELLLWFHHVPYTHVLKSGKTVIQHFYDAHYEGSAVAQTFPRLWETLRGRVDDERFEHVLFRLEYQAGHALVWRDSINNFYFNKSGIPDARGRVGHHPYRIEAEHMRLDGYVPYDVSPFEAASGARCVVTRDNSTATAATASVELRHVPTGTYDVAVNYYDMAIGNSTWELYIGRRRVGRWKGDLEYNLGRAPSPYIDGQTAARVTFRRVHIERGSTLKIVGRPDGLEPAPIDYVSILPLGIVD

SEQ ID NO: 5209 - protein, 291 aa, Chrysosporium lucknowense
MLVRSFLGFAVLAATCLAASLQEVTEFGDNPTNIQMYIYVPDQLDTNPPVIVALHPCGGSAQQWFSGTQLPSYADDNGFILIYPSTPHMSNCWDIQNPDTLTHGQGGDALGIVSMVNYTLDKHSGDSSRVYAMGFSSGGMMTNQLAGSYPDVFEAGAVYSGVAFGCAAGAESATPFSPNQTCAQGLQKTAQEWGDFVRNAYAGYTGRRPRMQIFHGLEDTLVRPQCAEEALKQWSNVLGVELTQEVSGVPSPGWTQKIYGDGTQLQGFFGQGIGHQSTVNEQQLLQWFGLI

SEQ ID NO: 5210 - protein, 206 aa, Corynebacterium accolens ATCC 49725
MGRHSAKTNHFAAKFTAGTVALGAAAAIMAPNAAAAPDSDWDRLAQCESGGDWHINTGNGYHGGLQFNAQTWQAYGGGEFAPTANQATREQQIVIAERTLANQGWGAWPACSASLGLNSAPTERTAPSAPAEAPQPVQQAVENKSDELAVDAVYNLIKDTANAYGLQLPAQFTDFYHANRHDFDAFYSANRNVIDPVAQLVENFSR

SEQ ID NO: 5211 - protein, 391 aa, Corynebacterium accolens ATCC 49725
MAPHHIKRINNSRSLPLRLATGGVLSTLAVGGVVAVAAQKDLVVDVNGDKVELATFAKDVDGVLQAAGVQVGEEDIVSPAPSESVADGDEISVRTAKPVAVSIDGEQQQLSTTDLTVSDLLNNLQGVNPGAAVKSGEDDVDKDAQLKDGMDLEVVSPKIIKINDGGKNTYTKIAAKTVGDVLKERGIKLGEDDRVFPAKEEKVTEGMSIKVERIDIQTEDVTEEFDAEPNFVDDPELEAGAEEVREQGEKGKREITRKVVLKNGKKESEEVIKDEVVVGPKPATIARGTKQAEPEPQGGNSGAAAPAVADGSVWDAIAQCESNGNWSINTGNGFSGGLQFAPSTWAGLGGTEYAPEAWQATREQQIAVAQKVQAAQGWGAWPACTAKLGLR

SEQ ID NO: 5212 - protein, 425 aa, Corynebacterium accolens ATCC 49725
MAGIIHAFGREILDSRGNPTVEAEVFLEDGAHGVAGVPSGASTGVHEAHELRDGGDRYLGKGVQKAVENINEEIGDEIAGLEADDQRLIDQALIKLDGTDNKSRLGANAILGVSIATAKAAAESAALPLYRYIGGPNAHVLPVPMMNILNGGSHADSGVDVQEFMIAPIGAETFTEALSIGAGVYHSLKAVLKDKGLSTGLGDEGGFAPSVDSTRAALDVIVEAIKKAGFEPGKDVALALDVASSEFYEDGKYHFEGGEHTAEEMSKVYEELINEYPIVSIEDPLQEDDWEGYTTLTAAIGDKVQIVGDDFFVTNPARLQEGIDKKAANALLVKVNQIGTLTETFDAVELAHRNGYRTMMSHRSGETEDTTIADLAVALNCGQIKTGAPARSERVAKYNQLLRIEQELGDAAVYAGRAAFPRFNA

SEQ ID NO: 5213 - protein, 1363 aa, Corynebacterium accolens ATCC 49725
MVTVPGVKAEAAEPTDFTPNSTLGNELKKEEKDPQHFAADYSWGLLVWAGEPAGPGFNNGGNKNNDVGWAWCIEPHAKTPLNTFEAYKKKNATKLEFDERYHDAVINLGRKMEAAAVRGDKKSAANYYVYLLMFLNSPQNPKYLPFKTIVGNSKDYFPGFTGSHEDFTALTGYKIEGTEAMPQLVKDSTVEIAKQPADAFITVVHPNNKRNSKAQSVIPVDQPGLPDEPDNGGNSEEPTTSSEENPSDETTPENPGGETSPNETTENPEPSDSEETTPKDTTSETTPDKTTDVVPNPEPTPTTSEQQKDLEPKIETEASIKDGNRVEKGATVIDTVTYEDLVPGKHYTLKAKLISKADGKTVLGESSTELVPDESAGKKDVEIVVNDKADPAVDSAVAFEKLVSTEVDKDGKDTSNSTDENTIATHENINDEKQTVNTEWKPEIHTNADFDNATQVKAGVTVKDTVEYTDLVPGKEYTLKAELRNKAVNDKGEHEVVGKGEATFTPDKSAGEQVVDIKVKDDVEGVIKAAVAFEDLYSKQVDENGKETPSSDEEKIAEHRDIEDEAQTVTSKMKPSIGTKAEKAEGDEIKSGTVITDKVEYQDLVPGKEYTLNAELRSKVKDENGDYAVIGHGEKTFVPSASKGSEEVEITVDEGVIETVDEAVAFEYLTSTAVNKDGEDSNTGKKNDIADHTDINDKDQTVKSEKPSETTTPQTTTTTEEIPGKPGDGGEGETSAPSSEDSSTPKTSETCESEEPGDSESEKPSESEEPSSSESSEPSESESVETTSSEASETSESDKPSDCESTTPSKPDEPGEPTDGNDEKTPKVSTNADFEGDLREVVAGAKVVDQVSYEGLVPNKEYALDAQLISKEDRKTVLGETKGHKFTPKSANGTEAVTIVVNEDVTEPVEAAVAFETLTSTEVDKHGENKPTDEDNPNHVGEHKDINDDDQTVTSEGSEKTPKITTNADFEEGSHAVIAGAKIVDEITYEGLVPGKEYTLNAELINKQDGMTVLGAGDKTFVPEKSAGSVEVEITVDDDVTEPVEAAVAFEELTSIQVDKNGEETPDVEQPNEIAEHKDIDDADQTVISHGDEDTTSSEDEPWISTNADFAHGSHEVVAGAEVVDEVSYEGLVPGKEYTLNAELINKQDGMTVLGTGHKTFVPEKSTGSVEVEITVNDDVTEPVEAAVAFEELTSTQVDKNGEETPDAEQSNEIAEHKDITDEDQTVASKDSETPGKPSKGKIPWWAILIPGIGLGKIIHDRHHSHDHSTEQPKEQPKDQSEEHSKKQDSEGQGDHNAPESNGEDKPGDAGQHAGKEHHGSEANGHVPGQTGNPLPSDAGRAEIKSVPSGATQLESGMQSYIQ

SEQ ID NO: 5214 - protein, 109 aa, Corynebacterium accolens ATCC 49725
MRTKKTLLTMAAATLGIAGIAAPAANAAPESAWDQVAACESGGDWHINTGNGYHGGLQFSQQTWAGSGGTQYAPTADQATKEQQIEIAENVLATQGAGAWPNCGGPVAG

SEQ ID NO: 5215 - protein, 206 aa, Corynebacterium accolens ATCC 49726
MGRHSAKTNHFAAKFTAGTVALGAAAAIMAPNAAAAPDSDWDRLAQCESGGDWHINTGNGYHGGLQFNAQTWQAYGGGEFAPTANQATREQQIVIAERTLANQGWGAWPACSASLGLNSAPTERTAPSAPAEAPQPVQQAVENKSDELAVDAVYNLVKDTANAYGLQLPAQFTDFYHANRHDFNAFYSANRNVIDPVAQLVENFSR

SEQ ID NO: 5216 - protein, 391 aa, Corynebacterium accolens ATCC 49726
MAPHHIKRINNSRSLPLRLATGGVLSTLAVGGVVAVAAQKDLVVDVNGDKVELATFAKDVDGALQAAGVQVGEEDIVSPAPSESVADGDEISVRTAKPVAVSIDGEQQQLSTTDLTVSDLLNNLQGVNPGAAVKSGEDDVDKDAQLKDGMDLEVVSPKIIKINDGGKNTYTKIAAKTVGDVLKERGIKLDEEDRVFPAKEEKVTEGMSIKVERIDIQTEDVTEEFDAEPHFVDDPELEAGAEEVREQGEKGKREITRKVVLKNGKKESEEVIKDEVIVGPKPATIARGTKQAEPEPQGGNSGAAAPAVADGSVWDAIAQCESNGNWSINTGNGFSGGLQFAPSTWAGLGGTEYAPEAWQATREQQIAVAQKVQAAQGWGAWPACTAKLGLR

SEQ ID NO: 5217 - protein, 425 aa, Corynebacterium accolens ATCC 49726
MAGIIHAFGREILDSRGNPTVEAEVFLEDGAHGVAGVPSGASTGVHEAHELRDGGDRYLGKGVQKAVENINEEIGDEIAGLEADDQRLIDQALIKLDGTDNKSRLGANTILGVSIATAKAAAESAALPLYRYIGGPNAHVLPVPMMNILNGGSHADSGVDVQEFMIAPIGAETFTEALSIGAGVYHSLKAVLKDKGLSTGLGDEGGFAPSVDSTRAALDVIVEAIKKAGFEPGKDVALALDVASSEFYEDGKYHFEGGEHTAEEMSKVYEELINEYPIVSIEDPLQEDDWEGYTTLTAAIGDKVQIVGDDFFVTNPARLQEGIDKKAANALLVKVNQIGTLTETFDAVELAHRNGYRTMMSHRSGETEDTTIADLAVALNCGQIKTGAPARSERVAKYNQLLRIEQELGDAAVYAGRSAFPRFNA

SEQ ID NO: 5218 - protein, 109 aa, Corynebacterium accolens ATCC 49726; identical to SEQ ID NO: 5214

SEQ ID NO: 5219 - protein, 425 aa, Corynebacterium ammoniagenes DSM 20306
MADILHVFAREIMDSRGNPTVEAEVFLDDGAHGTAGVPSGASTGVHEAHELRDGGDRYQGKGVLKAVENVNEEIADELVGFEADDQRLIDQAMIALDGTENKSRLGANAILGVSIAAAKAAAQSAGLPLYRYIGGPNAHILPVPMMNILNGGAHADSGVDVQEFMIAPIGAETFSEALQVGAEVYHSLKAVIKDKGLSTGLGDEGGFAPSVDSTKAALDLIVEAVEKSGYKLGEDIALALDVASSEFYKDGKYHFEGGEHTAEEMTKVYAELIEQYPIVSIEDPLDEDDWAGYSTLIAAVGEKVQIVGDDLFATNPTRLQRGIDEKAANALLVKVNQIGTLSETFDAVDLAHRNGFRTMMSHRSGETEDTTIADLAVALGCGQIKTGAPARSERVAKYNQLIRIEQELDDAAVYAGRSAFPRFQK

SEQ ID NO: 5220 - protein, 364 aa, Corynebacterium ammoniagenes DSM 20306
MLGTLAVGGVVAVNTQKDVTVDVNGERIELATFSSDIEGALQAAGIDYEGDDLIYPAPSESLDNGESITVRTAKPVAVTVDGEVKTMNSTALTVEDLLGTMDGVLPGAAVLAGNQEADADEKITDGMELEVVSPKIVSIKDGGKVTYTSIAAKTVGDVLQERGIKVDADDRVSPGVDEKLTAGTKIVIDRVETEEFDVTEDFDAEPNYVDDENLAKGEERVVEEGMSGERQRTIKKVTVNGQEESKDVIKETVLTEPKPATIARGTKEEAAKPSGAAAPAVAGGSVWDELAQCEATGDWHINTGNGYSGGLQFNAQTWQAYGGGEYAPEAYQASREQQIAVAEKVQAAQGWGAWPACTSSMGLR

SEQ ID NO: 5221 - protein, 207 aa, Corynebacterium ammoniagenes DSM 20306
MGSHSAKTNSVGTKFAATTIAFGAAAALMAPTAAAAPDSDWDRLAQCESGGDWNINTGNGYHGGLQFSAGTWQAHGGGEFAPTADQASREQQIVVAERTLASQGWGAWPACSSQLGLNSAPTDRSAPAPQPSAPADAPAVVQQSVQNSSSNEVASDQVYKLVVDTLNSYGVQVPSVVTDAYNANRGDFNAFYSANRGTIDPILAQVQ

SEQ ID NO: 5222 - protein, 303 aa, Corynebacterium ammoniagenes DSM 20306
MIKRLFPIAAAALLLAACGSAETTVDTSETTTTETSTVEVFPPHEEVEAPGVTLKLDSVTESDHLMLNAEGVKPGYLPEERQNPSDGAKFITVNTIVTNTGRGSMDLTCGFGIQAHLFNKDGQRYDPVQDLYRVPGNPECNDSLNPGFSIEMSWPFEIPESMEATEFGFANPETNYDDLTLVDVTDASREDTPGTEDSPPAQSPIEEPQAAVEEPSSNVVQSQNEGYYSSPDNPALAEQERLASIPYADGGTCPAYKCGYGTNSQGERNPSSGEIQTLHGCQDGYINDPELCSAVEWVENHEY

SEQ ID NO: 5223 - protein, 424 aa, Corynebacterium amycolatum SK46
MAAIIELNAREILDSRGNPTVEVEVLLEDGAVGRAAVPSGASTGVHEAHELRDGGDRYLGKGVEKAVRAVLEEIEDAIIGLEAEDQRLVDKTMIELDGTENKSRLGANAILGVSMAVAKAAAESAGLDLFRYVGGPNGHVLPVPMMNILNGGAHADSGVDVQEFMIAPIGAPTFKEALRVGAEVYHALKKVIKDKGLSTGLGDEGGFAPSVDSTKAALDLIVEAIEAAGYKLGDDVALALDVASSEFYKDGKYHFEGGEHTAEEMAAVYADLVENYAIVSIEDPLQEDDWEGYTKLTAQIGDKVQIVGDDFFVTNPKRLAEGIEKKAANALLVKVNQIGSLSETFEAVAMAHNAGYKTMMSHRSGETEDTTIADLAVGLNCGQIKTGAPARSERVAKYNQLLRIEEYLGDAAVYAGRSAFPRFK

SEQ ID NO: 5224 - protein, 379 aa, Corynebacterium amycolatum SK46
MSAAKKRHLNRANDGVSTSSKIAAGGLVAAVALGGTVAASNYDTITVEIDGKVEQIATWSKDDKAILEKAGVETAGGDLVQRQGDLTDGGKLVYRSAKPVTMIVDGKPQEHKTNAITTDELIEGLKKQGLISDKDKVEVEKGEISAKGVELDVVRAKNIVLHDDAKDIDLTVPAMTVGDVLAQRGIELREDDTVEPGLDAPVTEGMRIALSRLIDKTITETEEIPAHENIIEDDSMFEDERIVEQEGEPGQVERQVKVTSRDGEELGREVLEEKELKAPGISTIRQGTKSRIAAPAAGYGVWDQLAQCESGGDWAIDTGNGFSGGLQFTDSTWAAYGGTEYAPRASQASREQQIAVAERVQAGQGWGAWPACTASMGLR

SEQ ID NO: 5225 - protein, 108 aa, Corynebacterium amycolatum SK46
MRFSGKFIASAAVAAGMIAAPTAAANAASVSAWDQVAACESGGNWQTNTGNGYYGGLQFSQQTWSGHGGDQYAPTADQATKEQQIEIGERVLASQGAGAWPNCGGPLG

SEQ ID NO: 5226 - protein, 206 aa, Corynebacterium amycolatum SK46
MARHAAKTNTFASTSAKVALTGAILGAGAAIFAPTASAAPDSDWDRLAQCESGGNWHINTGNGYYGGLQFSAGTWNAFGGNEFASTADQASREEQIYVAEKVLAQQGWGAWPACSASLGLSSGPTDRPHPSQGAAPVRAQAAPAAAASDSKTDLIQQFADRLSNVDSLSDAQALIAEFRALTGQVELPQELVAAIPFDLSKLQGLI

SEQ ID NO: 5227 - protein, 220 aa, Corynebacterium aurimucosum
  strain ATCC 700975 / DSM 44827 / CN-1
MGRHSAKNKSIATKFAASTVAVGAAAAIMAPNAAAAPDSDWDRLAQCESGGNWAINTGNGYHGGLQFNAQTWQAYGGGEFAPTANLATREQQIAVAERTLAQQGWGAWPACSASLGLNSAPTPRNVSAAPAPAATQVKEETAPQAPAEAPKAVHEAAEEPTDELAVDALYTLIEDTATQYGLTIPASFTEQYKANRHDFNAFYSANRHVIDPLAQVLAAR

SEQ ID NO: 5228 - protein, 382 aa, Corynebacterium aurimucosum
  strain ATCC 700975 / DSM 44827 / CN-1
MSPKKQIKRINNSRSLPLRMATGGVLGTLAVGGVVAVGAQKDITLDVNGETTELATFAGDVNAALEAAGVNVGGEDVVYPALSEQVSDGDSITVRTAKPVAVTIDGVEKQLSSTDLTVSDLLGGLDGIAPGAAITSGSKTVKEDETVTEGMNLEVTSPKIIKLSDGGSVSYASVAAKTVEDVLEARGITVGKDDRVSPALDTPVKAGTAITVDRVEISEEEKMEDFDAPANFVDDPELEEGTEEVREEGTPGSRTVTRKIVKVNGKEESNEIIKEDVRNEAVAAVIARGTKPKSTAPAVAEGSVWDALAQCEATGNWSINTGNGFSGGLQFTPSTWAAFGGTEYAPQAWQASREQQIAVAQKVQAAQGWGAWPACTSKLGLR

SEQ ID NO: 5229 - protein, 105 aa, Corynebacterium aurimucosum
  strain ATCC 700975 / DSM 44827 / CN-1
METVTETAVATGTDADDAQQPADTAAVGDAGNAVDSGKLTGDEAFEKALAHAGVDAQAVTEKEVDYDDGDDGKGPHWEIEFKANGQEHELGVDAASGAVTQHEVD

SEQ ID NO: 5230 - protein, 425 aa, Corynebacterium aurimucosum
  strain ATCC 700975 / DSM 44827 / CN-1
MADIIHVMAREILDSRGNPTVEAEVFLDDGARGVAGVPSGASTGVHEAHELRDGGDRYLGKGVLKAVENVNEEIADELAGFEADDQRLIDQALIKLDGTENKSRLGANAILGVSIAAAKAAAESAGLPLYRYVGGPNAHVLPVPMMNIVNGGAHADSGVDVQEFMIAPIGAESFSEALRIGAEVYHALKSVIKSKGLSTGLGDEGGFAPEAESTKAALDLIIEAIKKAGFEPGKDVALALDVASSEFFKDGKYHFEGGEHTAEEMAKVYEELVAKYPIVSIEDPLQEDDWEGYTKLTETLGDKVQIVGDDFFVTNPARLQEGIDKKAANALLVKVNQIGTLTETFDAVELAHRNGYRTMMSHRSGETEDTTIADLAVALNCGQIKTGAPARSERVAKYNQLLRIEQELGDAAVYAGRSAFPRFQG

SEQ ID NO: 5231 - protein, 425 aa, Corynebacterium casei UCMA 3821
MADILHVFAREIMDSRGNPTVEAEVFLDDGAHGTAGVPSGASTGVHEAHELRDGGDRYKGKGVLKAVENVNEEIADEIVGFEADDQRLIDQAMIALDGTDNKSRLGANAILGVSIAAAKAAAQSAGLPLYRYIGGPNAHILPVPMMNIVNGGAHADSGVDVQEFMIAPIGAETFSEALQVGAEVYHTLKSVIKDKGLSTGLGDEGGFAPSVDSTKAALDLIVEAVEKSGYKLGEDVALALDVASSEFYKDGKYHFEGGEHTAEEMSKVYAELIEQYPIVSIEDPLDEDDWAGYTALIAEVGDKVQIVGDDLFATNPERLQKGIDEKAANALLVKVNQIGTLSETFDAVDLAHRNGFRTMMSHRSGETEDTTIADLAVALGCGQIKTGAPARSERVAKYNQLIRIEQELDDAAVYAGRSAFPRFNK

SEQ ID NO: 5232 - protein, 210 aa, Corynebacterium casei UCMA 3821
MGRHSAKTNSVGTKFAATTVAFGAAAALMAPTAAAAPDSDWDRLAQCESGGNWSINTGNGYHGGLQFSASTWQAFGGGEFAATANQASREQQIVVAERTLAQQGWGAWPACSAGLGLNSAPTERTAPSQESSAPAVPADAPAAVQQSAQNSSSDEVASDAVYSLVVDTLSNYGVQVPSVVTEAYKANRSDFNAFYSANRGTIDPIVALAG

SEQ ID NO: 5233 - protein, 382 aa, Corynebacterium casei UCMA 3821
MSTTHHIKRINNTRSLPLRLATGGMLGTLAVGGVVAVNAQKDVTVDVNGELIELATFSTDVEGALQAAGIDYEGEDLIYPAPSESLGNGESITVRTAKPVAVTVDGEEKTMTSTALTVEDLLGTLDSVTPGAAVLTGDKEADAADKITDGMALEVVSPKIISIKDGGKVTYTSIAAKTVGDVLEARGIDVDADDRVSPGLDEEVAAGTQIVVDRVQVKEFELTEDFEAEPHYVDDDNMEKGEERVVEEGMSGERKRAIKQVFVNGKEESKDVVEENILTEPKPATIARGTKEPSTAPSVADGSVWDSLVQCEATGDWHINTGNGFSGGLQFTPSTWQAFGGGEYAAEAYQASREEQIAVAEKVQAAQGWGAWPACTAKMGLR

SEQ ID NO: 5234 - protein, 560 aa, Corynebacterium diphtheriae
MSRKLFASILIGALLGIGAPPSAHAGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 5235 - protein, 536 aa, Corynebacterium diphtheriae
MGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 5236 - protein, 538 aa, Corynebacterium diphtheriae
MSRKLFASILIGALLGIGAPPSAHAGADDVVDSSKSFVMENFSSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLG

SEQ ID NO: 5237 - protein, 207 aa, Corynebacterium diphtheriae
  strain 241
MARHARKTASTKAKFAASTVAFGTAATLLAPTASAAPDSDWDRLAGCEAGGNWAINTGNGFFGGLQFTASTWNAYGGGQYAPTANGATREQQIAVAEKVLAGQGWGAWPACSAKLGLNSAPTPRDVVANAPAPVQAAVAGAQEYAAQAGLNTEELAVDALYNAIKVRLAGTGLGIPPQIEAFYQANRTNFNGFYMANRGAIDFIFSM

SEQ ID NO: 5238 - protein, 109 aa, Corynebacterium diphtheriae
  strain 241
MRFSAKKTALIVAATGGLAAAIAPAAGAASVSQWDQVAACESGGNWQINTGNGYYGGLQFSAETWAGAGGTAYAPTADQATKEQQIEIAENVLAMQGSGAWPNCGGPLG

SEQ ID NO: 5239 - protein, 385 aa, Corynebacterium diphtheriae
  strain 241
MGNRQKAKINKGASSRAVPMRIVAGGVIASLAVGGVTAQQLKKDITVDLNGEHISLATFSRDVDGVLRQAGVNVGEKDLVYPAPSETVADNDTVTVRTSKQVSVVIDGVKKDVTTNAITVEELFSQLNDVPAALSSASLNVEKGARIPAEGMALDVVTPKIISLTTGDKTVFTQIAAATVADVLKERGIDVDADDVVMPALDTAVSKDMNIKVDKVDSREEKITEKFDEPATYIEDAEQLEGEETLVTPGTQGERTVTRKIVTVNGVETANEVVNEEIITPGVAATIKRGAKKPTTASAAAVASGSVWDQLAQCESGGNWSINTGNGFTGGLQFVDSTWLGLGGGVYAPQAYLATREQQIAIAEKVLAAQGWGAWPACTAKLGLR

SEQ ID NO: 5240 - protein, 425 aa, Corynebacterium diphtheriae
  strain 241
MADIMHVFAREILDSRGNPTVEAEVFLDDGSHGVAGVPSGASTGVHEAHELRDGGERYLGKGVLNAVNNVNEEIADAIAGAEADDQRLIDQAMIALDGTENKSRLGANAILGVSIAVAKAAAESAGLPLYRYIGGPNAHVLPVPMMNIVNGGAHADSGVDVQEFMIAPIGAESFSEALRMGAEVYHSLKSVIKSKGLSTGLGDEGGFAPSVESTKAALDLIVEAIEKAGFKPGADIALALDVASSEFYKDGKYHFEGGEHTAEEMAKVYEQLIAEYPIVSIEDPLQEDDWEGYTALTAAIGDKVQIVGDDFFVTNPARLKEGIEKKAANALLVKVNQIGTLTETFDAVDLAHRNGYRTMMSHRSGETEDTTIADLAVALGCGQIKTGAPARSERVAKYNQLLRIEQQLDDAAVYAGRSAFPRFQG

SEQ ID NO: 5241 - protein, 169 aa, Corynebacterium diphtheriae
  strain 241
MRFFYDTEFIEDGETIDLVSIGIVCEDGREYYAVSTDADHSRANKWVRDNVLDKMPNPSSTLWKSNATIRQEVYEFLTSTPGNTELWAWVGAYDHVVLAQLWGDMRGLPKELPRYTHELKQYWEMAGRPRLPKLPEGNHDALVDARHNLQKFKICAESLPLNKRNVVNR

SEQ ID NO: 5242 - protein, 560 aa, Corynebacterium diphtheriae; identical to SEQ ID NO: 5234
  strain 31A

SEQ ID NO: 5243 - protein, 169 aa, Corynebacterium diphtheriae
  strain 31A
MRFFYDTEFIEDGKTIDLVSIGIVCEDGREYYAVSTDADHSRANKWVRDNVLDKMPNPSSTLWKSNATIRQEVYEFLTSTPGNTELWAWVGAYDHVVLAQLWGDMRGLPKELPRYTHELKQYWEMAGRPRLPKLPEGNHDALVDARHNLQKFKICAESLPLNKRNVVNR

SEQ ID NO: 5244 - protein, 207 aa, Corynebacterium diphtheriae; identical to SEQ ID NO: 5237
  strain 31A

SEQ ID NO: 5245 - protein, 109 aa, Corynebacterium diphtheriae; identical to SEQ ID NO: 5238
  strain 31A

SEQ ID NO: 5246 - protein, 385 aa, Corynebacterium diphtheriae; identical to SEQ ID NO: 5239
  strain 31A

SEQ ID NO: 5247 - protein, 425 aa, Corynebacterium diphtheriae; identical to SEQ ID NO: 5240
  strain 31A

SEQ ID NO: 5248 - protein, 560 aa, Corynebacterium diphtheriae; identical to SEQ ID NO: 5234
  strain ATCC 27012 / C7 beta

SEQ ID NO: 5249 - protein, 169 aa, Corynebacterium diphtheriae; identical to SEQ ID NO: 5241
  strain ATCC 27012 / C7 beta

SEQ ID NO: 5250 - protein, 207 aa, Corynebacterium diphtheriae; identical to SEQ ID NO: 5237
  strain ATCC 27012 / C7 beta

SEQ ID NO: 5251 - protein, 385 aa, Corynebacterium diphtheriae
  strain ATCC 27012 / C7 beta
MGNRQKAKINKGASSRAVPMRIVAGGVIASLAVGGVTAQQLKKDITVDLNGEHISLATFSRDVDGVLKQAGVNVGEKDLVYPAPSETVADNDTVTVRTSKQVSVVIDGVKKDVTTNAITVEELFSQLNDVPAALSSASLNVEKGARIPAEGMSLDVVTPKIISLTTGDKTVFTQIAAATVADVLKERGIDVDTDDVVMPALDTAVSKDMNIKVDKVDSREEKITEKFDEPATYIDDAEQLEGEETLVTPGTQGERTVTRRIVTVNGAETANEVVNEEIITPGVAATIKRGTKKPTTASAAAVASGSVWDQIAQCESGGNWSINTGNGFTGGLQFVDSTWLGLGGGVYAPQAYLATREQQIAIAEKVLAAQGWGAWPACTAKLGLR

SEQ ID NO: 5252 - protein, 425 aa, Corynebacterium diphtheriae
  strain ATCC 27012 / C7 beta
MADIMHVFAREILDSRGNPTVEAEVFLDDGSHGVAGVPSGASTGVHEAHELRDGGERYLGKGVLNAVNNVNEEIADAIAGAEADDQRLIDQAMIALDGTENKSRLGANAILGVSIAVAKAAAESAGLPLYRYIGGPNAHVLPVPMMNIVNGGAHADSGVDVQEFMIAPIGAESFSEALRMGAEVYHSLKSVIKSKGLSTGLGDEGGFAPSVESTKAALDLIVEAIEKAGFKPGADVALALDVASSEFYKDGKYHFEGGEHTAEEMAKVYEQLIAEYPIVSIEDPLQEDDWEGYTALTAAIGDKVQIVGDDFFVTNPARLKEGIEKKAANALLVKVNQIGTLTETFDAVDLAHRNGYRTMMSHRSGETEDTTIADLAVALGCGQIKTGAPARSERVAKYNQLLRIEQQLDDAAVYAGRSAFPRFQG

SEQ ID NO: 5253 - protein, 109 aa, Corynebacterium diphtheriae; identical to SEQ ID NO: 5238
  strain ATCC 27012 / C7 beta

SEQ ID NO: 5254 - protein, 109 aa, Corynebacterium diphtheriae; identical to SEQ ID NO: 5238
  strain ATCC 700971 / NCTC 13129 / Biotype gravis

SEQ ID NO: 5255 - protein, 169 aa, Corynebacterium diphtheriae; identical to SEQ ID NO: 5241
  strain ATCC 700971 / NCTC 13129 / Biotype gravis

SEQ ID NO: 5256 - protein, 425 aa, Corynebacterium diphtheriae; identical to SEQ ID NO: 5240
  strain ATCC 700971 / NCTC 13129 / Biotype gravis

SEQ ID NO: 5257 - protein, 385 aa, Corynebacterium diphtheriae; identical to SEQ ID NO: 5239
  strain ATCC 700971 / NCTC 13129 / Biotype gravis

SEQ ID NO: 5258 - protein, 207 aa, Corynebacterium diphtheriae; identical to SEQ ID NO: 5237
  strain ATCC 700971 / NCTC 13129 / Biotype gravis

SEQ ID NO: 5259 - protein, 560 aa, Corynebacterium diphtheriae; identical to SEQ ID NO: 5234
  strain ATCC 700971 / NCTC 13129 / Biotype gravis

SEQ ID NO: 5260 - protein, 968 aa, Corynebacterium diphtheriae
  strain BH8
MKDLSPRKRYGGLPLRAALALCTASALFLGIVVPGGFPVEAAQEVAEIDGAEDTARPEATPEDAAPSAVDPADSDASKVGSPAAPPAKPSDAKPEKVPAPENLQAPTEEGEPAPASSVSRLIGGDWRKKIVEKNPPMPQRCGLRIALVFDLSNSVGENGLENTKISGQKLIKDLSYTPTTIGIFNFGTEAPVANTKDEPRLDLTNPSDVQTALSTIQKFDYGNHNHSKDDPYTDSGGTNWEGALRNVRKAGVHYDVVYFVTDGVPTTNIKHLPENVDGKVLDGKTHDTGRVTHNGDITLAMEEANKIKEGGTRIEVIAVGSFDGKVPVLRDNVQYDGLTRWTRTDTIWSNAAEVRSGTFWAVPTGSQIREPDLRSVFEKRVKAGVLDYFHTHEKADYYVFRLEDELSSVPTGEPFSENIRVYDYRQKRNVNKLFEGNVYRSNYAVGHDIMQKISGPAAEDVHFISNYDQLATTLRDLATESCESALTVQKQIVDEHGEIIDANPKGWKFTDTDIEGNLEVIRRDGVSGNEQFTDESGLVSYNFKSQSRRQNGTLTITETQKDGFELKKVGSDNAKCTEVDITSNSASSAKSIKIENRGDLGFNVGIGTGKTVHCIVQNMKLDNTFKIKKVPHPDQDKDTDGDQLKAPVNTENEVTAYYDVEVTSNARRKLKLHAPVVDTMTFPQGMTIKNIEFFMGNKKIDDPALIAMKASMAPNVANFEFMPALFDEFEAQQMKKVEVRVTASVDERTRLSISDESYERCESSTPRTADRPKSMFNAVRLEGESEGEDPTFNNQACVDPELKLVDFTVQKIDGSDERVPLEGAEFTIFSGDAAVPQSWKEVVRMQPKPGEASTLVLPKGANVTPGKYLLVETKAPKSADGRQYSLLVRPITFMVDVKGGKTEVEILDGTPVATVDSDNLSIIRVVNVYVGTLPQTGGAGVGIIALLGMLLTLAGAFFARRSRGTSQA

SEQ ID NO: 5261 - protein, 207 aa, Corynebacterium diphtheriae; identical to SEQ ID NO: 5237
  strain BH8

SEQ ID NO: 5262 - protein, 109 aa, Corynebacterium diphtheriae; identical to SEQ ID NO: 5238
  strain BH8

SEQ ID NO: 5263 - protein, 385 aa, Corynebacterium diphtheriae; identical to SEQ ID NO: 5239
  strain BH8

SEQ ID NO: 5264 - protein, 425 aa, Corynebacterium diphtheriae
  strain BH8
MADIMHVFAREILDSRGNPTVEAEVFLDDGSHGVAGVPSGASTGVHEAHELRDGGERYLGKGVLNAVNNVNEEIADAIAGAEADDQRLIDRAMIALDGTENKSRLGANAILGVSIAVAKAAAESAGLPLYRYIGGPNAHVLPVPMMNIVNGGAHADSGVDVQEFMIAPIGAESFSEALRMGAEVYHSLKSVIKSKGLSTGLGDEGGFAPSVESTKAALDLIVEAIEKAGFKPGADIALALDVASSEFYKDGKYHFEGGEHTAEEMAKVYEQLIAEYPIVSIEDPLQEDDWEGYTALTAAIGDKVQIVGDDFFVTNPARLKEGIEKKAANALLVKVNQIGTLTETFDAVDLAHRNGYRTMMSHRSGETEDTTIADLAVALGCGQIKTGAPARSERVAKYNQLLRIEQQLDDAAVYAGRSAFPRFQG

SEQ ID NO: 5265 - protein, 169 aa, Corynebacterium diphtheriae
  strain BH8
MRFFYDTEFIEDGETIDLVSIGIVCEDGREYYAVSTDADHSRANKWVRDNVLDKMPNPSSTLWKSNATIRQEVYEFLTSTPGNTELWAWVGAYDHVVLAQLWGDMRGLPKELPRYTHELKQYWEMAGRPRLPKLPEGNHDALVDARHNLQKFKICAESLPLNKRNVVNG

SEQ ID NO: 5266 - protein, 560 aa, Corynebacterium diphtheriae; identical to SEQ ID NO: 5234
  strain CDCE 8392

SEQ ID NO: 5267 - protein, 169 aa, Corynebacterium diphtheriae
  strain CDCE 8392
MRFFYDTEFIEDGETIDLVSIGIVREDGREYYAVSTDADHSRANKWVRDNVLDKMPNPSSTLWKSNATIRQEVYEFLTSTPGNTELWAWVGAYDHVVLAQLWGDMRGLPKELPRYTHELKQYWEMAGRPRLPKLPEGNHDALVDARHNLQKFKICAESLPLNKRNVVNG

SEQ ID NO: 5268 - protein, 207 aa, Corynebacterium diphtheriae; identical to SEQ ID NO: 5237
  strain CDCE 8392

SEQ ID NO: 5269 - protein, 385 aa, Corynebacterium diphtheriae; identical to SEQ ID NO: 5251
  strain CDCE 8392

SEQ ID NO: 5270 - protein, 109 aa, Corynebacterium diphtheriae; identical to SEQ ID NO: 5238
  strain CDCE 8392

SEQ ID NO: 5271 - protein, 425 aa, Corynebacterium diphtheriae
  strain CDCE 8392
MADIMHVFAREILDSRGNPTVEAEVFLDDGSHGVAGVPSGASTGVHEAHELRDGGERYLGKGVLNAVNNVNEEIADAIAGAEADDQRLIDQAMIALDGTENKSRLGANAILGVSIAVAKAAAESAGLPLYRYIGGPNAHVLPVPMMNIVNGGAHADSGVDVQEFMIAPIGAESFSEALRMGAEVYHSLKSVIKSKGLSTGLGDEGGFAPSVESTKAALDLIVEAIEKAGFKPGADIALALDVASSEFYKDGKYHFEGGEHTAEEMAKVYEQLIAEYPIVSIEDPLQEDDWEGYTALTAAIGDKVQIVGDDFFVTNPARLKEGIEKRAANALLVKVNQIGTLTETFDAVDLAHRNGYRTMMSHRSGETEDTTIADLAVALGCGQIKTGAPARSERVAKYNQLLRIEQQLDDAAVYAGRSAFPRFQG

SEQ ID NO: 5272 - protein, 169 aa, Corynebacterium diphtheriae; identical to SEQ ID NO: 5241
  strain HC01

SEQ ID NO: 5273 - protein, 207 aa, Corynebacterium diphtheriae; identical to SEQ ID NO: 5237
  strain HC01

SEQ ID NO: 5274 - protein, 109 aa, Corynebacterium diphtheriae; identical to SEQ ID NO: 5238
  strain HC01

SEQ ID NO: 5275 - protein, 385 aa, Corynebacterium diphtheriae; identical to SEQ ID NO: 5239
  strain HC01

SEQ ID NO: 5276 - protein, 425 aa, Corynebacterium diphtheriae; identical to SEQ ID NO: 5240
  strain HC01

SEQ ID NO: 5277 - protein, 169 aa, Corynebacterium diphtheriae; identical to SEQ ID NO: 5241
  strain HC02

SEQ ID NO: 5278 - protein, 207 aa, Corynebacterium diphtheriae; identical to SEQ ID NO: 5237
  strain HC02

SEQ ID NO: 5279 - protein, 385 aa, Corynebacterium diphtheriae; identical to SEQ ID NO: 5239
  strain HC02

SEQ ID NO: 5280 - protein, 425 aa, Corynebacterium diphtheriae; identical to SEQ ID NO: 5240
  strain HC02

SEQ ID NO: 5281 - protein, 109 aa, Corynebacterium diphtheriae; identical to SEQ ID NO: 5238
  strain HC02

SEQ ID NO: 5282 - protein, 385 aa, Corynebacterium diphtheriae; identical to SEQ ID NO: 5239
  strain HC03

SEQ ID NO: 5283 - protein, 425 aa, Corynebacterium diphtheriae; identical to SEQ ID NO: 5264
  strain HC03

SEQ ID NO: 5284 - protein, 169 aa, Corynebacterium diphtheriae; identical to SEQ ID NO: 5241
  strain HC03

SEQ ID NO: 5285 - protein, 207 aa, Corynebacterium diphtheriae
  strain HC03
MARHARKTASTKTKFAASTVAFGTAATLLAPTASAAPDSDWDRLAGCEAGGNWAINTGNGFFGGLQFTASTWNAYGGGQYAPTANGATREQQIAVAEKVLAGQGWGAWPACSAKLGLNSAPTPRDVVANAPAPVQAAVAGAQEYAAQAGLNTEELAVDALYNAIKVRLAGTGLGIPPQIEAFYQANRTNFNGFYMANRGAIDFIFSM

SEQ ID NO: 5286 - protein, 109 aa, Corynebacterium diphtheriae; identical to SEQ ID NO: 5238
  strain HC03

SEQ ID NO: 5287 - protein, 207 aa, Corynebacterium diphtheriae; identical to SEQ ID NO: 5237
  strain HC04

SEQ ID NO: 5288 - protein, 385 aa, Corynebacterium diphtheriae; identical to SEQ ID NO: 5239
  strain HC04

SEQ ID NO: 5289 - protein, 425 aa, Corynebacterium diphtheriae; identical to SEQ ID NO: 5240
  strain HC04

SEQ ID NO: 5290 - protein, 169 aa, Corynebacterium diphtheriae; identical to SEQ ID NO: 5241
  strain HC04

SEQ ID NO: 5291 - protein, 109 aa, Corynebacterium diphtheriae; identical to SEQ ID NO: 5238
  strain HC04

SEQ ID NO: 5292 - protein, 207 aa, Corynebacterium diphtheriae; identical to SEQ ID NO: 5237
  strain INCA 402

SEQ ID NO: 5293 - protein, 385 aa, Corynebacterium diphtheriae
  strain INCA 402
MGNRQKAKINKGASSRAVPMRIVAGGVIASLAVGGVTAQQLKKDITVDLNGEHISLATFSRDVDGVLRQAGVNVGEKDLVYPAPSETVADNDTVTVRTSKQVSVVIDGVKKDVTTNAITVEELFSQLNDVPAALSSASLNVEKGARIPAEGMALDVVTPKIISLTTGDKTVFTQIAAATVADVLKERGIDVDADDVVMPALDTAVSKDMNIKVDKVDSREEKITEKFEEPATYIEDAEQLEGEETLVTPGTQGERTVTRKIVTVNGVETANEVVNEEIITPGVAATIKRGAKKPTTASAAAVASGSVWDQLAQCESGGNWSINTGNGFTGGLQFVDSTWLGLGGGVYAPQAYLATREQQIAIAEKVLAAQGWGAWPACTAKLGLR

SEQ ID NO: 5294 - protein, 425 aa, Corynebacterium diphtheriae; identical to SEQ ID NO: 5240
  strain INCA 402

SEQ ID NO: 5295 - protein, 169 aa, Corynebacterium diphtheriae
  strain INCA 402
MRFFYDTEFIEDGKTIDLVSIGIVCEDGREYYAVSTDADHSRANKWVRDNVLDKMPNPSSTLWKSNATIRQEVYEFLTSTPGNTELWAWVGAYDHVVLAQLWGDMRGLPKELPRYTHELKQYWEMAGRPRLPKLPEGNHDALVDARHNLQKFKICAESLPLNKRNVVNG

SEQ ID NO: 5296 - protein, 109 aa, Corynebacterium diphtheriae
  strain INCA 402
MRFSAQKTALIVAATGGLAAAIAPAAGAASVSQWDQVAACESGGNWQINTGNGYYGGLQFSAETWAGAGGTAYAPTADQATKEQQIQIAENVLAMQGSGAWPNCGGPLG

SEQ ID NO: 5297 - protein, 560 aa, Corynebacterium diphtheriae; identical to SEQ ID NO: 5234
  strain PW8

SEQ ID NO: 5298 - protein, 169 aa, Corynebacterium diphtheriae; identical to SEQ ID NO: 5241
  strain PW8

SEQ ID NO: 5299 - protein, 207 aa, Corynebacterium diphtheriae; identical to SEQ ID NO: 5237
  strain PW8

SEQ ID NO: 5300 - protein, 385 aa, Corynebacterium diphtheriae
  strain PW8
MGNRQKAKINKGASSRAVPMRIVAGGVIASLAVGGVTAQQLKKDITVDLNGEHISLATFSRDVDGVLRQAGVNVGEKDMVYPAPSETVADNDTVTVRTSKQVSVVIDGVKKDVTTNAITVEELFSQLNDVPAALSSASLNVEKGARIPAEGMALDVVTPKIISLTTGDKTVFTQIAAATVADVLKERGIDVDADDVVMPALDTAVSKDMNIKVDKVDSREEKITEKFDEPATYIEDAEQLEGEETLVTPGTQGERTVTRKIVTVNGVETANEVVNEEIITPGVAATIKRGAKKPTTASAAAVASGSVWDQLAQCESGGNWSINTGNGFTGGLQFVDSTWLGLGGGVYAPQAYLATREQQIAIAEKVLAAQGWGAWPACTAKLGLR

SEQ ID NO: 5301 - protein, 425 aa, Corynebacterium diphtheriae; identical to SEQ ID NO: 5240
  strain PW8

SEQ ID NO: 5302 - protein, 109 aa, Corynebacterium diphtheriae; identical to SEQ ID NO: 5238
  strain PW8

SEQ ID NO: 5303 - protein, 169 aa, Corynebacterium diphtheriae; identical to SEQ ID NO: 5241
  strain VA01

SEQ ID NO: 5304 - protein, 207 aa, Corynebacterium diphtheriae; identical to SEQ ID NO: 5237
  strain VA01

SEQ ID NO: 5305 - protein, 385 aa, Corynebacterium diphtheriae; identical to SEQ ID NO: 5239
  strain VA01

SEQ ID NO: 5306 - protein, 425 aa, Corynebacterium diphtheriae; identical to SEQ ID NO: 5240
  strain VA01

SEQ ID NO: 5307 - protein, 1032 aa, Corynebacterium diphtheriae
  strain VA01
MQLNSGMCDGKKTGIKGSMHFKNRHSFHVIFGLLAALFLVFYFSFSSGVLKVKAEEMGSATRPVEDEQGEASTFDLEPKVDEDGLSDTSNDGMSPHAFRAGSLDGEQLVSRMVEPSLPAPYQYPNLYEYAVSVDKKGKANQIILSGDFRLSQQTFNNYAGYFKIYINQQEIPNVEWNVEDGRLTANFSSVPVNPEARIYIRLAGAVWNGSYFEGPYSAMNVSVHGARRLRQKTFLIDPMKGSWTTQTSIPNPPTPKRCGLNIALVFDVSNSLNYQDGVRHSRDAATAVISALKGTPTTLGMYAFATGSPVGDIQPPNSHGNYPKIANVEALDLSTDAGYDQAVGQIRTLRTGEDVGGTNWEAALLRVAEAETRYDIVYFITDGVPTTNEELFPRNLNERLFNGWAGDPGHVTHNVDITRGITAANAVKATGARLETLAVNLPNYEIPVLNDDVRISSNNYGSGRVIRDKSYIFASQESWDRLTRSGYSWVQQRGASSNPLRIYFNNHDTTWSHAQSIVDKLGGADAVTMLENYAALPEKIRKMAMESCEGTVIVEKQIVDDKGEIIPRSVVEGWRFTADAVQSDTDKIWLVDENESPTDQRTTLTNLDGITQYRFKTASPHKSGSVRITETQQEGFVLHQQDGHNARCIVDGKPLSGAQYKDDGELGFRVDISTARVVTCVVQNKFKPTFKVEKTPLEDQNPALDGKQSRAPIDSSGSVVAYYEVKVTNNSINSSELSAPVIDKITFPAEMSVTKVEFYYENRKISDDSHIAAQGAADRPPLTYEIKPALFGTFKGNESKTVEVRVTAMVDKPTQIEIAKKKNGNYQWCESPRPISPDNPRSMFNSVTLAGEHEPPNPQVNNQACVDPEIQMAEISLIKVDSQDNSVVLEGAEFTIFRNSGTVDAPQVGERVLTLGAQPSAKGTLSGTIPVGTYLLVETKAPVGEKGQYELLPQPVPFHVELQSGKTHITILNGHNHPQVTVAESNTAMIKVADVHLGQLPKTGGVGVGLFAAFGALLICIGILLARRKKHY

SEQ ID NO: 5308 - protein, 109 aa, Corynebacterium diphtheriae; identical to SEQ ID NO: 5238
  strain VA01

SEQ ID NO: 5309 - protein, 421 aa, Corynebacterium efficiens
  strain DSM 44549 / YS-314 / AJ 12310 / JCM 11189 / NBRC 100395
MHVFAREIMDSRGNPTVEAEVFLDDGSHGVAGVPSGASTGVHEAHELRDGGDRYLGKGVLKAVENVNEEIGDELAGLEADDQRLIDAAMIKLDGTENKSRLGANAILGVSMAVAKAAADSAGLPLFRYIGGPNAHVLPVPMMNIINGGAHADSGVDVQEFMIAPIGFDSFSEALRAGAEVYHALKKVINEKGLSTGLGDEGGFAPSVESTRAALDLIVEAIKKAGFEPGKDIALALDVASSEFFKDGKYHFEGGEHTAEEMANVYAELVDEYPIVSIEDPLQEDDWDGYVALTAQIGDKVQIVGDDFFVTNPARLKEGIAKKAANSILVKVNQIGTLTETFDAVDMAHRAGYTSMMSHRSGETEDTTIADLAVALNCGQIKTGAPARSDRVAKYNQLLRIEQLLGDAAVYAGRSAFPRFQG

SEQ ID NO: 5310 - protein, 203 aa, Corynebacterium efficiens
  strain DSM 44549 / YS-314 / AJ 12310 / JCM 11189 / NBRC 100395
MFTRKLFTLTAVAGLSLSLAACGDDSGDSDATATETTVVTSEDETTDDPATTEETADNGVATETQTAVSDADATADRDIVFDAIDLVMAEHADGIIIDIDREDDTEAYEIDVVVGEEVIELNVDTAAGEVRESDRDNDDAEDVRRAQEATVTVADAITQALEAHPDGVVDEASLEDEDGRLEWQIDLDDVERNDLAEFTVLAN

SEQ ID NO: 5311 - protein, 425 aa, Corynebacterium efficiens [sequence omitted]

SEQ ID NO: 5312 - protein, 390 aa, Corynebacterium efficiens
  strain DSM 44549 / YS-314 / AJ 12310 / JCM 11189 / NBRC 100395
MAIHQKSRINQLNGTRSVPLRLATGGMLATLLIGGVTVATAKKDVIIDVNGEQIALTTLSGTVEGALEQAGVELGAQDFVSPAPDSSLTSESVVTVRTAKQVALVVDGREETLTTTAVSVEDLLGELDEISPADAIDADPDTTIPDSGLQLKVTKPKIISINDGGRVVYTSIAADTVGEVLERRGITIDEDDRLNLDANHRITTNTEIIIDRVETSEVTETVDIAAPVTYVDDPEADKGTETVVTEGTPGAKEITRQIVTVNGVEAENTVLREVELTAATPTTIKRGTKAAPATVSSSTSGSAAPSVAGGSVWDALAQCESNGNWSINTGNGFSGGLQFHPQTWQAYGGGQYAPTAAGASREQQIAIAQKVQAAQGWGAWPACTAKLGIR

SEQ ID NO: 5313 - protein, 197 aa, Corynebacterium efficiens
  strain DSM 44549 / YS-314 / AJ 12310 / JCM 11189 / NBRC 100395
MLFMGRHSAKTATPFVKMAATTVAFGAAAVAFAPAASAAPDSDWDRLANCESGGNWAINTGNGYHGGLQFSPSTWRAYGGDEFAPFAYQATREQQIAVAERTLAGQGWGAWPACSSKLGLNSAPTPRNLNPAPAPAPAPAAPAEYRATVDTNTNPVVGSSDLNTVQGIYDAVSGTLAQYGVQVPAEIQAHYNAFIGR

SEQ ID NO: 5314 - protein, 230 aa, Corynebacterium efficiens
  strain DSM 44549 / YS-314 / AJ 12310 / JCM 11189 / NBRC 100395
MGVTVRSNNFIWFPEPALGRDRREGVPMFTRKLFTLTAVAGLSLSLAACGDDSGDSDATATETTVVTSEDETTDDPATTEETADNGVATETQTAVSDADATADRDIVFDAIDLVMAEHADGIIIDIDREDDTEAYEIDVVVGEEVIELNVDTAAGEVRESDRDNDDAEDVRRAQEATVTVADAITQALEAHPDGVVDEASLEDEDGRLEWQIDLDDVERNDLAEFTVLAN

SEQ ID NO: 5315 - protein, 612 aa, Corynebacterium genitalium ATCC 33030
MYEVDAGSLLKPNKRSSLGVFQQVRDNPAMPERCGLNVALVVDLSGSMGSNGLRTIQGVVNSVASRLQGTDTNLGLFNFAENSPAKRNGSNLSSPVSVSTQSGQAAIKKWVDGLAIPTEREGQATNWQEALYQVAQYNEQNPSDRYDVVYMITDGNPTVRKDNAFADVRMRFSTADGSATEFRDVEGAIGAANMVKAQGTRIVAVGIPSNWRGVITSRDDQLAVSDENLKAISGGSGYQGRERSLRAADFAQFESSAVMQQAIINSLNTCAITVERRFYEGEDPNGPPTPENTRGTNEETVSGQWSFHSEETPPSGRVTTEDKIPNAWNRRRDNYMSEFALEKQTTYPKVVIREDPSKIPEGWVRMDAEGGKRAQCFDPRGAPVEVNNLPAGGNPAQHPKNTTDDGLTNDFSLTNVPVSGVHCIVYYQAKPADQPFKFKLNKVDSMDNTISLDGAQFALTGLDKDNAGEKKPITVPGAVKGEFHWDKLATGRYELRETKPADHGYVMLSEPVYFRVATAKEGNKEVTKLYLLAGKDDRTGREVADPDKIETFPVTHFGQTKVGNEVQVTMKVANTKGGTLPKTGGHGVYAQMLFGLVLLLTGAFTARRRSAA

SEQ ID NO: 5316 - protein, 406 aa, Corynebacterium genitalium ATCC 33030
MSNSYNPNNPYGSQQPDWTSGGADSSGGSTRYTGGYGAGQYGAGAGQEYGAGQYGAGQYGAGQYGAGQYGAGQYGAGAGQYGTGQYGAGQYGTGAGQQYGVDQSGAGAAAPYEQNQTQSLFQNQGQGQYGFDQPQYGPPQQPGGSKLNILGIISIALAVLGTIMSFFPATLVFGWLLLPIALVVGIIGLVMKDMSKGPAIAGVITAVVGGLIALTVFFVAASSTSDSAAEDAGDAAPADGASAGGAADNGKDKGKSKAKGSDAGKSRENPLPLGSTITQGDWEVTINSVNLDATDEIMEENPFSDEPKDGMVHILVNMTAKYIGDDPQGESPLIFVSYVSPEGKTYESHEVTLVEPDMFDLSTTLYNGADTSGNIGVSIPIEGKEEGTIVVEADLYSGEKVFYAVK

SEQ ID NO: 5317 - protein, 380 aa, Corynebacterium genitalium ATCC 33030
MSRHRRINKNSTTRAVIASGAIGAVVIGGATTAAAAQKTITVDLNGEETELNTFAGSVDGALEAAGVDVGDKDLVHPAPGESLSNGDTVTVRTAKPVGVRIDGGQVQQVTTTAATVNDFLGEMPGVAGGSAHDYSADQRVEDGMTIDVTSPKIVSITDGGKTTYTSAPARTVAELLAARGVVIDSNDRVTPSLNTPVTEDMAVKIERVDITQRTATEEFEADPTYVDDDSLAPGEEKVREKGEKGERKVTRRLVTVNGKVESDDVLKREETRKARPAVIARGKQQAGGNTGASAPAVAGGSVWDSIAQCESGGNWSINTGNGYYGGLQFAASTWSAYGGGQYAPTADQATREQQIAVAEKVQAAQGWGAWPACTASLGIR

SEQ ID NO: 5318 - protein, 425 aa, Corynebacterium genitalium ATCC 33030
MADIMLTYAREIMDSRGNPTVEVEVFLDDGSHGIAAVPSGASTGEHEAHELRDGGDRYGGKGVQNAVTNVNETIADAIAGIEADDQRVLDLAMIELDGSDNKKNLGANAILGVSMANAKAAADSAGLPLYRYIGGPNAHVLPVPMMNILNGGAHADSGVDVQEFMIAPIGADTFTEALRQGAEVYHALKSVIKDKGLSTGLGDEGGFAPSVDSTRAALDLIVEAIEKAGYKPGADIALALDVASSEFFENGSYNFEGGQHSAEEMAKVYAELVEAYPIVSIEDPLDENDWGGYVKLTEELGDKVQIVGDDFFVTNPDRLAKGIEQNAANALLVKVNQIGTLTETFDAVELAHRNRYATMMSHRSGETEDTTIADLAVALSCGQIKTGAPARSERVAKYNRLIRIEEELGPAAVYAGRNAFPRYNK

SEQ ID NO: 5319 - protein, 217 aa, Corynebacterium genitalium ATCC 33030
MGRHRKQNSKAVSAKALAGATAAIATTALVAPTASAAPDSDWDRLAQCEAGGNWHINTGNGYYGGLQFSASTWRAYGGGEFAPYAHQATREQQIAVAERTLASQGWGAWPACSRKLGLNSAPTPRTAPAAKPAPAPKPAAAPQPKKNNELEVDKLYKSLTRELNNRGLNVPPQVEATYKANRNDYNAFYQANKDLIDALLSGDAQAFIAAVNARLPR

SEQ ID NO: 5320 - protein, 231 aa, Corynebacterium genitalium ATCC 33030
MPTGEDAHGSDYFTPVFLLPQLCNSTSAKALAGATAAIATTALVAPTASAAPDSDWDRLAQCEAGGNWHINTGNGYYGGLQFSASTWRAYGGGEFAPYAHQATREQQIAVAERTLASQGWGAWPACSRKLGLNSAPTPRTAPAAKPAPAPKPAAAPQPKKNNELEVDKLYKSLTRELNNRGLNVPPQVEATYKANRNDYNAFYQANKDLIDALLSGDAQAFIAAVNARLPR

SEQ ID NO: 5321 - protein, 214 aa, Corynebacterium glucuronolyticum ATCC 51866
MARHSAPKKTTFAKIAASATAVAAATTIATPAAQAAPDSDWDRLAQCEAGGNWSINTGNGYHGGLQFSPSTWSAHGGREFAPYAYQATREQQIAVAERILASQGWGAWPACSARLGLNSAPTPRNAPSNESSALESTENIVEEVVQSSSDDKLPVDVLFNLVVNRLAAVGIQVPAEVHGMYDFHRQDIQNFYAANAQFIDANLPQVSAAVKNAQ

SEQ ID NO: 5322 - protein, 375 aa, Corynebacterium glucuronolyticum ATCC 51866
MNESTYARPVKIAAGGVLATVVAGGVFAVGNTKTITLDIDGQSTELSTMSASVGDALQSVGFEAKDSDLVSPSPADKLVDGTHITVRSAKPVALVVDGVQHEVTSNALTVSELLQHFNDGEKASITKAAKISSSPEQVIPAGGFTVKVTNPKIVSVDDAGRVVYDSIAAETVGDVLEKRGISLGAEDVVTPSVDTPLKDVSSIKVDRVRTSNVISDEEYTAEPTYTEDPESPEGEETEVSPAEPGRKTVTRKIVFVNGQEVSNEVLQETVTAPSTGAVIARGTKKAPAAASVAAGSVWDSIAQCESGGNWAISTGNGYYGGLQFNVGTWSAYGGGEYAPTANLATRDQQIAIAQKVQAAQGWGAWPACTASLGIR

SEQ ID NO: 5323 - protein, 425 aa, Corynebacterium glucuronolyticum ATCC 51866
MTYIEDLTAREILDSRGNPTVEVDVVLADGAFGRAAVPSGASTGVHEAHELRDGGDRYQGKGVEKAVANVDDKIADAIVGIDATDQRLVDNAMIELDGSENKSNLGANAILGVSMAVARAAAQSADLPLYRYIGGPTANILPVPMMNILNGGAHADSGVDVQEFMIAPIGFDSFREALRAGAEVYHTLKSVIKEKGLSTGLGDEGGFAPSVDSTKAALDLIVEAIKKAGFEPGKDIALALDVASSEFYKDGKYHFEGGEHTAEEMAKVYEDLIANYPIVSIEDPLQEDDWEGYTTLTATIGDKVQIVGDDFFVTNPARLKEGIEKKAANALLVKVNQIGSLTETFDAVEMAHRAGYHTMMSHRSGETEDTTIADLAVALGCGQIKTGAPARSERVAKYNRLLRIEEELGSAAHYAGAEAFPRHNK

SEQ ID NO: 5324 - protein, 214 aa, Corynebacterium glucuronolyticum ATCC 51867; identical to SEQ ID NO: 5321

SEQ ID NO: 5325 - protein, 375 aa, Corynebacterium glucuronolyticum ATCC 51867; identical to SEQ ID NO: 5322

SEQ ID NO: 5326 - protein, 425 aa, Corynebacterium glucuronolyticum ATCC 51867; identical to SEQ ID NO: 5323

SEQ ID NO: 5327 - protein, 425 aa, Corynebacterium glutamicum
MAEIMHVFAREILDSRGNPTVEAEVFLDDGSHGVAGVPSGASTGVHEAHELRDGGDRYLGKGVLKAVENVNEEIGDELAGLEADDQRLIDEAMIKLDGTANKSRLGANAILGVSMAVAKAAADSAGLPLFRYIGGPNAHVLPVPMMNIINGGAHADSGVDVQEFMIAPIGAETFSEALRNGAEVYHALKSVIKEKGLSTGLGDEGGFAPSVGSTREALDLIVEAIEKAGFTPGKDIALALDVASSEFFKDGTYHFEGGQHSAAEMANVYAELVDAYPIVSIEDPLQEDDWEGYTNLTATIGDKVQIVGDDFFVTNPERLKEGIAKKAANSILVKVNQIGTLTETFDAVDMAHRAGYTSMMSHRSGETEDTTIADLAVALNCGQIKTGAPARSDRVAKYNQLLRIEQLLGDAGVYAGRSAFPRFQG

SEQ ID NO: 5328 - protein, 657 aa, Corynebacterium glutamicum
  strain ATCC 13032 / DSM 20300 / JCM 1318 / LMG 3730 / NCIMB 10025
MRDTAFRSIKAKAQAKRRSLWIAAGAVPTAIALTMSLAPMASAQSSNLSSDAVIGSIAQGVTDGLTDYLKPRVEELPAGEVTYPEIAGLPDGVRVISAEWATSKHVILTIQSAAMPERPIKVQLLLPRDWYSSPNREFPEIWALDGLRAIEEQSGWTIETNIEQYYADKNAIVVLPVGGESSFYSDWEGPNNGKNYQWETFLTQELAPILDKGFRSNTDRAITGISMGGTAAVNIATHHPDMFKFVGSFSGYLDTTSAGMPIAISAALADAGGYDANAMWGPVGSERWQENDPKSNVDKLKGKTIYVSSGNGADDFGKEGSVAIGPANAAGVGLEVISRMTSQTFVDRASQAGVEVVASFRPSGVHSWEYWQFEMTQAFPHIANALGMSTEDRGVECAPVGAIADAVADGAMGTCLTNEYDVTGGKAQDFANGRAYWSANTGAFGLVGRINARYSELGGPASWLGYPTSSELKTPDGRGRFVTFEHGSIYWTATTGPWEIPGDMLAAWGTQDYEKGSLGYPTGAAVEYNGGLRQQFEGGYVFRTSNNQSYWVRGEISKKYAEDGIFAQLGFPTGNEKLINGGAFQEFEKGNIYWSASTGAHVILHGDIFDAWGAKGWEQGEYGFPTSDQTAITAGGQTIDFQNGTIRQVNGRIEESR

SEQ ID NO: 5329 - protein, 361 aa, Corynebacterium glutamicum
  strain ATCC 13032 / DSM 20300 / JCM 1318 / LMG 3730 / NCIMB 10025
MHTRGLVSLLSLIFLFVLSGCGGNATTADEAAESDVVTSSSAPPSKRALDVGEAVEIPGVVLTVNSVTQSDQLMLYSEGSARGSEPREQRNAASGEKFVSVDTTVKNSSSDPWDLSCGHVLQTWLLEDELDDQQGDQEKKFSPIDNLDQISGNPECGVLLEVGTEIEMTWSFTIPDDIEITHFGFSLSDSTSNDLAIISLGGAIETSSAITTTEVIAPENDTETLLEITPVDCQVGLGPIVTSWSDGTVGGWSQHCQDVHDEVLAGEVAANTPVCDGVVCTYPSGATMPDPNAPQIPSDTSGAVCDENQCVYPNGYIARIGDPNVPNYLKPGNSPWVQGQIDFQNCLDSGKTIEQCREELN

SEQ ID NO: 5330 - protein, 374 aa, Corynebacterium glutamicum
  strain ATCC 13032 / DSM 20300 / JCM 1318 / LMG 3730 / NCIMB 10025
MAPHQKSRINRINSTRSVPLRLATGGVLATLLIGGVTAAATKKDIIVDVNGEQMSLVTMSGTVEGVLAQAGVELGDQDIVSPSLDSSISDEDTVTVRTAKQVALVVEGQIQNVTTTAVSVEDLLQEVGGITGADAVDADLSETIPESGLKVSVTKPKIISINDGGKVTYVSLAAQNVQEALELRDIELGAQDRINVPLDQQLKNNAAIQIDRVDNTEITETVSFDAEPTYVDDPEAPAGDETVVEEGAPGTKEVTRTVTTVNGQEESSTVINEVEITAAKPATISRGTKTVAANSVWDQLAQCESGGNWAINTGNGFSGGLQFHPQTWLAYGGGAFSGDASGASREQQISIAEKVQAAQGWGAWPACTASLGIR

SEQ ID NO: 5331 - protein, 193 aa, Corynebacterium glutamicum
  strain ATCC 13032 / DSM 20300 / JCM 1318 / LMG 3730 / NCIMB 10025
MGRHSTKTSSAFTKLAASTIAFGAAATIMAPSASAAPDSDWDRLAQCESGGNWAINTGNGYHGGLQFSASTWAAYGGQEFATYAYQATREQQIAVAERTLAGQGWGAWPACSASLGLNSAPTQRDLSATTSTPEPAAAAPAVAEYNAPAANIAVGSTDLNTIKSTYGAVTGTLAQYGITVPAEVESYYNAFVG

SEQ ID NO: 5332 - protein, 183 aa, Corynebacterium glutamicum
  strain ATCC 13032 / DSM 20300 / JCM 1318 / LMG 3730 / NCIMB 10025
MKNAKLFLALISAPLILAGCSSTDTGTAESTISSETASAVDATTSTSSSTATSAVIDDDPVFDIIDIVLAQYPDRIITDIDREDSSDQYEVDVVVGQEVLELDVTTSGQIHTDDRDNDDDDDIREAHAATVTAAQAIGLALDQYPDGIIDSVELDEDDGQLKWKIDLDDTSGNDLADVEIAAV

SEQ ID NO: 5333 - protein, 209 aa, Corynebacterium glutamicum
  strain ATCC 13032 / DSM 20300 / JCM 1318 / LMG 3730 / NCIMB 10025
MGKHRRNNSNATRKAVAASAVALGATAAIASPAQAAEVVVPGTGISVDIAGIETTPGLNNVPGIDQWIPSLSSQAAPTAYAAVIDAPAAQAAPAASTGQAIVDAARTKIGSPYGWGATGPNAFDCSGLTSWAYSQVGKSIPRTSQAQAAQGTPVAYSDLQAGDIVAFYSGATHVGIYSGHGTVIHALNSSTPLSEHSLDYMPFHSAVRF

SEQ ID NO: 5334 - protein, 366 aa, Corynebacterium glutamicum
  strain ATCC 13032 / DSM 20300 / JCM 1318 / LMG 3730 / NCIMB 10025
MKDYAVHTRGLVSLLSLIFLFVLSGCGGNATTADEAAESDVVTSSSAPPSKRALDVGEAVEIPGVVLTVNSVTQSDQLMLYSEGSARGSEPREQRNAASGEKFVSVDTTVKNSSSDPWDLSCGHVLQTWLLEDELDDQQGDQEKKFSPIDNLDQISGNPECGVLLEVGTEIEMTWSFTIPDDIEITHFGFSLSDSTSNDLAIISLGGAIETSSAITTTEVIAPENDTETLLEITPVDCQVGLGPIVTSWSDGTVGGWSQHCQDVHDEVLAGEVAANTPVCDGVVCTYPSGATMPDPNAPQIPSDTSGAVCDENQCVYPNGYIARIGDPNVPNYLKPGNSPWVQGQIDFQNCLDSGKTIEQCREELN

SEQ ID NO: 5335 - protein, 278 aa, Corynebacterium glutamicum
  strain ATCC 13032 / DSM 20300 / JCM 1318 / LMG 3730 / NCIMB 10025
MSSASFTTKALSVLAALTAASAPLVAASPAHALANARNVTGSSTTSDSIVRLHIGNTACTGTMITPTWAITARHCIPEGGIAGAAIGSSTLSQFQQVSQAILHPTADLALVELPNQASSNTVDLYGAHVQPGENGQAAGWGGYSAFGQNVAQQADVQIQRRVVNVPSPDRTAVLLEGTVSNGRLVPGDSGGPLYINGQLAGVLSMSTDVENDALDGTVGWYIPVAEHAEWIAYYTGKHIAPIAGAPAELVDATANPTFIPAPQPFTGSSIGGWALGSS

SEQ ID NO: 5336 - protein, 425 aa, Corynebacterium glutamicum; identical to SEQ ID NO: 5327
  strain ATCC 13032 / DSM 20300 / JCM 1318 / LMG 3730 / NCIMB 10025

SEQ ID NO: 5337 - protein, 357 aa, Corynebacterium glutamicum
  strain ATCC 13032 / DSM 20300 / JCM 1318 / LMG 3730 / NCIMB 10025
MPLRLATGGVLATLLIGGVTAAATKKDIIVDVNGEQMSLVTMSGTVEGVLAQAGVELGDQDIVSPSLDSSISDEDTVTVRTAKQVALVVEGQIQNVTTTAVSVEDLLQEVGGITGADAVDADLSETIPESGLKVSVTKPKIISINDGGKVTYVSLAAQNVQEALELRDIELGAQDRINVPLDQQLKNNAAIQIDRVDNTEITETVSFDAEPTYVDDPEAPAGDETVVEEGAPGTKEVTRTVTTVNGQEESSTVINEVEITAAKPATISRGTKTVAANSVWDQLAQCESGGNWAINTGNGFSGGLQFHPQTWLAYGGGAFSGDASGASREQQISIAEKVQAAQGWGAWPACTASLGIR

SEQ ID NO: 5338 - protein, 199 aa, Corynebacterium glutamicum
  strain ATCC 13032 / DSM 20300 / JCM 1318 / LMG 3730 / NCIMB 10025
MRGKLFMGRHSTKTSSAFTKLAASTIAFGAAATIMAPSASAAPDSDWDRLAQCESGGNWAINTGNGYHGGLQFSASTWAAYGGQEFATYAYQATREQQIAVAERTLAGQGWGAWPACSASLGLNSAPTQRDLSATTSTPEPAAAAPAVAEYNAPAANIAVGSTDLNTIKSTYGAVTGTLAQYGITVPAEVESYYNAFVG

SEQ ID NO: 5339 - protein, 220 aa, Corynebacterium glutamicum
  strain ATCC 13032 / DSM 20300 / JCM 1318 / LMG 3730 / NCIMB 10025
MLKAQRTRFPLSLLIPPFCHLKQPLIFISYSLHRVEYMKNAKLFLALISAPLILAGCSSTDTGTAESTISSETASAVDATTSTSSSTATSAVIDDDPVFDIIDIVLAQYPDRIITDIDREDSSDQYEVDVVVGQEVLELDVTTSGQIHTDDRDNDDDDDIREAHAATVTAAQAIGLALDQYPDGIIDSVELDEDDGQLKWKIDLDDTSGNDLADVEIAAV

SEQ ID NO: 5340 - protein, 220 aa, Corynebacterium glutamicum
  strain R
MLKAQRTRFPLSLLIPPFCHLKQPLIFISYSLHRVEYMKNAKLFLALISAPLILAGCSSTDTGTAESTISSETASAVDATTSTSSSTATSAVIDDDPVFDIIDIVLAQYPDGITTDIDREDSSDQYEVDVVVGQEVLELDVTTSGQIHTDDRDNDDDDDIREAHAATVTAAQAIGLALDQYPDGIIDSVELDEDDGQLRWKIDLDDTSGNDLADVEIAAV

SEQ ID NO: 5341 - protein, 374 aa, Corynebacterium glutamicum; identical to SEQ ID NO: 5330
  strain R

SEQ ID NO: 5342 - protein, 425 aa, Corynebacterium glutamicum; identical to SEQ ID NO: 5327
  strain R

SEQ ID NO: 5343 - protein, 278 aa, Corynebacterium glutamicum
  strain R
MSSASFTTKALSVLAALTAASAPLVAASPAHALANARNVTGSSTTSDSIVRLHIGNTACTGTMITPTWAITARHCIPEDGIAGAAIGSSTLSQFQQVSQAILHPTADLALVELPNQASSNTVDLYGAHVQPGENGQAAGWGGYSAFGQNVAQQADVQIQRRVVNVPSPDRTAVLLEGTVSNGRLVPGDSGGPLYINGQLAGVLSMSTDVENDALDGTVGWYIPVAEHAEWIAYYTGKHIAPIAGAPAELVDATANPTFIPAPQPFTGSSIGGWALGSS

SEQ ID NO: 5344 - protein, 366 aa, Corynebacterium glutamicum
  strain R
MKDYAVHTRGLVSLLSLIFLFVLSGCGGNATTADEAAESDVVTSSSAPPSKRALDVGEAVEIPGVVLTVNSVTQSDQLMLYSEGSARGSEPREQRNAASGEKFVSVDTTVKNSSSDPWDLSCGHVLQTWLLEDELDDQQADQEKKFSPIDNLDQISGNPECGVLLEVGTEIEMTWSFTVPDDIEITHFGFSLSDSTSNDLAIISLGGAIETSSAITTTEVIAPENDTETLLEITPVDCQVGLGPIVTSWSDGTVGGWSQHCQDVHDEVLAGEVAANTPVCDGVVCTYPSGATMPDPNAPQIPSDTSGAVCDENQCVYPNGYIARIGDPNVPNYLKPGNSPWVQGQIDFQNCLDSGKTIEQCREELN

SEQ ID NO: 5345 - protein, 211 aa, Corynebacterium glutamicum
  strain R
MGKHRRNNSNATRKAVAASAVALGATAAIASPAQAAEVVVPGTGISVDIAGIETTPGLNNVPGIDQWIPSLSSQAAPTAYAAVIDAPAAEAQAAPAASTGQAIVDAARTKIGSPYGWGATGPNAFDCSGLTSWAYSQVGKSIPRTSQAQAAQGTPVAYSDLQAGDIVAFYSGATHVGIYSGHGTVIHALNSSTPLSEHSLDYMPFHSAVRF

SEQ ID NO: 5346 - protein, 374 aa, Corynebacterium glutamicum ATCC 14067
MAPHQKSRINRINSTRSVPLRLATGGVLATLLIGGVTAAATKKDIIVDVNGEQMSLVTMSGTVEGVLAQAGVELGDQDIVSPSLDSSISDEDTVTVRTAKQVALVVEGQIQNVTTTAVSVEDLLQEVGGITGADAVDADLSETIPESGLKVSVTKPKIISINDGGKVTYVSLAAQNVQEALELRDIELGAQDRINVPLDQQLKNNAAIQIDRVDNTEITETVSFDAEPTYVDDPEAPAGDETVVEEGTPGTKEVTRTVTTVNGQEESSTVINEVEITAAKPATISRGTKTVAANSVWDQLAQCESGGNWAINTGNGFSGGLQFHPQTWLAYGGGAFSGDASGASREQQISIAEKVQAAQGWGAWPACTASLGIR

SEQ ID NO: 5347 - protein, 425 aa, Corynebacterium glutamicum ATCC 14067; identical to SEQ ID NO: 5327

SEQ ID NO: 5348 - protein, 193 aa, Corynebacterium glutamicum ATCC 14067; identical to SEQ ID NO: 5331

SEQ ID NO: 5349 - protein, 509 aa, Corynebacterium glutamicum ATCC 14067
MTSKSSAFRRLTAAVGTVAVAVAGVISMGQVASAQQATAVGPDQPGAPTHGSLTVHKYVGQEGNAGTGEEISVPGGQPLEGAEFTIWRLGTNDGDSCEPIDLANTNDWAQVPTGAAPRELSAVQNDFCLVDGGTARTTNSAGEYTFGNLDLGLYYVQETDAPANIVSRTAPFYVSIPLPHAQQNWLYDVHVYPKNQEVDAPTKTINSDSDQAGKGLTVGSVVEWTISQTVPALNDGEQYTSATIWDVLNPAELEYAGTTSVSLNGTPLVEGTDYTIDAGVVSWSLTEKKLAEIKAGDTIEVVFTTTVLAVTETGDIDNPGSEGPDKPGYGSEFNGGTTPGGTTPHTYWGQLTVNKGDTGMVNKLAGAEFAVFNNAENGVCAPEAPETDAIATGVSDAEGVVRWNDVTPDNPLGLWIANSSDGEIANPNKDYCLYETKAPSGYVAGPVQKVNITPGTTAKLVVDFENTKKDGPNLPLTGGQGTLMMTIGGLALMLVGAGAVYALRRRNEA

SEQ ID NO: 5350 - protein, 183 aa, Corynebacterium glutamicum ATCC 14067
MKNAKLFLALVSTPLLLASCSSTDSGTAESTISSETASAVDATTSTSSSTATSAAIDDDPVFDIIDIVLAQYPDGIITDIDREDSSDQYEVDVIVGQEVLELDVTTSGQISVDDRDNDDDDDIREAHAATVTAAQAIGLALDQYPDGIIDSVELDEDDGQLKWKIDLDDTSGNDLADVEIAAV

SEQ ID NO: 5351 - protein, 425 aa, Corynebacterium glutamicum S9114; identical to SEQ ID NO: 5327

SEQ ID NO: 5352 - protein, 192 aa, Corynebacterium glutamicum S9114
MGRHSTKTSSAFTKLAASTIAFGAAATIMAPSASAAPDSDWDRLAQCESGGNWAINTGNGYHGGLQFSASTWAAYGGQEFATYAYQATREQQIAVAERTLAGQGWGAWPACSASLGLNSAPTQRDLSATTSTPEPAAAPAVAEYNAPAANIAVGSTDLNTIKSTYGAVTGTLAQYGITVPAEVESYYNAFVG

SEQ ID NO: 5353 - protein, 374 aa, Corynebacterium glutamicum S9114; identical to SEQ ID NO: 5330

SEQ ID NO: 5354 - protein, 183 aa, Corynebacterium glutamicum S9114
MKNAKLFLALVSAPLILAGCSSTDTGTAESTISSETASAVDATTSTSSSTATSAVIDDDPVFDIIDIVLTQHPDGIITDIDREDSSDQYEVDVVVGQEVLELDVTTSGQIHTDDRDNDDDDDIREAHAATVTAAQAIGLALDQYPDGIIDSVELDEDDGQLRWKIDLDDTSGNDLADVEIAAV

SEQ ID NO: 5355 - protein, 391 aa, Corynebacterium jeikeium
  strain K411
MSPKKKSHLHRINNTSSTPLRIATGGMLATLVVGGGVAVAGQKSVTLDVNGDIIQASTMSGDVEGALKSAGVEIDNRAMVTPALDEAIGDNSKITVRSARTVALTIDGKQEKIDTTALTVGSLLDQIGRSDAASNLSEARNQEIPLDGMELEIVTPKKFTLNDGGQDGRMSLPARTVGEIFEMRGTPLGKEDKVTPAADTPLKEGMHVEVTRISDRDETKVEEIPAPERVKEDPNMPEGEEKVVEKGAPGKARVVATVRTINGQEVSRKEKSSKEITTPKERVIIRGTKKADKAEDKGSNTGAAAPAVANGSVWDQLAQCEAGGDWSINTGNGFSGGLQFTPSTWAAFGGTEYAPAAHMATREQQIAVAERVRAGQGWGAWPACTSKLGLR

SEQ ID NO: 5356 - protein, 425 aa, Corynebacterium jeikeium
  strain K411
MALILNIDAREIIDSRGNPTVEVDVLLDDGSFGRAAVPSGASTGVHEAHELRDGGERYQGKGVLNAVKNVIEDIDEELMGVEADDQRLIDQLMRDLDGTENKSKLGANAILGVSMAVARAAAESADLPLFRYVGGPNAHVLPVPMMNILNGGAHADSGVDVQEFMIAPIGAETFSEALRVGAEVYHTLKKVIKDKGLSTGLGDEGGFAPSVDSTKAALDLIVEAIEKAGFKVGEDVALALDVASSEFFKDGKYHFEGGEHTAEEMAKVYEDLIEEYPIVSIEDPLQEDDWEGYTALTAKIGDKVQLVGDDFFVTNPQRLAKGIEEKAANALLVKVNQIGTLTETFDAVELAHRNGYRSMMSHRSGETEDTTIADLAVALNCGQIKTGAPARSERVAKYNQLLRIEEILGDAAVYAGRSAFPRFTK

SEQ ID NO: 5357 - protein, 1221 aa, Corynebacterium jeikeium
  strain K411
MLTSQHPQRRLSSAALRIISIFFCLVLAAAGMICIAENGFVPPAAAQGTTAPAALVSPPEVPPPPEAKPDIPLEQRQRLNCYESMFGECTAESIQAIIDQAGTTPTAIGLSYNYSKISKTVTIPSGADIMFMSDGWEPELVRDHGFTDSMIEVKEGARLVLGSGGADSQTVKILNKTGKFNTETSSPTIRVEGELVVNTAEITGARGLSGAHVGAITGIGQKALITLNKGAKVSDNHRAQDSGSTQNGAGNIAVSDGAVLVMNDGEVSHGKGSDQNNGYGEAGGIGAYTGARVYINGGEIKFNSGWAGGIIGFSWPWNLAEAQANKDSHRNFIQINGGEISYNNSGFSGGGVLAFGNTVVEMNGGKISSNNSANGGGVGTFDDYVSGANGSYAEESSTGKDSGLSPEEWSKLSPAAFVMKGGEVVDNTATRTGGGVNVVSNQVHLLGGNISENKAWQQGGGVYVSTKSYTAHLSNALVSENEATRKHPGADQSAAIGGGLWVCPTGTIKMYVNEGGAIIDNTAESYGADIAHDNLGRVSALELWLSNRILGGGDAMYFRDGGKSWDRYNTDSPDSQIEEIFKNRTLQERGLKTVAVADVKGSAQKAAKLTISENKAPRGGGIGSNGGVVFGHGDEDVTDLEVLKAWANADDTPYTGEKPESISLQLMHGDHKVGDPVKVTPDEKGDWKYTFANLPEVKEGEPPYSVKELAVDGFETLVSEPVRSAAGRTQLVVNAKRPNLSIEKSWEGQGDDKLPESIKVDVLQTVDCKTETYKQVELTAQNEWKTELKDVPRFLDGKEVSYSVKESDVPGYTPTYATIERTADKFIARLTNTRDSTELKVKKVWIGQDAVEIDPAVAKGRLPEEVTVHVVQAVNGKEADYGDSIKLNADNKWSATVRDLPTHVDGKEAQYSVREDKVEGFKTDYTSFGDAFTVVNKAEPTFLEVTKKWEDVTGDLPQEVTVHVVQTVDGKQTDYGDPLKLSAENDWHAKVENLPQFVNGKPVTYSVREDAVDGYTSKVSGEGPEFTVTNRPDTPPTPLTTGVSVDKQWLDADGNVLDADAAATMPEVTVHVVQTVDGKSVDYGDPIALNADNNWSAEVDGLPASVDGKEATYSVREDAVDGYTSKVSGEGPEFTVTNRPDTPPSTPPSTPPSTPPSTPPSTPPSTPPTTTSSTPVPPTPSQSGRGGGLALTGSSVLPVLALGALLTALGSTLVAMMRRRS

SEQ ID NO: 5358 - protein, 208 aa, Corynebacterium jeikeium
  strain K411
MARHAKTSSFTTAARLSVAGVAVAATSALLAPTASAAPDSDWDRLAQCESGGNWSINTGNGFHGGLQFSPSTWAGYGGKQYAPYAYQATREQQIAIAERVLAGQGWGAWPACSAKLGLNSKPTPRNAAAKPKAKPAAPAPVVQKAVRDLSRNSNALAVDKFYDALVKRIEELGYSVPKEVTDYYNANKHSLNHTYKQYSAQLQAVLPH

SEQ ID NO: 5359 - protein, 116 aa, Corynebacterium jeikeium
  strain K411
MNKSVKTAFARIGMAAGLVAAPAAAAAVAAPAAQAAPVSAWDQVAQCESGGNWKINTGNGYYGGLQFSAQTWAGFGGTKYAPTANQATKAQQIEIAEKVLAKQGAGAWPNCGKVLG

SEQ ID NO: 5360 - protein, 425 aa, Corynebacterium jeikeium ATCC 43734
MALILNIDAREIIDSRGNPTVEVDVLLDDGSFGRAAVPSGASTGVHEAHELRDGGERYQGKGVLNAVKNVIEDIDEELMGVEADDQRLIDQLMRDLDGTENKSKLGANAILGVSMAVARAAAESADLPLFRYVGGPNAHVLPVPMMNILNGGAHADSGVDVQEFMIAPIGAETFSEALRVGAEVYHTLKKVIKDKGLSTGLGDEGGFAPSVDSTKAALDLIVEAIEKAGFKVGEDVALALDVASSEFFKDGKYHFEGGEHTAEEMAKVYEGLIEEYPIVSIEDPLQEDDWEGYTALTAKIGDKVQIVGDDFFVTNPQRLAKGIEEKAANALLVKVNQIGTLTETFDAVELAHRNGYRSMMSHRSGETEDTTIADLAVALNCGQIKTGAPARSERVAKYNQLLRIEEILGDAAVYAGRSAFPRFTK

SEQ ID NO: 5361 - protein, 200 aa, Corynebacterium jeikeium ATCC 43734
MIDLTTYSEDQLLDLQQALADERKRRAALPAVEEAAREAKEEVVAEVTERLAEKDVKLKPPAKADTKVRPWKPWHPLDTATHFYYGDLATNGGKTWRDVLDKTRTQLNVWEPGSPGIDERYWVEVTEDKPEPETGEQPDEPTEDNPADETEPATPEWKPNTTVKPGERYTHQGATYEVIQGHTTQAGWEPPAVPALWQKV

SEQ ID NO: 5362 - protein, 393 aa, Corynebacterium jeikeium ATCC 43734
MSPKKKSHLHRINNTSSTPLRIATGGMLATLVVGGGVAVAGQKSVTLDVNGDIIQASTMSGDVEGALKSAGVEIDNRAMVTPALDEAISDNSKITVRSARTVALTIDGKQEKIDTTALTVGSLLDQIGRSDAASNLSEARNQEIPLDGMELEIVTPKKFTLNDGGEDGRMSLPARTVGEIFEMRGTPLGKDDKVTPAANTPLKEGMHVEVTRIANREETKVEEIPAPERVKEDPNMPEGEEKVVEKGAPGKARVVATVRTVNGEEVSRKEKSSKEITAPKERVIIRGTKKTDKGEGKDKGSNTGAAAPAVANGSVWDQLAQCEAGGDWSINTGNGFSGGLQFTPSTWAAFGGTEYAPAAHMATREQQIAVAERVQAGQGWGAWPACTSKMGLR

SEQ ID NO: 5363 - protein, 116 aa, Corynebacterium jeikeium ATCC 43734; identical to SEQ ID NO: 5359

SEQ ID NO: 5364 - protein, 208 aa, Corynebacterium jeikeium ATCC 43734
MARHAKTSSFTTAARLSVAGVAVAATSALLAPTASAAPDSDWDRLAQCESGGNWSINTGNGFHGGLQFSPSTWAGYGGKQYAPYAYQATREQQIAVAERVLAGQGWGAWPACSAKLGLNSKPTPRNAAAKPKAKPAAPAPVVQKAVRDLSRNSNALAVDKFYDALVKRIEELGYSVPKEVTDYYNANKHSLNHTYKQYSAQLQAVLPH

SEQ ID NO: 5365 - protein, 260 aa, Corynebacterium kroppenstedtii
  strain DSM 44385 / CCUG 35717
MGQHSKNTNRISTGAKVALSGLAITASGIAVAPSASAAPDSDWDRLAQCESGGNWGINTGNGFQGGLQFAPSTWSAYGGTEYAATANQATREQQITVGERVLAEQGWNAWPACSAQLGLSSAPSQRDNAYANGAQAAVQPAAAPVEEAAPAENAAPAAQAPADVADEAPTPQKAVTDLAATQSIASLDQVFDAIQAAFNKAGIPMPAVITDYYHAHHDELVGAYNQAIGAAVNGYAEATAQATKIYDAVEKNFHSSRSAA

SEQ ID NO: 5366 - protein, 388 aa, Corynebacterium kroppenstedtii
  strain DSM 44385 / CCUG 35717
MSTQKKSRIHRINHTSSTPVRVATGGMLATLVVGGAVAVNAQKNLILNVNGETSHVSAMSGDVKSILASHDVDLKDGDFVSPAANSSVKDKQEITVRTARPVTLTVDGVQKTIQSTALTVKDFLNQVGTINPDDYVSAQGSTKIPESGMKLEVVPLKDITLDDGGQLGDMKVPAVTVKDFLDRRGIKLGADDKVTPELGKKLVSGDKITIERNKTEDQTVKEAVEPTVRYVDDPNSPKGSETVVKPGKAGEREVTYTVKSRNGQEVQRWEKASKILSEATEKVISRGTKAAVASTKSSSASAPAVAGGSVWDSIAQCESGGKWNTSTGNGFSGGLQFTDQTWQAFGGGAYAPTAAGATREQQIAVANKVQAAQGWGAWPACTSKLGIR

SEQ ID NO: 5367 - protein, 427 aa, Corynebacterium kroppenstedtii
  strain DSM 44385 / CCUG 35717
MAQIIDVQAREILDSRGNPTVEVEVLLDDASFGRAGVPSGASTGVHEAHELRDGGDRYLGKGVRQAVENVNEKIAPAVTGLEADDQRLVDKVMLDLDGSDNKSNLGANAILGVSLATAKAAASSANLELFRYLGGPNAHVLPVPMMNIVNGGAHADSGVDVQEFMIAPIGADSFREALRMGAEVYHNLKSVIKSKGLSTGLGDEGGFAPSVDSTKEALDLIAEAVKKAGYKLGEDIAFALDAASSEFYDKDKGVYNFEGGEHSAEDMVKVYEELVENYPIVSIEDPLQEDDWEGYTKLTAEIGDKVQIVGDDFFVTNPARLKEGIEKKAANALLVKVNQIGSLSETADAVQLAQNNNYRCMMSHRSGETEDTTIADLSVAYSCGQIKSGAPARSERVAKYNQLLRIEEFLGDAAVYAGRSAFPRFNG

SEQ ID NO: 5368 - protein, 381 aa, Corynebacterium lipophiloflavum DSM 44291
MAAKRINSTTSATRRVLAGSVAGAVIVGGAATAAAAAQKNVTVDVNGEATTVRTYSDDVEGALQAAGVEVGASDLVYPAPSDALQSGTTVTVRTAKPVALVIDGAEQQLTSTAATVADLVSEAGITAASALSAHPDQPLTDGMTIDVTTPKIVSINDGGNVVYTSEAAKTVGDLLAARGITFDTNDRLNVPLSAPLEPNMRIVLDRVDVSETSESVEFDAPAKVVEDANLPAGTEEVREPGAKGEKKVLYRTVTVNGVVESSGPAGEEEIRPAVPATVVRGTKAAATATAAAAGAPSVAGGSVWDQIAQCESGGNWSINTGNGYYGGLQFNAGTWAAYGGTQYAPTADLATREQQIAIAEKTQAAQGWGAWPACTAKLGLR

SEQ ID NO: 5369 - protein, 212 aa, Corynebacterium lipophiloflavum DSM 44291
MGRHSKQTASFATKALAGTAAAAALTGIMAPAAHAAPDSDWDRLAQCEAGGNWSINTGNGYYGGLQFSASTWRAYGGDQFAPYAHQATREQQIIVAERTLASQGWGAWPACSARLGLNSAPTNRDAQAAPAPAPAPAAAPAPAAAPSAAPQVDALYHAIVARLNENNIAVPAELHTAYAANRDDYSNFYLANKALIDAVLAGDINAVIAELV

SEQ ID NO: 5370 - protein, 424 aa, Corynebacterium lipophiloflavum DSM 44291
MADIIHAFAREIMDSRGNPTVEAEVFLDDGARGIAGVPSGASTGVHEAHELRDGDERYEGKGVRKAVDNVNEEIADAIAGIEADDQRLIDQTMIELDGTDNKSRLGANAILGVSMAVAKAAAESAGLPLYRYIGGPNAHILPVPMMNILNGGAHADSGVDVQEFMIAPLGAETFEEALRMGAEVYHALKSVLKAKGLSTGLGDEGGFAPSVDSTKAALDVIVEAVEKAGYTLGDDIALALDVASSEFYEDGVYNFEGGKHSSAEMIKVYAELVEQYPIVSIEDPLDEDDWDGYVELTAQIGDKVQIVGDDFFVTNPKRLAEGIEKKAANALLVKVNQIGTLTETFDAVDLAHRNGYRTMMSHRSGETEDTTIADLAVALGCGQIKTGAPARSERVAKYNQLLRIEQELGDAAVYAGRSAFPRFK

SEQ ID NO: 5371 - protein, 274 aa, Corynebacterium lipophiloflavum DSM 44291
MSTSYTAPVGPAQPVAPVEPPQRTTVGIIALVCAIAGFIFGCIPGAFILGWILLPIGFILGITGLFMKAKKGTAVAAVIVSIVGTIVSVIVFLFAVGRTFDESFNQDVFVAGPESAVAPVAEGSAAQGGSAAGSTRDNPLPIGATVENEEWSVTLNSVDLDATDAVTAENPVNDQPGPDQTYALANVTITYKGDNPQGSMPMPLIEYVTPDGHSVTSFDTLVVAPDALDTLTSLYSGASVSGNEAFLIPAGTAGEDVLAIQPDLLSKKAFFAVR

SEQ ID NO: 5372 - protein, 425 aa, Corynebacterium matruchotii ATCC 14266
MADIMHVFAREILDSRGNPTVEAEVHLDDFSVGIAGVPSGASTGVHEAHELRDGGDRYQGKGVLEAVKHVNNEIADKIVGFEADDQRVIDQTLIELDGTENKSKLGANAILGVSMAVAKAAAESSNLPLYRYIGGPNAHLLPVPMMNIVNGGAHADSGVDVQEFMIAPIGAETFAEALRLGAEVYHSLKSVVKSKGLSTGLGDEGGFAPSVGSTKEALDLIVEAIKKAGLEPGKDIALALDVASSEFYKDGKYHFEGGEHTAEEMVKVYEDLISSYPIVSIEDPLQEDDWEGYTNLTAKIGDRVQIVGDDFFVTNPARLAKGIEEKAANALLVKVNQIGTLTETFDAVDLAHRAGYRTMMSHRSGETEDTTIADLAVALGCGQIKTGAPARSERVAKYNRLLRIELELGTAAVYAGRSAFPRFKG

SEQ ID NO: 5373 - protein, 382 aa, Corynebacterium matruchotii ATCC 14266
MSHHQKSRLSRLNSSRSVPLRLATSGVLATLVVGGVAVAANKKDVVIDLNGDQLALATLSQDVGGALRSAGIEVADGDIVQPAADAKLGNDEKITVRTVKDVAVVVDGQKKVVKTNATTVGEMVSQLDSIGAAIKALGLSTPVDTKLQKSGMSVDVVTPKIVSITDGGKTSYVSLAAATVKDALAARGIELGPHDRVTPELTSAVSGNMKINIDRVTVDDVQVKEAYDEEPTFVDNPDAMQGVESVVEAGSPGEREVTRRITKVNGVESANDVVSQNVLVPAKKATISRGTKVSRVPTVPDGSVWDRLAQCESTGNWAINTGNGFHGGLQFTPQTWLAYGGGEYAPYAYQATREEQIAVAQKVQASQGWGAWPACTAKMGLR

SEQ ID NO: 5374 - protein, 206 aa, Corynebacterium matruchotii ATCC 14266
MARHARKTASKFAKFAASTVAVGTASAIFSPAAHAAPDSDWDRLAQCESGGNWAINTGNGFHGGLQFTASTWNAHGGQQYAPYAYQASREQQIAVAERVLASQGWGAWPACSAKLGLNSAPTPRDTVSNAPSPVQQAVENAIANAQNDAQANTLASDAIYGLVKDRLASYGIQVPGEVHAFYTANRGDFNAFYTANRQIIDTAVRG

SEQ ID NO: 5375 - protein, 421 aa, Corynebacterium matruchotii ATCC 33806
MHVFAREILDSRGNPTVEAEVHLDDFSVGIAGVPSGASTGVHEAHELRDGGDRYQGKGVLEAVKHVNNEIADKIVGFEADDQRVIDQTLIDLDGTENKSKLGANAILGVSMAVAKAAAESSNLPLYRYIGGPNAHLLPVPMMNIVNGGAHADSGVDVQEFMIAPIGAETFAEALRLGAEVYHSLKSVVKSKGLSTGLGDEGGFAPSVGSTKEALDLIVEAIKKAGLEPGKDIALALDVASSEFYKDGKYHFEGGEHTAEEMVKVYEDLISSYPIVSIEDPLQEDDWEGYTNLTAKIGDRVQIVGDDFFVTNPARLAKGIEEKAANALLVKVNQIGTLTETFDAVDLAHRAGYRTMMSHRSGETEDTTIADLAVALGCGQIKTGAPARSERVAKYNRLLRIELELGTAAVYAGRSAFPRFKG

SEQ ID NO: 5376 - protein, 361 aa, Corynebacterium matruchotii ATCC 33806
MATSGVLATLVVGGVAVAANKKDVVIDLNGDQLALATLSQDVGGALRSAGIEVADGDIVQPAADAKLGNDEKITVRTVKDVAVVVDGQKKVVKTNATTVGEMVSQLDSIGAAIKALGLSTPVDTKLQKSGMSVDVVTPKIVSITDGGKTSYVSLAAATVKDALAARGIELGPHDRVTPELTSAVSGNMKINIDRVTVDDVQVKEAYDEEPTFVDNPDAMQGVESVVEAGSPGEREVTRRITKVNGVESANDVVSQNVLVPAKKATISRGTKVSRVPTVPDGSVWDRLAQCESTGNWAINTGNGFHGGLQFTPQTWLAYGGGEYAPYAYQATREEQIAVAQKVQASQGWGAWPACTAKMGLR

SEQ ID NO: 5377 - protein, 206 aa, Corynebacterium matruchotii ATCC 33806
MARHARKTASKFAKFAASTVAVGTASAIFSPAAHAAPDSDWDRLAQCESGGNWAINTGNGFHGGLQFTASTWNAHGGQQYAPYAYQASREQQIAVAERVLASQGWGAWPACSAKLGLNSAPTPRDTVSNAPSPVQQAVENAIANAQNDAQANTLASDAVYNLVKDRLASYGIQVPGEVHAFYTANRGDFNAFYTANRQIIDTAVRG

SEQ ID NO: 5378 - protein, 657 aa, Corynebacterium melassecola
MRDTAFRSIKAKAQAKRRSLWIAAGAVPTAIALTMSLAPMASAQSSNLSSDAVVGSIAQGVTDGLTDYLKPRVEELPAGEVTYPEIAGLPDGVRVISAEWATSKHVILTIQSAAMPERPIKVQLLLPRDWYSSPNREFPEIWALDGLRAIEEQSGWTIETNIEQYYADKNAIVVLPIGGESSFYSDWEEPNNGKNYQWETFLTQELAPILDKGFRSNTDRAITGISMGGTAAVNIATHHPDMFKFVGSFSGYLDTTSAGMPIAISAALADAGGYDANAMWGPVGSERWQENDPKSNVDKLKGKTIYVSSGNGADDFGKEDSVAIGPANATGVGLEVISRMTSQTFVDRANQAGVEVVASFRPSGVHSWEYWQFEMTQAFPHIANALGMSTEDRGVECAPVGAIADAVADGAMGTCLTNEYDVTGGKAQDFANGRAYWSANTGAFGLVGRINARYSELGGPDSWLGYPTSSELKTPDGRGRFVTFEHGSIYWTATTGPWEIPGDMLAAWGTQDYEKGSLGYPTGAAVEYNGGLRQQFEGGYVFRTSNNQSYWVRGEISKKYADDGIFAQLGFPTGNEKLINGGAFQEFEKGNIYWSVSTGAHVILHGDIFDAWGAKGWEQGEYGFPTSDQTAITAGGQTIDFQNGTIRQVNGRIEESR

SEQ ID NO: 5379 - protein, 109 aa, Corynebacterium pseudogenitalium ATCC 33035
MRSKKTMLTVSAAALGLAGLAAPAATAAPASAWDQVAACESGGDWHINTGNGYQGGLQFNPQTWAANGGTQYAPTADQATREQQIAVAENVLATQGAGAWPNCGGPVAG

SEQ ID NO: 5380 - protein, 425 aa, Corynebacterium pseudogenitalium ATCC 33035
MADIIHTFAREILDSRGNPTVEAEVFLDDGARGVAGVPSGASTGVHEAHELRDGGERYQGKGVLKAVENINEKIADEIAGFEADDQRLIDQALIKLDGTDNKSELGANAILGVSIAAAKAAAESAALPLYRYIGGPNAHVLPVPMMNILNGGAHADSGVDVQEFMIAPIGAESFAEALRMGAEVYHALKAVLKDKGLSTGLGDEGGFAPSVDSTKAALDVIVDAIKKAGFEPGKDVALALDVASSEFFKDGKYHFEGGEHTAEEMSKVYEDLIDQYPIVSIEDPLQEDDWDGYTTLTAAIGDKVQIVGDDFFVTNPARLQEGIEKKAANALLVKVNQIGTLTETFDAVELAHRNGYRTMMSHRSGETEDTTIADLAVALNCGQIKTGAPARSERVAKYNQLLRIEQELGDGAVYAGRSAFPRFKA

SEQ ID NO: 5381 - protein, 393 aa, Corynebacterium pseudogenitalium ATCC 33035
MSPHQIKRLNNSRSLPLRLATGGVLGTLAVGGVVAVAAQKDVTVDINGDKVELATFAKDVDGVLEAAGVQVSEEDIVSPAPSESVGDGDEISVRTAKPVAVTIDGVQQQLSTTDLTVSDLLGNLNGVVKGASVKSGDADVDEDAQLEEGMDLEVVSPKIVKINDGGKVTYTKIAAKTVEDVLKARNIDVDDDDRVFPSKDTKVTEGMSIKVDQVSTTTYDSEEEFDAEPNFVDDPELEEGTEEVREEGVKGKRVITHKLVMKDGAKESNDVIKEKVTVEPKAATIARGTKKAEEEKPEEGGNSGAAAPAVADGSVWDSIAQCEATGNWAINTGNGFSGGLQFTPSTWAAFGGTEYAPEAWQASREQQIAVAEKVQAAQGWGAWPACTSKLGLR

SEQ ID NO: 5382 - protein, 209 aa, Corynebacterium pseudogenitalium ATCC 33035
MGRHSAKNRMAAKFTAGTVAFGAAAAIMAPTASAAPDSDWDRLAQCEAGGNWHINTGNGYQGGLQFNPQTWQANGGGQFAATADQATREQQIVVAERVLASQGWGAWPACSASLGLNSAPTQRTAPSAAPKAPAQAPAPVKQAAAQKSDELAVDALYNTIKNAANSYGLALPAQFTELYKANRHDFNNFYSANRNIIDPIAQMIENITR

SEQ ID NO: 5383 - protein, 270 aa, Corynebacterium pseudotuberculosis
  strain 1002
MQKQRIIYNGVRRNLMLATSIAFTAGLVYGGGMLEPSMNSLILPSASAAVTGFPRPVPPLENIDLERKASVTIKIPDSSSGTNAGLPGYEVTVILLKTDPINTSEGYAKASKLTVEQAKKLEELRHYSGVTDAKGEANFSELVPGAYLVTTKSPKPGDRKPQEEVLIAPIIGENGEWDYSFTAVMKFKNNPKPGPTLPPWVPPVTQTTPPPTKDEQPPASDNPASKQNKKREALPLTGASVVGLIVISLSLIAGGFFLLVSRKNGENSTY

SEQ ID NO: 5384 - protein, 207 aa, Corynebacterium pseudotuberculosis
  strain 1002
MARHARKSASALAKIAASTVAVGSAATLFAPAASAAPDSDWDRLAGCESGGNWAINTGNGYYGGIQFSASTWKGFGGGQYAPTADKATREQQIAVAEKVLASQGWGAWPSCSAKLGLNSAPTPRDSVASAPAPLQQIVDDAQNYAAASGQNADKLAVDAVYKAVKDRLAGYGIGVHPEIDAFYQANNNNFDAFYQANRQVIDTAMGM

SEQ ID NO: 5385 - protein, 383 aa, Corynebacterium pseudotuberculosis
  strain 1002
MGTRQKSRINRVNSSKSIPLRLATGGVLASLAVGGVAVTQVKKDITVDVNGEQLTLATMSGTVEEALAKAGVTVGDKDIVYPGLTEKISNQDTIKVRTSKQVSVAIDGVEKNLTTNATTVEELFTQLDGLNATLSSAALNLDKDSKIPREGLSLDVVTPKIISVTEAGKTVFTQIAAATVKDVLAERGIKVDQDDIVTPALDAPVTKNMDVKIDRVDVQEVVANEPFGEPAHYVEDAELPEGEEAEVSAGTPGERTVTRKVTKVNGEETANEVIDEKVITPAVAATVKRGTKKAASAPAVADGSVWDQLAQCESTGNWAINTGNGFSGGLQFTDSTWAGFGGTAYAPRAHLATREQQIAIAQKVQASQGWGAWPACTSKLGLR

SEQ ID NO: 5386 - protein, 425 aa, Corynebacterium pseudotuberculosis
  strain 1002
MADIMHVFAREILDSRGNPTVEAEVFLDDGAHGIAGVPSGASTGIHEAHELRDGGDRYLGKGVLNAVNNINEEIADAVAGAEADDQRLIDQAMIALDGTENKSRLGANAILGVSMAVAKAAAESAGLPLYRYIGGPNAHLLPVPMMNIVNGGAHADSGVDVQEFMIAPIGAESFSEALRMGAEVYHSLKSVIKSKGLSTGLGDEGGFAPSVESTKAALDLIVEAIEKAGMKPGTDIALALDVASSEFFKDGKYHFEGGEHTAEEMAKVYADLIEQYPIVSIEDPLQEDDWEGYTNLTAAIGDKVQIVGDDFFVTNPVRLQEGIDKKAANALLVKVNQIGTLTETFDAVDLAHRNGYRTMMSHRSGETEDTTIADLSVALGCGQIKTGAPARSERVAKYNQLLRIEQELGDAAVYAGRSAFPRFRN

SEQ ID NO: 5387 - protein, 207 aa, Corynebacterium pseudotuberculosis; identical to SEQ ID NO: 5384
  strain C231

SEQ ID NO: 5388 - protein, 383 aa, Corynebacterium pseudotuberculosis; identical to SEQ ID NO: 5385
  strain C231

SEQ ID NO: 5389 - protein, 425 aa, Corynebacterium pseudotuberculosis; identical to SEQ ID NO: 5386
  strain C231

SEQ ID NO: 5390 - protein, 271 aa, Corynebacterium pseudotuberculosis
  strain C231
MMQKQRIIYNGVRRNLMLATSIAFTAGLVYGGGMLEPSMNSLILPSASAAVTGFPRPVPPLENIDLERKASVTIKIPDSSSGTNAGLPGYEVTVILLKTDPINTSEGYAKASKLTVEQAKKLEELRHYSGVTDAKGEANFSELVPGAYLVTTKSPKPGDRKPQEEVLIAPIIGENGEWDYSFTAVMKFKNNPKPGPTLPPWVPPVTQTTPPPTKDEQPPASDNPASKQNKKREALPLTGASVVGLIVISLSLIAGGFFLLVSRKNGENSTY

SEQ ID NO: 5391 - protein, 207 aa, Corynebacterium pseudotuberculosis; identical to SEQ ID NO: 5384
  strain FRC41

SEQ ID NO: 5392 - protein, 383 aa, Corynebacterium pseudotuberculosis; identical to SEQ ID NO: 5385
  strain FRC41

SEQ ID NO: 5393 - protein, 425 aa, Corynebacterium pseudotuberculosis; identical to SEQ ID NO: 5386
  strain FRC41

SEQ ID NO: 5394 - protein, 270 aa, Corynebacterium pseudotuberculosis; identical to SEQ ID NO: 5383
  strain FRC41

SEQ ID NO: 5395 - protein, 207 aa, Corynebacterium pseudotuberculosis; identical to SEQ ID NO: 5384
  strain I19

SEQ ID NO: 5396 - protein, 383 aa, Corynebacterium pseudotuberculosis; identical to SEQ ID NO: 5385
  strain I19

SEQ ID NO: 5397 - protein, 425 aa, Corynebacterium pseudotuberculosis; identical to SEQ ID NO: 5386
  strain I19

SEQ ID NO: 5398 - protein, 271 aa, Corynebacterium pseudotuberculosis; identical to SEQ ID NO: 5390
  strain I19

SEQ ID NO: 5399 - protein, 207 aa, Corynebacterium pseudotuberculosis 1/06-A; identical to SEQ ID NO: 5384

SEQ ID NO: 5400 - protein, 270 aa, Corynebacterium pseudotuberculosis 1/06-A
MQKQRIIYNGVRRNLMLATSIAFTAGLVYGGGMLEPSTNSLILPSASAAVTGFPGAVSPLEGIDLERKASVTIKIPDSSSGTNAGLPGYEVTVILLKTDPINTSEGYTKASKLTVEQAKKLEELRRYSGVTDAKGEANFPELTPGAYLITAKSPKSGDPEPQEEVLIVPIVGENGEWDYSFTAVMKFKNDPKPGPTLPPWVPPVTQTTPPPTKDEQPPASDNPASKQNKKREALPLTGASVVGLIVISLSLIAGGFFLLVSRKNGENSTY

SEQ ID NO: 5401 - protein, 383 aa, Corynebacterium pseudotuberculosis 1/06-A
MGTRQKSRINRVNSSKSIPLRLATGGVLASLAVGGVAVTQVKKDITVDVNGEQLTLATMSGTVEEALAKAGVTVGDKDIVYPGLTEKISNQDTIKVRTSKQVSVAIDGVEKNLTTNATTVEELFTQLDGLNATLSSAALNLDKDSKIPREGLSLDVVTPKIISVTEAGKTVFTQIAAATVKDVLAQRGIKVDQDDIVTPALDAPVTKNMDVKIDRVDVQEVVANEPFGEPAHYVEDAELPEGEEAEVSAGTPGERTVTRKVTKVNGEETANEVIDEKVITPAVAATVKRGTKKAASAPAVADGSVWDQLAQCESTGNWAINTGNGFSGGLQFTDSTWAGFGGTAYAPRAHLATREQQIAIAQKVQASQGWGAWPACTSKLGLR

SEQ ID NO: 5402 - protein, 425 aa, Corynebacterium pseudotuberculosis 1/06-A; identical to SEQ ID NO: 5386

SEQ ID NO: 5403 - protein, 207 aa, Corynebacterium pseudotuberculosis 3/99-5; identical to SEQ ID NO: 5384

SEQ ID NO: 5404 - protein, 383 aa, Corynebacterium pseudotuberculosis 3/99-5; identical to SEQ ID NO: 5385

SEQ ID NO: 5405 - protein, 271 aa, Corynebacterium pseudotuberculosis 3/99-5; identical to SEQ ID NO: 5390

SEQ ID NO: 5406 - protein, 425 aa, Corynebacterium pseudotuberculosis 3/99-5; identical to SEQ ID NO: 5386

SEQ ID NO: 5407 - protein, 207 aa, Corynebacterium pseudotuberculosis 316; identical to SEQ ID NO: 5384

SEQ ID NO: 5408 - protein, 383 aa, Corynebacterium pseudotuberculosis 316; identical to SEQ ID NO: 5401

SEQ ID NO: 5409 - protein, 425 aa, Corynebacterium pseudotuberculosis 316; identical to SEQ ID NO: 5386

SEQ ID NO: 5410 - protein, 255 aa, Corynebacterium pseudotuberculosis 316
MLATSIAFTAGLVYGGGMLEPSTNSLILPSASAAVTGFPGAVSPLEGIDLERKASVTIKIPDSSSGTNAGLPGYEVTVILLKTDPINTSEGYTKASKLTVEQAKKLEELRRYSGVTDAKGEANFPELTPGAYLITAKSPKSGDPEPQEEVLIVPIVGENGEWDYSFTAVMKFKNDPKPGPTLPPWVPPVTQTTPPPTKDEQPPASDNPASKQNKKREALPLTGASVVGLIVISLSLIAGGFFLLVSRKNGENSTY

SEQ ID NO: 5411 - protein, 207 aa, Corynebacterium pseudotuberculosis 42/02-A; identical to SEQ ID NO: 5384

SEQ ID NO: 5412 - protein, 270 aa, Corynebacterium pseudotuberculosis 42/02-A; identical to SEQ ID NO: 5383

SEQ ID NO: 5413 - protein, 383 aa, Corynebacterium pseudotuberculosis 42/02-A; identical to SEQ ID NO: 5385

SEQ ID NO: 5414 - protein, 425 aa, Corynebacterium pseudotuberculosis 42/02-A; identical to SEQ ID NO: 5386

SEQ ID NO: 5415 - protein, 207 aa, Corynebacterium pseudotuberculosis CIP 52.97; identical to SEQ ID NO: 5384

SEQ ID NO: 5416 - protein, 270 aa, Corynebacterium pseudotuberculosis CIP 52.97; identical to SEQ ID NO: 5400

SEQ ID NO: 5417 - protein, 383 aa, Corynebacterium pseudotuberculosis CIP 52.97; identical to SEQ ID NO: 5401

SEQ ID NO: 5418 - protein, 425 aa, Corynebacterium pseudotuberculosis CIP 52.97
MADIMHVFAREILDSRGNPTVEAEVFLDDGAHGIASVPSGASTGIHEAHELRDGGDRYLGKGVLNAVNNINEEIADAVAGAEADDQRLIDQAMIALDGTENKSRLGANAILGVSMAVAKAAAESAGLPLYRYIGGPNAHLLPVPMMNIVNGGAHADSGVDVQEFMIAPIGAESFSEALRMGAEVYHSLKSVIKSKGLSTGLGDEGGFAPSVESTKAALDLIVEAIEKAGMKPGTDIALALDVASSEFFKDGKYHFEGGEHTAEEMAKVYADLIEQYPIVSIEDPLQEDDWEGYTNLTAAIGDKVQIVGDDFFVTNPVRLQEGIDKKAANALLVKVNQIGTLTETFDAVDLAHRNGYRTMMSHRSGETEDTTIADLSVALGCGQIKTGAPARSERVAKYNQLLRIEQELGDAAVYAGRSAFPRFRN

SEQ ID NO: 5419 - protein, 383 aa, Corynebacterium pseudotuberculosis PAT10; identical to SEQ ID NO: 5385

SEQ ID NO: 5420 - protein, 425 aa, Corynebacterium pseudotuberculosis PAT10; identical to SEQ ID NO: 5386

SEQ ID NO: 5421 - protein, 207 aa, Corynebacterium pseudotuberculosis PAT10; identical to SEQ ID NO: 5384

SEQ ID NO: 5422 - protein, 261 aa, Corynebacterium resistens
  strain DSM 45100 / JCM 12819 / GTC 2026
MPKGRGSSDLRLDTNHHGWPLPPHRETKRTVQVHSKSSRVSLARTRRETVETMGRHTKQNSFSTTARLTLAGMAVVGASAAIAPAASAAPDSDWDRLAQCEAGGNWQINTGNGFHGGLQFSPSTWNAHGGQKYAPYAYQATREQQIAVAEKVLASQGWGAWPACSAKLGLNSAPTPRTAAAKPKAAPKPAPAPAVQKAVKDLAAQKNTLAVDAVWDKVVKRIEAAGYSVPPQLTHFYKAHRHQLNAFYNANKHAVHAVIPR

SEQ ID NO: 5423 - protein, 425 aa, Corynebacterium resistens
  strain DSM 45100 / JCM 12819 / GTC 2026
MAEIMQIIAREILDSRGNPTVEVEVGLDDGSIGRAAVPSGASTGVHEAHELRDGDERYLGKGVLKAVENVIDEIDDELVGMEADDQRLIDEAMIELDGTDNKSRLGANAILGVSMAVAHAAAESTGLHLFRYVGGPNAHVLPVPMMNILNGGAHADSGVDVQEFMIAPIGAETFSDALRMGTEVYHQLKKVIKDKGLSTGLGDEGGFAPSVDSTKAALDLIVEAIEGAGYKLGEEIALALDVASSEFYKDGKYHFEGGEHTAEEMAKVYEELIDQYPIVSIEDPLQEDDWEGYTNLTAAIGDKVQIVGDDFFVTNPARLQEGIEKKAANALLVKVNQIGTLTETFDAVDLAHRNGYRTMMSHRSGETEDTTIADLAVALNCGQIKTGAPARSERVAKYNQLLRIEQYLDDAAVYAGRSAFPRFQG

SEQ ID NO: 5424 - protein, 394 aa, Corynebacterium resistens
  strain DSM 45100 / JCM 12819 / GTC 2026
MSPKKKSSLHRINNTSSTPLRVATGGMLATLVVGGGVAVAGQKDVTVDVNGKIIEASTMSGTVEGALKSAGVNVNDRSMVTPALGDSIGDSDTITVRTPRQVSLVVDGRKQTVDTTALTVGSLLDQLGRTDAAELLSDARGERIPEEGMTLEVTTPKKFTLNDGGEFGKMSLPAHTVGDIFKLRGTPLGKDDIVKPSADTVLKDGMHVDVTRVVKKRVVEDRAVEAPVKVKEDSNLAEGEEKVVRKGKPGKVRDIFTVRTENGNEISRELVKTREITKPQVRIVIRGTKADDGDASSRKAGGNTGASAPAVAGDSVWDQIAQCESTGNWAINTGNGFSGGLQFTPSTWAGFGGTEYAPAAHMATREQQIAVAKRVQAAQGWGAWPACTSKLGLR

SEQ ID NO: 5425 - protein, 112 aa, Corynebacterium resistens
  strain DSM 45100 / JCM 12819 / GTC 2026
MRKNVKTNLTRFALAAGVVAAPALVAPAANAASVGQWDQVAACESGGDWHINTGNGYQGGLQFSPQTWAGHGGTQYAPTADQATKAQQIEIAEKVLASQGAGAWPNCGGPVG

SEQ ID NO: 5426 - protein, 425 aa, Corynebacterium striatum ATCC 6940
MADIIHVFAREILDSRGNPTVEAEVFLDDGAHGVAGVPSGASTGVHEAHELRDGGERYLGKGVLKAVENVNEEIADEIAGFEADDQRLIDQALIALDGTENKSRLGANAILGVSIAAAKAAAESAALPLYRYIGGPNAHVLPVPMMNIVNGGAHADSGVDVQEFMIAPIGAESFAEALRMGAEVYHSLKSVIKEKGLSTGLGDEGGFAPEAESTKAALDLIVEAIKKAGFEPGKDIALALDVASSEFFKDGKYHFEGGEHTAEEMAKVYEELINEYPIVSIEDPLQEDDWEGYTKLTATIGDKVQIVGDDFFVTNPARLAEGIEKKAANALLVKVNQIGTLTETFDAVELAHRNGYRTMMSHRSGETEDTTIADLAVALNCGQIKTGAPARSERVAKYNQLLRIEQELGEGAVYAGRSAFPRFQG

SEQ ID NO: 5427 - protein, 379 aa, Corynebacterium striatum ATCC 6940
MNQIKRINSSRSLPLRLATGGVLGTLAVGGVVAVSAQKDITLDVNGDKIELATFAGNVDEALQAAGVNVGGEDLVYPAPSEKVADGDNITVRTSKPVAVSIDGVKQQLSSTDLKVSDLLGNLDGIAPGAAITSGDKKVTGDDNLTEGMELEVVSPKIVKINDGGKITYTNIAAKTVKDVIEERGIDVDEDDRVFPSMDTPIVNGMSIKVDQVSTTFYDATEEFEAEPTFVDDPELEEGNEEVRVEAVKGQRNVTRKLVMKDGAKESDEIVKEKVINEPVAATIARGTKKPAAAPAVADGSVWDSLAQCESTGNWAINTGNGFSGGLQFTPSTWAGFGGTAYAPEAWQATREQQIAVAEKVQAAQGWGAWPACTSKLGLR

SEQ ID NO: 5428 - protein, 207 aa, Corynebacterium striatum ATCC 6940
MGRHSAKNNSFATKFAASTVAFGAAAAIMAPTASAAPDSDWDRLAGCESGGNWAINTGNGYYGGLQFSGQTWSAFGGGQYAPTANQATREQQIAIAEKVLASQGWGAWPACSASLGLNSAATPRNLDAAPAAPAAAPAAVKQAAAQPSDELAVDALYAFVEDTAAKYGLSIPVEFANQYKANRHDFNAFYSANRNFIDPIAQLVGNL

SEQ ID NO: 5429 - protein, 111 aa, Corynebacterium striatum ATCC 6940
MRSKKKFATLSAAAAMGVAALATPAANAAPVSAWDQVAACESGGNWLINTGNGYYGGLQFSAQTWSGFGGQQYAPTADQATKEQQIAVAEQVLAAQGAGAWPNCGGPVGGY

SEQ ID NO: 5430 - protein, 83 aa, Corynebacterium striatum ATCC 6940
MLYVGSKYPSNVAVGSREAKAVFRGSTPQWAPPWQVTATYAVGDIVASRGGFWECIKAHSSKNIYEPGSDYGSQDYYWRMYRP

SEQ ID NO: 5431 - protein, 202 aa, Corynebacterium striatum ATCC 6940
MTHDETNTKGEIMSIEQIKESIQQLTDDEVEKLGVWIYGDERERRATLKAVEEAQAEVVKELQDAGKLPLPDALTDPEKLPAAISDVPEWVNPGVDHSMMYREGDIVRHNGRIVRSTHKGLNHWEPGAHGVDEHIWADITDRYTTSQPEEPGTGEVRPFAPGLDVAEGDIVAYEGAHYRVRSAHTTATHWPPDQAHALFEKL

SEQ ID NO: 5432 - protein, 209 aa, Corynebacterium tuberculostearicum SK141; identical to SEQ ID NO: 5382

SEQ ID NO: 5433 - protein, 109 aa, Corynebacterium tuberculostearicum SK141; identical to SEQ ID NO: 5379

SEQ ID NO: 5434 - protein, 425 aa, Corynebacterium tuberculostearicum SK141
MADIIHTFAREILDSRGNPTVEAEVFLDDGARGVAGVPSGASTGVHEAHELRDGGERYQGKGVLKAVENINEKIADEIAGFEADDQRLIDQALIKLDGTDNKSELGANAILGVSIAAAKAAAESAALPLYRYIGGPNAHVLPVPMMNILNGGAHADSGVDVQEFMIAPIGAESFAEALRMGAEVYHALKAVLKDKGLSTGLGDEGGFAPSVDSTKAALDVIVDAIKKAGFEPGKDVALALDVASSEFFKDGKYHFEGGEHTAEEMSKVYEDLIDQYPIVSIEDPLQEDDWEGYTALTAAIGEKVQIVGDDFFVTNPARLQEGIEKKAANALLVKVNQIGTLTETFDAVELAHRNGYRTMMSHRSGETEDTTIADLAVALNCGQIKTGAPARSERVAKYNQLLRIEQELGDGAVYAGRSAFPRFKA

SEQ ID NO: 5435 - protein, 393 aa, Corynebacterium tuberculostearicum SK141
MSPHQIKRLNNSRSLPLRLATGGVLGTLAVGGVVAVAAQKDVTVDINGDKVELATFAKDVDGALEAAGVQVSEEDIVSPAPSESVGDGDEISVRTAKPVAVTIDGVQQQLSTTDLTVSDLLGNLDGVVKGASVKSGDADVDEDAQLEEGMDLEVVSPKIVKINDGGKVTYTKIAAKTVEDVLKARNIDVDDDDRVFPSKDTKVTEGMSIKVDQVSTTTYDSEEEFDAEPNFVDDPELEEGTEEVREEGVKGKRVITHKLVMKDGAKESNDVIKEKVTVEPKAATIARGTKKAEEEKPEEGGNSGAAAPAVADGSVWDSIAQCEATGNWSINTGNGFSGGLQFTPSTWAAFGGTEYAPEAWQASREQQIAVAEKVQAAQGWGAWPACTSKLGLR

SEQ ID NO: 5436 - protein, 560 aa, Corynebacterium ulcerans
MNRKLFASILIGVLLGIGAPPSAHAGADDVVDSSKSFVMENFSSYHGTKPGYVDSIQKGIQKPKSGTQGNYDDDWKGFYSTDNKYDAAGYSVDNENPLSGKAGGVVKVTYPGLTKILALKVDNAETIKKELGLSLTEPLMEQVGTEEFIKRFGDGASRVVLSLPFAEGSSSVEYINNWEQAKALSVELEINFETRGKRGQDAMYEYMAQSCAGSRVRRSVGSSLSCINLDWDAIRDKTKTKIESLKEHGPIKNKMSESPNKTVSEEKAKQYLEEFHQTALEHPELSELKTVTGVNSVFAGANYASWAVNVAQVVDSKTADNLEKTTAALSILPGIGSVMGIADGAVHHNTEEIVAQSIALSSLMVAQAIPLVGELVDLGFAAYNFVESIINLFQVVHNSYNRPAYSPGHKTQPFVHGGYAASWNTVEDSIIKTGFQGESGHDIKITAENTPLPIAGVLLPTIPGKLDVNKSKTHISVNGRKIRMRCRAIDDATIFCRPKTPVYVGNGVHANLHVAFHRSSSEKIHSDETPLSSIDVLGYQKTVDHTKVNSKLSLFAEVKS

SEQ ID NO: 5437 - protein, 560 aa, Corynebacterium ulcerans
MNRKLFASILIGAILGIGAPPLAHAGADDVVDSSKSFVMENFSSYHGTKPGYVDSIQKGIQKPKSGAQGNYDDDWKGFYSTDNKYDAAGYSVDNENPLSGKAGGVVKVTYPGLTKILALKVDNAETIKKELGLSLTEPLMEQVGTEEFIKRFGDGASRVVLSLPFAEGSSSVEYINNWEQAKELSVELEINFETRGKRGQDAMYEYMAQSCAGNRVRRSVGSSLSCINLDWDAIRDKTKTKIESLKEHGPIKNKMSESPNKTVSEEKAKQYLEEFHQTALEHPELSELKTVTGVNSVFAGANYASWAVNVAQVVDSKTADNLEKTTAALSILPGIGSVMGIADGAVHHNTEEIVAQSIALSSLMVAQAIPLVGELVDLGFAAYNFVESIINLFQVVHNSYNRPAYSPGHKTQPFVHGGYAASWNTVEDSIIKTGFQGESGHDIKITAENTPLPIAGVLLPTIPGKLDVNKSKTHISVNGRKIRMRCRAIDDATTFCRPKTPVYVGNGVHANLHVAFHRSSSEKIHSDETPLSSIDVLGYQKTVDHTKVNSKLSLFAEVKS

SEQ ID NO: 5438 - protein, 291 aa, Corynebacterium ulcerans
VVLSLPFAEGSSSVEYINNWEQAKALSVELEINFETRGKRGQDAMYEYMAQSCAGNRVRRSVGNSSSCINLDWDAIRDKTKTKIESLKEHGPIKNKMSESPNKAVSEEKAKQYLEEFHQTALEHPELSELKTVTGTNSVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIQTGFQGESGHDIKITAEN

SEQ ID NO: 5439 - protein, 291 aa, Corynebacterium ulcerans
VVLSLPFAEGSSSVEYINNWEQAKELSVELEINFETRGKRGQDAMYEYMAQSCAGNRVRRSVGSSLSCINLDWDAIRDKTKTKIESLKEHGPIKNKMSESPNKTVSEEKAKQYLEEFHQTALEHPELSELKTVTGVNSVFAGANYASWAVNVAQVVDSKTADNLEKTTAALSILPGIGSVMGIADGAVHHNTEEIVAQSIALSSLMVAQAIPLVGELVDLGFAAYNFVESIINLFQVVHNSYNRPAYSPGHKTQPFVHGGYAASWNTVEDSIIKTGFQGESGHDIKITAEN

SEQ ID NO: 5440 - protein, 291 aa, Corynebacterium ulcerans
VVLSLPFAEGSSSVEYINNWEQAKELSVELEINFETRGKRGQDAMYEYMAQSCAGNRVRRSVGSSLSCINLDWDAIRDKTKTKIESLKEHGSIKNKMSESPNKTVSEEKAKQYLEEFHQTALEHPELSELKTVTGVNSVFAGANYASWAVNVAQVVDSKTADNLEKTTAALSILPGIGSVMGIADGAVHHNTEEIVAQSIALSSLMVAQAIPLVGELVDLGFAAYNFVESIINLFQVVHNSYNRPAYSPGHKTQPFVHGGYAASWNTVEDSIIKTGFQGESGHDIKITAEN

SEQ ID NO: 5441 - protein, 560 aa, Corynebacterium ulcerans
MNRKLFASILIGAILGIGAPPSAHAGADDVVDSSKSFVMENFSSYHGTKPGYVDSIQKGIQKPKSGAQGNYDDDWKGFYSTDNKYDAAGYSVDNENPLSGKAGGVVKVTYPGLTKILALKVDNAETIKKELGLSLTEPLMEQVGTEEFIKRFGDGASRVVLSLPFAEGSSSVEYINNWEQAKELSVELEINFETRGKRGQDAMYEYMAQSCAGNRVRRSVGSSLSCINLDWDAIRDKTKTKIESLKEHGPIKNKMSESPNKTVSEEKAKQYLEEFHQTALEHPELSELKTVTGVNSVFAGANYASWAVNVAQVVDSKTADNLEKTTAALSILPGIGSVMGIADGAVHHNTEEIVAQSIALSSLMVAQAIPLVGELVDLGFAAYNFVESIINLFQVVHNSYNRPAYSPGHKTQPFVHGGYAASWNTVEDSIIKTGFQGESGHDIKITAENTPLPIAGVLLPTIPGKLDVNKSKTHISVNGRKIRMRCRAIDDATTFCRPKTPVYVGNGVHANLHVAFHRSSSEKIHSDETPLSSIDVLGYQKTVDHTKVNSKLSLFAEVKS

SEQ ID NO: 5442 - protein, 560 aa, Corynebacterium ulcerans
MNRKLFASILIGAILGIGAPPLAHAGADDVDDSSKSFVMENFSSYHGTKPGYVDSIQKGIQKPKSGAQGNYDDDWKGFYSTDNKYDAAGYSVDNENPLSGKAGGVVKVTYPGLTKILALKVDNAETIKKELGLSLTEPLMEQVGTEEFIKRFGDGASRVVLSLPFAEGSSSVEYINNWEQAKALSVELEINFETRGKRGQDAMYEYMAQSCAGNRVRRSVGSSLSCINLDWDAIRDKTKTKIESLKEHGPIKNKMSESPNKIVSEEKAKQYLEEFHQTALEHPELSELKTVTGVNSVFAGANYASWAVNVAQVVDSKTADNLEKTTAALSILPGIGSVMGIADGAVHHNTEEIVAQSIALSSLMVAQAIPLVGELVDLGFAAYNFVESIINLFQVVHNSYNRPAYSPGHKTQPFVHGGYAASWNTVEDSIIKTGFQGESGHDIKITAENTPLPIAGVLLPTIPGKLDVNKSKTHISVNGRKIRMRCRAIDDATTFCRPKTPVYVGNGVHANLHVAFHRSSSEKIHSDETPLSSIDVLGYQKTVDHTKVNSKLSLFAEVKS

SEQ ID NO: 5443 - protein, 560 aa, Corynebacterium ulcerans
MNRKLFASILIGALLGIGAPPSAHAGADDVVDSSKSFVMENFSSYHGTKPGYVDSIQKGIQKPKSGAQGNYDDDWKGFYSTDNKYDAAGYSVDNENPLSGKAGGVVKVTYPGLTKILALKVDNAETIKKELGLSLTEPLMEQVGTEEFIKRFGDGASRVVLSLPFAEGSSSVEYINNWEQAKELSVELEINFETRGKRGQDAMYEYMAQSCAGNRVRRSVGSSLSCINLDWDAIRDKTKTKIESLKEHGPIKNKMSESPNKTVSEEKAKQYLEEFHQTALEHPELSELKTVTGVNSVFAGANYASWAVNVAQVVDSKTADNLEKTTAALSILPGIGSVMGIADGAVHHNTEEIVAQSIALSSLMVAQAIPLVGELVDLGFAAYNFVESIINLFQVVHNSYNRPAYSPGHKTQPFVHGGYAASWNTVEDSIIKTGFQGESGHDIKITAENTPLPIAGVLLPTIPGKLDVNKSKTHISVNGRKIRMRCRAIDDATTFCRPKTPVYVGNGVHANLHVAFHRSSSEKIHSDETPLSSIDVLGYQKTVDHTKVNSKLSLFAEVKS

SEQ ID NO: 5444 - protein, 560 aa, Corynebacterium ulcerans
MNRKLFASILIGALLGIGAPPSAHAGADDVVDSSKSFVMENFSSYHGTKPGYVDSIQKGIQKPKSGTQGNYDDDWKGFYSTDNKYDAAGYSVDNENPLSGKAGGVVKVTYPGLTKILALKVDNAETIKKELGLSLTEPLMEQVGTEEFIKRFGDGASRVVLSLPFAEGSSSVEYINNWEQAKELSVELEINFETRGKRGQDAMYEYMAQSCAGNRVRRSVGSSLSCINLDWDAIRDKTKTKIESLKEHGPIKNKMSESPNKTVSEEKAKQYLEEFHRTALEHPELSELKTVTGVNSVFAGANYASWAVNVAQVVDSKTADNLEKTTAALSILPGIGSVMGIADGAVHHNTEEIVAQSIALSSLMVAQAIPLVGELVDLGFAAYNFVESIINLFQVVHNSYNRPAYSPGHKTQPFVHGGYAASWNTVEDSIIKTGFQGESGHDIKITAENTPLPIAGVLLPTIPGKLDVNKSKTHISVNGRKIRMRCRAIDDATTFCRPKTPVYVGNGVHANLHVAFHTSSSEKIHSDETPLSSIDVLGYQKTVDHTKVNSKLSLFAEVKS

SEQ ID NO: 5445 - protein, 207 aa, Corynebacterium ulcerans
  strain BR-AD22
MARHARKSASALAKIAASTVAVGSAATLFAPTASAAPDSDWDRLAGCESGGNWAINTGNGYYGGIQFSASTWKGFGGGQYAPTADKATREQQIAVAEKVLASQGWGAWPSCSAKLGLNSAPTPRDSVASAPAPLQQIVDDAQNYAAASGQNADKLAVDAVYKVVKERLAGYGIGVHPEIDAFYQANNNNFDAFYQANRQVIDTVMGM

SEQ ID NO: 5446 - protein, 383 aa, Corynebacterium ulcerans
  strain BR-AD22
MGTRQKSRINRVNSSRSIPLRLATGGVLASLAVGGVAVTQVKKDITVDVNGEQLSLATMSDTVEEALSKAGVTVGDKDIVYPGLTEKISNQDTITVRTSKQVSVAIDGVEKDLTTNATTVEELFEQLDGVNATLSAAALNMDKDSKIPREGLSLDVVTPKIISVTDAGKTVFTQIAAATVKDVLAERGIKVDNDDIVTPALDAPVTKNMDVKIDRVDIQEVVANEPFGEPANYVDDAELPEGEEAEVSAGTPGERTVTRKVTKVNGEETANEVIDEKVITPAVAATIKRGTKKAASAPAVANGSVWDQLAQCESTGNWAINTGNGFSGGLQFTDSTWAGFGGTAYAPRAHLATREQQIAVAQKVQAAQGWGAWPACTSKMGLR

SEQ ID NO: 5447 - protein, 425 aa, Corynebacterium ulcerans
  strain BR-AD22
MADIMHVFAREILDSRGNPTVEAEVFLDDGAHGIAGVPSGASTGIHEAHELRDGGDRYLGKGVLNAVNNINEEIADAIAGAEADDQRLIDQAMIALDGTENKSRLGANAILGVSMAVAKAAAESAGLPLYRYVGGPNAHLLPVPMMNIVNGGAHADSGVDVQEFMIAPIGAESFSEALRMGAEVYHSLKSVIKSKGLSTGLGDEGGFAPSVESTKAALDLIVEAIEKAGMKPGADIALALDVASSEFFKDGKYHFEGGEHTAEEMAKVYADLIEQYPIVSIEDPLQEDDWEGYTNLTAAIGDKVQIVGDDFFVTNPARLQEGIDKKAANALLVKVNQIGTLTETFDAVDLAHRNGYRTMMSHRSGETEDTTIADLSVALGCGQIKTGAPARSERVAKYNQLLRIEQELGDAAVYAGRSAFPRFRD

SEQ ID NO: 5448 - protein, 547 aa, Corynebacterium ulcerans
  strain BR-AD22
MYGLDNLLKFAVSANKSVRSQSKEDIVLNKFSRTTRTAAVAAIAGLSLSLSMPVAFAEEPVAVAAATASDSPLVNPNAKGSLTIHKYADPERVGTPTGTIKDAESISGEKLDGVEFTIYKIKDIDLTTNDGIAAAAKKTAADYITAGVVDADKVTEIKKETTRDGKVVLSDLSLGAYLVVETGPLPGYTPAIPFVAYVPMTEGNSGDNQGVKWNYDVHAFPKNFKEEKPSKTVEDKDQNADGAVVYTVSGTVRRLAEGEKLTQFEITDQVDKKLQVTDVKVFLGDVELSKDSYEDPAFTENNVHVKLTAQGLSQLVTGSKVSVKITTKVLNSIEDLKVENSATVYQNKPGGQQDTTGTPTPTVRTYWGGVQFKKVDKERGGLSGAEFRIIRSASETCEDVNVKDTKSIESSSVNGLQNGKVSQLFTSEEDGKALITGLHVNDFADNAVVDPASTYCLVETKAPKGKELLSKAIPFQLKAEPGATAENREYKLASIKVGDVDGEVVNIDDTTPQLPLTGGAGIGILAALGALIIGAGAWLARRNSAKN

SEQ ID NO: 5449 - protein, 207 aa, Corynebacterium ulcerans 809; identical to SEQ ID NO: 5445

SEQ ID NO: 5450 - protein, 383 aa, Corynebacterium ulcerans 809
MGTRQKSRINRVNSSRSIPLRLATGGVLASLAVGGVAVTQVKKDITVDVNGEQLSLATMSDTVEEALSKAGVTVGDKDIVYPGLTEKISNQDTITVRTSKQVSVAIDGVEKDLTTNATTVEELFEQLDGVNATLSAAALNMDKDSKIPREGLSLDVVTPKIISVTDAGKTVFTQIAAATVKDVLAERGIKVDSDDIVTPALDAPVTKNMDVKIDRVDIQEVVANEPFGEPANYVDDAELPEGEEAEVSAGTPGERTVTRKVTKVNGEETANEVIDEKVITPAVAATIKRGTKKAASAPAVANGSVWDQLAQCESTGNWAINTGNGFSGGLQFTDSTWAGFGGTAYAPRAHLATREQQIAVAQKVQAAQGWGAWPACTSKMGLR

SEQ ID NO: 5451 - protein, 425 aa, Corynebacterium ulcerans 809; identical to SEQ ID NO: 5447

SEQ ID NO: 5452 - protein, 112 aa, Corynebacterium urealyticum
  strain ATCC 43042 / DSM 7109
MRKSVKTNLTRLAMAAGVIAAPALVAPTANAASVDQWDQVAACESGGDWHINTGNGYYGGLQFSAQTWAGFGGTQYAPTADQATKEQQIEIAEKVLAGQGAGAWPNCGGPVA

SEQ ID NO: 5453 - protein, 386 aa, Corynebacterium urealyticum
  strain ATCC 43042 / DSM 7109
MSPKKKSSLHRINNTNSTPLRLATGGMLATLVVGGGVAAAAHKNITLDVNGEIIEASSVTGNVGDILEKNGVEVNPKDLVSPAPSESVSNNDTIKVRSAKQVALIIDGKRENVDTTSVTVEEMLRQVGKYDEIATGSLSAGMNTKIPAEGMDLDVTTSKYFTLNDGGKQGRMKLPARTVGDIFELRGTPLGEDDIVTPSADTPLREGMHIDVVRVSKKDHTFERTVAAPEREIEDANLPEGERKVVKEGKDGKERVKLLVTRHNGKVTDRKVLEREELEAPVEAVVKVGTKPKKPAGPDAPAVANGSVWDELAQCESTGNWSINTGNGFSGGLQFTPSTWAGFGGTEYAPAAHMATREQQIAVAERVQAAQGWGAWPACTAKMGLR

SEQ ID NO: 5454 - protein, 425 aa, Corynebacterium urealyticum
  strain ATCC 43042 / DSM 7109
MAGILNVSALEIMDSRGNPTVEVEVILDDGSMGRAAVPSGASTGVHEAHELRDGGDRYLGKGVAKAVDFVNTEIDDALAGLEADDQRLIDQTLLELDGTENKSRLGANALLGVSMAVAHAAADSAGLELFRYVGGPNGHVLPVPMMNILNGGAHADSGVDVQEFMIAPIGAETFAEALQVGAEVYHSLKDVIKAKGLSTGLGDEGGFAPSVESTKAALDLIVEAIEKAGYTLGEDVALALDVASSEFYEDGVYNFEGGKHSSAEMVEVYADLVEQYPIVSIEDPLDEDDWEGYVTLTEKLGDKIQIVGDDLFVTNPSRLQEGIDRGAANALLVKVNQIGTLSETFDAVELAHRNGYRTMMSHRSGETEDTTIADLAVALNCGQIKTGAPARSERVAKYNQLLRIERYLEGAAVYAGRSAFPRFKN

SEQ ID NO: 5455 - protein, 255 aa, Corynebacterium urealyticum
  strain ATCC 43042 / DSM 7109
MFSAQSRTLTASRTSARRTIEAREHETNGFRPVTAPATGRETQEKMGRHSKRNSISTVGRIAVAGAALSAGAAAFAPAASAAPDSDWDRLAQCEAGGNWQINTGNGYHGGLQFSPSTWNAYGGQKYAPYAYQASREQQIAVAEKVLAGQGWGAWPSCSAQLGLNSAPTQRDVPAKKAAPQATAKKAVSQLAQQKDVLAIDKVYQQIVERFEAAGLAVPAPVEEFYKAHRVNLNNHLNAHNARVAQAQQILNQFGL

SEQ ID NO: 5456 - protein, 207 aa, Corynebacterium variabile
  strain DSM 44702 / JCM 12073 / NCIMB 30131
MNSRYTRTTLAALTASVLSVGALAACGDDSDDAKSTVTVTQSAPADNTSGSDSTAATTTSQSDGSGSSDHTDARTSAVDAAGALEAALDAKPGSYAVEVDEEDGRAWEITLVADGKGVEVTVDNATGEVTGEQSTDLDAEQREAPSVTAAEAVDAALAEKPGTLDSLDLDQDNGTIVWDATVIDGTREWDIVIDASSGDILRANQDD

SEQ ID NO: 5457 - protein, 203 aa, Corynebacterium variabile
  strain DSM 44702 / JCM 12073 / NCIMB 30131
MGRHNTRTRLTSTKRLAVAGIAVAGIGAALAPAATAAPDSDWDALAQCEAGGNWAINTGNGFHGGLQFSPSTWNGYGGQEFAPYAYQASRQEQIVVGERVLAGQGWGAWPSCSSQLGLSSAPTERSAPAAAPASQNQVQQLNAADDVLEIDAVWKQLNDEAAARGIAVPKEVTDAYNANRNALNDQYSAALDGFNAAATALKF

SEQ ID NO: 5458 - protein, 333 aa, Corynebacterium variabile
  strain DSM 44702 / JCM 12073 / NCIMB 30131
MTNPTGPVEPGDQNPQGPQDPQGQSYPQGMPGQPGQQSQPYYQSAPGQPGQSYSQWPQDQQYYQGQPGYPGQQYPQYGQPQTKEKNTVGLIGLIIAVIGFIFACIPGALILGWILLPIGFIVSLVSLFLKGKKPGLGIAGLIVSVVGTVVGFSVFFLVVDDVVDDALDEIGSGGDVSVAVPEGAETDGDGDAGTRENPYPLGSTVTDKDWSVTINSVDLDAAAAINGENSYNDPAPEGMTYILVNVTINYIGDSDGGEMPWTTVDYVTPDGNTISSTDNFVMAPDSLDTISELYKGGSTSGNIALAVPQETVGDGVLAVSPGMLSGKTFVSVR

SEQ ID NO: 5459 - protein, 428 aa, Corynebacterium variabile
  strain DSM 44702 / JCM 12073 / NCIMB 30131
MAEIMQINARDILDSRGNPTVEVEVFLEDGSIGRADVPSGASTGVHEAHELRDGGDRYLGKGVQQAVDFVNGEIDEALAGYEADDQRLIDTKLIELDGTDNKSRLGANAILGVSLAVAKAAAESANLHLFRYVGGPNGHVLPVPMMNILNGGAHADSGVDVQEFMIAPIGAETFSEALRTGAEVYHSLKKVIKDKGLSTGLGDEGGFAPSVGSTREALDLIDEAVSAAGYTLGKDVALALDVAASEFYDNDKGVYNFEGGQHSAAEMAQVYKELVEEYALVSIEDPLNEDDWEGWATLTAEIGDKVQLVGDDLFVTNPARLQEGIDKNVANALLVKVNQIGTLTETLDAVALAHNNGYRSMMSHRSGETEDTTIADLAVALNCGQIKTGAPARSERVAKYNQLLRIESYLEGAATYAGASAFPRFTAK

SEQ ID NO: 5460 - protein, 376 aa, Corynebacterium variabile
  strain DSM 44702 / JCM 12073 / NCIMB 30131
MKNKSTLHRINHTRSVPLRVATGGMLATLVVGGAVVATNHKDVTLDVNGKILKASTVRGDVESILSSEGVDVSDGDLVTPGLSESVSDGSHVTVRFARQVALVVDGQSRTVDTTKMTVSELLDELDIDADSTTASASAIPLDGMELDITSPKIFTLNDGQPDETPARLTMSAPTVADVLEMRGAPLGKEDVVTPSADTPVTDDMHIDVTRKTSEEVTEEQEIAPPEKVIEDPDMAKGEEEVIEEGTAGTARVTVRVHTLNGVETNRDELKREEIKPATERVVRRGTGSSAPSVSDGSVWDQLAQCEATGDWSINTGNGFSGGLQFTPSTWAAFGGTEYAPEAYMASREEQIAVAEKVQAAQGWGAWPACTSSMGMR

SEQ ID NO: 5461 - protein, 1400 aa, Cyanothece sp.
  strain PCC 7424
MADFILDAQGGILTGTNEADLISFAVNITGQINSLEGNDTIQSLGGNSVTGTQIILANQGDDLISSASTGGFLTTIEAYGGQGNDTVVGGNFNDTLYGSEGFDTIQGGGGDDSIGGGLQTASQTSDLADTIDGGEGNDIIFGNLGIDTLVGNIGNDTVFGGRDGDSIDGGLDNDSLVGGEGADTITGGTGNDTLVGGLQTSSQTGDLADNLNGGLGNDVIFGNLGNDTLIGDIGDDILFGGRDNDTLSGGANNDSLVGGEGADTITGDEGDDTIRGGLQTASQSDDLADSLNGGLGNDLIFGNLGNDTLLGDIGDDILFGGIDNDSIDGGADQDSLVGGENIDTITGGAGNDTIIGGLQSGDQSNDEADNINGGVGNDSILGNIGVDTLLGDAGNDIIFGGRDNDSIDGGTENDSLIGGEGTDTLVGGNGNDTIIGGLQTADQSGDQGDTITGGDGNDSILGNSGVDTLLGDGGNDALFGGRDNDTIDGGENDDTLVGGEGTDTLVGGNGADSILGGLQSEAQTGDLADTILGGAGNDTISGNLGDDTIDGGDNKDRINGNEGADSLVGGAGTDTIDGGEGNDTINGNEDNDSLFGGAGTDTISGNLGDDTIDGGEGNDTINGNEDNDSLFGGAGTDTISGNLGDDTIDGGEGNDTINGNEDNDSLFGGAGTDTISGNLGDDTIDGGEGNDTINGNEDNDSLFGGAGNDTIDGGEGNDTINGNEDNDSLLGGAGNDSIDGGAGNDTINSNDAANPGEIETLIGGAGADNITGGNGNDSIYGGFSTGAQTGDEADSINGGAGNDTIFGNLGNDTIDGGEGNDTINGNEDNDSLFGGAGNDSIDGGAGNDTINSNDPAVGGTETLIGGAGADNITGGNGNDSIYGGFSTGAQTGDEADSINGGAGNDTIFGNLEDDTIDGGNNNDRISGNEGNDSLLGGAGNDTIFGNLGNDSIDGGSGTDSLIGGEGGDTLNGGDTEGDIIYGGFVGNNQNNDEADSINGGAGNDTLYGNLDNDTIDGGNDEDTIYGGEGTDSLLGRDGNDSIYGGFSGNNQTGDEADSINGGAGNDTISGNLGDDTIDGDNNNDRISGNEDNDSLLGGAGTDTLFGNSGHDTIDGGEDNDTINGNQDRDKLLGGAGGDSLVGDTGDDTIYGGFSGDTQTGDLADTIDGGTANDLLFGNLGNDSIVGGTGDDIIYGNEDGDTLLGGNNNDTIYGGFSGDTQAGDLADTIDGGIANDILFGNLGNDSIVGGTGNDTLIGGSGADTLTGGSNNDHFRYLAASDSNNSTVDRIIDFANSDRISLATNLFGLTFNANASKTFETVAPIGGTTFTSVADIYGGITGLTASVAGDLTVANVTVNGGTFAGRYLFINDQFAEASATNDILIRFSTNVTLNPNNIVFFT

SEQ ID NO: 5462 - protein, 749 aa, Cyanothece sp.
  strain PCC 7424
MGGCGSFCTAEKCNDLQRQINALEIKIDECCRSGREGPPGPPGEKGDKGDKGDKGDPGEKGDKGDKGDKGDPGEKGDKGDKGDKGDPGEKGDKGDKGDKGDPGEKGDKGDKGDKGDPGERGRDGLTIVGPEGPPGPPGQPGVTGKTGEPGPPGEKGDKGDPGKDADSSLVSGVLGDLGIISDLEDLKRQLGGGGMSLDDLDAKLDEILDKLNGCCSTTEMISATTTDIKSETGNIQNGIGDLQRRSEVLGVRFDDFGYQLGAIFDFNFPPSPDPIELGDCREVLDADGNRQKVFVPGAFVGTYKNEKELMVIAVRHLDRLFKHICESSTATQAQDDRLWKLLGGDSLFEYDGTNIVEQTLDVESLIKAKVSQLTTDNEEQDRAKGNVVIKHLPDYLEALTSVEYWRGGHNEYPLKLPEDLTLSLSEVKNKLEIEPTSEWKWSDLTEAQEEILSIELETDLDWEVWRQKNDYDTYGKFPYEIKIEKNTLLKQDIDIREIKEGNDPPRYRYETSFVDAAEDDNIEISSLSDGLAEIMGFIIAEATNNKLLKELNSRQMFEVASLRQMLTSLYSKFESLQAYLGYKVTEQQDEYWLSFNPSPRQVNENDDQILELLNFLKPSRVFYTKELFGGKRNEALDAKINECLTASAIIKARYSESFSVFSQFVDFEGQLKEKFANSKDLISKIINKDGLTNDDPDRPDKTEFDDFIEEVEKGFSQQIGDIDQDGNPREPYGRGYGERPRIQRFKGSP

SEQ ID NO: 5463 - protein, 385 aa, Cyanothece sp.
  strain PCC 7424
MSDNTMDLNQSNDQLQNSSQSNQKPNPIDTVATGVGVVSGGLAGAAIGRLVGGRLGAAVGAVIGGVAGANVGHEVAEGVDHSIEGVVDNVKNNVKQTVEEIKPSVKETVNSLKQTVEEVKPSVSGAVDSVRQTIDETRPSMKKAIDAATETIDETRPAIVETADTVKETVKDARPAVKKAVDKTSESIQSSTESLAKSVQGAGESVKDAAQEAKPKMRRAMESVSDDVQSSASKVADSVKGAASNQNTTPTSSINRATQEVSSVRTQSSTEQTVDLTKQMTSSAPISGSGASQNFDLAQREFEQGIKLASQNDFTGAQTAFRNGIKVMPESPELHYNLGVVLLEQGKKTEGIDYIRQARDLSRIQGNTQAAKTLENILKQIEVVK

SEQ ID NO: 5464 - protein, 734 aa, Cyanothece sp.
  strain PCC 7424
MNNYCYPLILGGMASLFLSIQPSLLASAESFDSRQEKNSSQQQNPFDSPQSSVESLSLSSDEFFSPEISSKPFSIESIGQDIDKSSSIEESSLNFPILESDKIKDQELITQSTPMISQPEIIIEENNQMLEPSVPAYPVVPRAVAPPVGDMAVSNIDAMADTINLGTAAIIPRLVLREAPAREVLAVLARYAGFNLIFTDTQTAAPEGQGGAVGSQQTVSLDLENESVEEVFNSVLMISGLKANRRGRTIFVGAALPAAARNLITRTIRLNQIEAINAATFLATQGAEYQRLVTQTEDIVDPLTNRVVGRRDTPPELQPLVVNRQEGSNAPFLLDGLTIATDERLNSITLIGEPRQVQIATSMLVQLDARRRQVAVNVKVVDVQLAGTEFYNSSFSFGFDDGFFVQDGGTAILNFGNYNPPNAAQTRSSVPTPPVIPTTDAFGGGVVPNVFIDIQGSAPFNTVNQGLEQFADTLVPYARPGFGTLNNPFQPGVTEIDISRDEDGFIEEIEYTYELPNVFQFPEKFLLTLEAQITSGNAKILTDPTLVVQEGQQATVKLTQKVVESVNTQVDPLSGVRTTTPVLQDAGLTLTVEVDRIDDNGFVSLFVSPTIAAPGASQEFESGDGTTNQLTLLTRRELTSGLIRMRDGQTLILSGIISESEQTTVSKVPILGDIPILGALFRRTDNSGSRSEVIVLLTPKIIDDRPDSSWGFNYTPGPGAAEMLRRQGFPVQPR

SEQ ID NO: 5465 - protein, 786 aa, Cyanothece sp.
  strain PCC 7424
MAVFTVTNLLDNGKGSLRQAIARANSLEGTDIIKFSRNLKGSTITLTSGELSITDSVTLKGLGAEWLKISGNDSSRIFNIDDGSDQILEVLISDLTLTEGRTTGSEDFAARGGAIFNANETLTLINTSITGSTAQGASVDFYDYYNDTTWSGGGAIYNSSGNLTIINSVISGNTAKGGTSYQQYQYLYAGGSASGGGIFNATGNLSVTNSIISGNTAIGGDGELGGSGHGGGISNRGSLTVTNSIISDNTAEGSYGDGSAWGGGIEGSNITVNNSTISNNTAIGGRGRQGIRYRSIEPYAGSIGGYASGGGILGANLIVNNSTITGNTAIGGEGGRGAYGYNSSYLALAEGGDGGTGGQARGGGIGIMGISSIATISNSTISGNTVIGGNGGTGGSGALFYIDDNSYDAGDGTDGEGGSGTGGGIWAIYAHLTITNSTITQNSAQGGMGSSNGQTAGAGVITETQLSGNSTPITLTSTIIAGNTDNQDVAGTFTSGGYNLIGNGEDSTGLIDGVNHDQVGTTANPIDPLLSPLQDNGGPTLTHALLPGSPAIDAGNNDSNLISDQRGAPRVVGDAADIGALEVADQTLLGNESSNSFTGGAGNDFLEGGDGNDTLNGSKGNDGLRGGAGSDRLMGSDGNDLLIGGLERDILAGGEGADVFRFESLADSSLLSPDRIRDFNQTEGDRFQLLPTNPSTLWNAGDVTGDNLRVALEAAYADSNQSAGGSQPLGLNEAVLFNFGSRSYLSINNTISGFNPEQDLVVEVSGIVLASGDENAGVLSVSDYFV

SEQ ID NO: 5466 - protein, 817 aa, Cyanothece sp.
  strain PCC 7424
MAVFTVTNLLDNGEGSLRQAIANANSLDGADTIEFASNLSGGTISLTSGELSITDSLTLEGLGSDLLTISGSDLSRIFNINDQTEYYSYNSNILDVVISGLTLTNGFVSENTQSFNAPAASGGAIYNYDENLTLIDTVITGNTAAGDPFAYYENAEALGGGIFNYSGTVTVIDSVISSNTAQGGTVLLDFIREGGFVGSGGGIYSRTGNVTVINSTISDNTAKTGRGGDFVFTYESHGGGIAGGFNSTITITNSTISNNTVVGANTTNIYSREGGDARGGGISGDNVIVNNSSITGNTVLGGNGTGSFYVYYGYSGGYGGDARGGGISGNNVTVSNSTISGNIAQGGNGGIGGKANVFRGFFYGTNGGRGGNATGGGISSANLTMSNSTISGNTAQGGNGANGGQGADTATINEYFGYSGYYYYFAGNGGNGGNGGNSVGGGVAVSNNALIANSTITNNTLDSGTGGVGGSGGLGNESLNIPNGIDGTDGTIGNEIGGGLSANGTVTSTIIAGNTDNQDLAGTFTSGGNNLIGNGDGATGFIDGVNDDQVGTTINPIDPLLSPLQDNGGLTLTHTLLPGSPAIDAGSNPSTLISDQRGAPRVAGDGADIGALELADETLLGDQSSNSFTSGTGNDFLEGGDGNDALNGSSGNDGLRGGAGSDRLIGSDGNDLLIGGLDRDILAGGEGADVFRFESLADSSLLSPDRIRDFNQTEGDRFQLLPTNPSTLWNAGDVTGDNLRVALEAAYADSNQSAGGSQPLGLNEAVLFNFGSRSYLSINNTISGFNPEQDLVVEVSGIVLASGDENAGVLSVSDYFV

SEQ ID NO: 5467 - protein, 430 aa, Cyanothece sp.
  strain PCC 7424
MLNKPEVPIEAIEAREILDSRGKPTVEAEVRLETGAVGMAQVPSGASTGTFEAHELRDGDPSRYGGKGVTIAVRNIHEKIAPSILDMDAFDQVSVDLKMIQRDGTPNKKELGANAILAVSLATAKAAAAELDIPLYRYLGGPLSNVLPVPMMNVLNGGAHADNNVDFQEFMIMPIGADSFREALRWGAEVFACLSSVLKERKLLSGVGDEGGYAPNLGSNQEALDLLMEAIDKAGYKAGEQIALAMDVASSEFYKDGQYIYDGSAHSPQEFIDYLDKLVSQYPIVSIEDGLAEEDWDNWKILTDQLGSRIQLVGDDLLVTNPTRLQKAIDMGVANSILIKLNQIGTLTETLETIDLATRNKYRSVISHRSGETEDTTIADLAVATRAGQIKTGSLCRSERVAKYNRLLRIEDELGDRAVYAAKIGLGPKA

SEQ ID NO: 5468 - protein, 815 aa, Cyanothece sp.
  strain PCC 7424
MKIPSILPTLLFATGAVLSFSQPAQAQTLIQVTGIQLEPTPNGLKVIVETAQGNTPQAFIIPSGETVDIQLLDSQLNLPDKQSFQVENPVDGIASVTVTQGEANTVQVTIVGTQGSPQVELVPSPLGVVLDLRPSSTTVTPEEPTEEIDIIATTEANENDYIVEDATTATFTDTPLRDIPQSIQVIPEQIIEDQQVIRLDEALRNVSGVVQGNTFGGTQDEFIIRGFTSTSGNLLLDGFRLPNSGTTFRETATLERIEVLKGPAGVLFGFVEPGGVINLITKKPLPEPYYDAQLQIGSFAFFRPTFDLSGPLTEDKSLLYRLMFGYETEDGFREFDQGVNRFYITPVVSWKPSDQTEILFDLSFIDDERPFDRGIINNVNFNIPEVPVNRIFGEPDDKSEVEEFSIGYRLNHEFNENWEIQNNFRYISSFNFNYRAEPLYDADEFGNLSRNFRSNDAYEENFNLQTRLIGKVATGPVDHTLLFGFDAFRETFWQQQNRLPVGLTPSINLFDPQYNVIPRPFLSELTTRLFFFRNRTDYVGLYLQDQVTITDNLKLLLNGRVDIATQENKSRETGEETVNGDSDFTPRVGIVYQPIEPVSLYASYSESFVPNGSTRADGTFLPPEEGRQYEIGIRTELNEGRVVLNLAAYDITKSNVATDDPLNPGFSIPTGEIRSQGIEFDVIGRILPGWNIIASYAYTDARITEDNDPERVGLRVGYVPYSAASLWTTYTIQSGNLEGLGFGAGFFYIGDRIDGFIPSVFLSSYTRVDAAIYYRRKNWQAEVNFKNLFNDYYIESGFYEPGAPFNVIGSFSIQF

SEQ ID NO: 5469 - protein, 430 aa, Cyanothece sp.
  strain PCC 8801
MLNKPEVLIEAITAREILDSRGRPTIEAEVLLETGAFGIAQVPSGASTGSFEAHELRDDDPARYAGKGVLTAVRNVKEKIAPQLLGTNAFDQASIDQKMIDRDGSSNKKELGANAILGVSLATAKAASAELDIPLYRYLGGPLANVLPVPMMNVLNGGSHADNNVDFQEFMIMPVGADSFTEGLRWGAEVFATLSKVLKERKLLSGVGDEGGYAPNLASNQEALDLLIEAIERSNYKPGEQIALAMDVASSEFYKDGQYVYDGSAHSPQEFIDYLAKLVSEYPIISIEDGLQEEDWDNWKLHTQSLGSRIQLVGDDLFVTNPTRLQRGIDLGVANSILIKLNQIGTLTETLETIALATRCQYTSVISHRSGETEDTTIADLAVATRAGQIKTGSLCRSERVAKYNRLLRIEEELGDRALYAPKVGLGPKF

SEQ ID NO: 5470 - protein, 825 aa, Cyanothece sp.
  strain PCC 8801
MKLERQSVMTGLLTGVLVVCITPTVQAQVTITNVQINTTDQGLEIILETPEGQQPEVFSGSIGTTFFADIANAQLNLASGQDFRQDNPASGIASISVSQQPNNLVQITVIGIETTPIVQINRISGRLVLTVTPEQPSETEETPDSETSNQQEDEAIELVVTDDTQDNSYFVPNSSTATGTDTPLRDTPFSIQVVPNRVLRDQQVIRLDDALRNVSGVQQNSADPRGQRFQIRGFDSSSVLRDGFRQTFGRSGNSGFQELSNVQQVEVLKGPASILYGALEPGGVINIVTKQPLADPFQQIEFQAGNRGLLNPSIDFTGPVSRDKSLLYRLNFAYRNERSFRDFDTYIERKFIAPTFTWNIDEQTKLTFEVEYSDDDRPADFGVLALGDQVVDTPNARNFGEPGDYLRAETLRVGYRFQHDFNENWQFQNAFNYLRYDSTFSSAFTFSVDEETLTAFRSFIYLDQPSTNYELKSKVIGNFDTWSIKHKILFDVGLTRREQLGNIGRSDFSDIPLNIFAPVYGTVPRPDPNTQEIFTFSDYQVDQLRITFQDQITLFDNLKLVAAFNYDSVEQKFWDRLTDENTVQYDDSVVPRVGLVYQPIEEVSLYGSYSQSFYPGAGQTVSGQFLDPEESEQYEIGIRAEILDKKLSFNLAYFDITKNNVATSDPEFPIFSVAVGEQRSRGVELDIVGEIIPGLNIVFNYANITAEITEDNDIPVGNRLFNVPENSANLWLTYQIQDGFFEGLGFGGGFNYVDERFGDNANSFRLESYTLANAAVFYERDNWKFALNIRNIFDEDHIKGSENSRNNEIYPGEPFTLLGSISVKF

SEQ ID NO: 5471 - protein, 171 aa, Cyanothece sp.
  strain PCC 8801
MKQIFTSIVLFALLLTVNQSVVSQTNFQQEILTAHNKYRQKVNVSPLIWSNQLANDAQQWANYLASLGGRKLQHDSNTNGQGENLWLGTSKRFSYTQMVDGWGQEKQYLTSRRFTLETVSSTGNWSDVGHYTQIVWKNTKKVGCATSKAGGNDILVCRYSPQGNIIGQPIY

SEQ ID NO: 5472 - protein, 743 aa, Cyanothece sp.
  strain PCC 8801
MNNYRHPLAMSGAISLMLLMSYPAIAVNPTATENPFEESTSEEKLFSKAVAINPRSEWKFDPQIAPSKVKEDIFTETSLEIAQIPNYYPNTPPSPAPAPSTNFYPNNPSQPSGFYPNTPNPIPPSRSSDIMIPNPEVLIKSNGSSIPDSLQPTMPMAPTLPRAVAPPVGDIAISNINAATDGIDLGTSIIVPRLVLRQAPAREVLAVLARYAGMNLVFTDDTRAAAAATAGQPPGAQSAGEVTVSLDLENEPVEQVFNSVLMISGLQANRRGRTIFVGSQLPQAAQNLISRTIRLNQVKSASAGTFLASQGAEFQRLVTVREDIIDPLTQRVIGQRELPPELDPLTAQRTEGSNSPQLLTGLAVSSDDRLNTITLVGEPRQVQVATSLLTQLDARRRQVAVNVKVVDIALNNDQSFSSSFSFGVNDSFFVQDEGAAFLRFGGPSPIDSAEFNSATGRLGVPPAIPNPFAEGGNIFLNQGSFQFPVLTDGGFPQIPGASLGVSNDFRAVGVSPPENADDPFEYQLPSFFEFPRKFLSQIEATIQSSNGKVLTDPTLVVQEGQQATVKLTQKVIENITTQVDPLSGVRTTTPVLSDAGLTLTIDIDKIDDNGFISLTVSPTIAAIGDVQPFDSGADGGFNQLFLLARRELTSGLIRLRDGQTLILSGIISETDQTITNKVPILGDIPLLGALFRSQTDTKNRSEVIVLLTPQILHDNGQWGYNYTPGRASAEVLRQQGFPVQIVP

SEQ ID NO: 5473 - protein, 899 aa, Cyanothece sp.
  strain PCC 8802
MTFSEEFTTNNDSDFLDSESAYPVAFGITFTPQITGIALGLLGLLGAIYVLFTFFMPAWTNYNTLKADQANKQAQVDQQKSGKLDQKMLQVQAQLQKSQATRNKVLSLFSSESSLKTLLLDINNFIEARQLKLITFKPTGEPAVVSDGSLGEAVNNRLKRQSFQLEVEGAFQKTHELLQDLERLQPLLILKELSSQLVEEKFAVKVVDVNQQGGQVVGTGQAVPIGEDNLKTTFTLDAILPLTPEEIAKLKPPAEENKPPAEGNKPPENPSGQPPNPIPPSRSSDIMIPNPEVLIKSNGSSIPDSLQPTMPMAPTLPRAVAPPVGDIAISNINAATDGIDLGTSIIVPRLVLRQAPAREVLAVLARYAGMNLVFTDDTRAAAAATAGQPPGAPSAGEVTVSLDLENEPVEQVFNSVLMISGLQANRRGRTIFVGSQLPQAAQNLISRTIRLNQVKSASAGTFLASQGAEFQRLVTVREDIIDPLTQRVIGQRELPPELDPLTAQRTEGSNSPQLLTGLAVSSDDRLNTITLVGEPRQVQVATSLLTQLDARRRQVAVNVKVVDIALNNDQSFSSSFSFGVNDSFFVQDEGAAFLRFGGPSPIDSAEFNSATGRLGVPPAIPNPFAEGGNIFLNQGSFQFPVLTDGGFPQIPGASLGVSNDFRAVGVSPPENADDPFEYQLPSFFEFPRKFLSQIEATIQSSNGKVLTDPTLVVQEGQQATVKLTQKVIENITTQVDPLSGVRTTTPVLSDAGLTLTIDIDKIDDNGFISLTVSPTIAAIGDVQPFDSGADGGFNQLFLLARRELTSGLIRLRDGQTLILSGIISETDQTITNKVPILGDIPLLGALFRSQTDTKNRSEVIVLLTPQILHDNGQWGYNYTPGRASAEVLRQQGFPVQIVP

SEQ ID NO: 5474 - protein, 430 aa, Cyanothece sp.; identical to SEQ ID NO: 5469
  strain PCC 8802

SEQ ID NO: 5475 - protein, 825 aa, Cyanothece sp.
  strain PCC 8802
MKLERQSVMTGLLTGVFAVCIAPTVQAQVTITNVQINTTDQGLEIILETPEGQQPEVFSGSIGTTFFADIANAQLNLASGQDFRQENPASGIASISVSQQPNNLVQITVIGIETTPIVQINPISGRLVLTVTPEQPSETEETPDSETSNQQEDEAIELVVTDDTQDNSYFVPNSSTATGTDTPLRDTPFSIQVVPNRVLRDQQVIRLDDALRNVSGVQQNSGDPRGQRFQIRGFDSSSVLRDGFRQTFGRSGNSGFQELSNVQQVEVLKGPASILYGALEPGGVINIVTKQPLADPFQQIEFQAGNRGLLNPSIDFTGPVSRDKSLLYRLNFAYRNERSFRDFDTYIERKFIAPTFTWNIDEQTKLTFEVEYSDDDRPADFGVLALGDQVVDTPNARNFGEPGDYLRAETLRVGYRFQHDFNENWQFQNAFNYLRYDSTFSSAFTFSVDEETLTAFRSFIYLDQPSTNYELKSKVIGNFDTWSIKHKILFDVGLTRREQLGNIGRSNFSDIPLNIFAPVYGTVPRPDPNTQDIFTFSDYQVDQLRITFQDQITLFDNLKLVAAFNYDSVEQKFWDRLTDENTVQYDDSVVPRVGLVYQPIEEVSLYGSYSQSFYPGAGQTVSGQFLDPEESEQYEIGIRAEILDKKLSFNLAYFDITKNNVATSDPEFPIFSVAVGEQRSRGVELDIVGEIIPGLNIVFNYANITAEITEDNDIPVGNRLFNVPENSANLWLTYQIQDGFFEGLGFGGGFNYVDERFGDNANSFRLESYTLANAAVFYERDNWKFALNIRNIFDEDHIKGSENSRNNEIYPGEPFTLLGSISVKF

SEQ ID NO: 5476 - protein, 171 aa, Cyanothece sp.
  strain PCC 8802
MKQIFTSIVLFALLLTVNQSVVSQTNFQQEILTAHNKYRQQVNVSPLIWSNQLANDAQQWANYLASLGGRKLQHDSNTNGQGENLWLGTSKRFSYTQMVDGWGQEKQYLTSRRFTLETVSSTGNWSDVGHYTQIVWKNTKKVGCATSKAGGNDILVCRYSPQGNIIGQPIY

SEQ ID NO: 5477 - protein, 152 aa, Emericella nidulans
  strain FGSC A4 / ATCC 38163 / CBS 112.46 / NRRL 194 / M139
MRLNYIYTATLTLALALSVLASTGGFSSTNTAIETRNIGTAEWMEYDSLSPDLNSGVDHGAGDHLRPQKRKLVADPYKVPYPLQTGPTRYAPLAKKPGTATATTLPTPQFPASPYKIATKYLNPGTVQTTLSATETLSVTMMENTAAPAPHP

SEQ ID NO: 5478 - protein, 98 aa, Emericella nidulans
  strain FGSC A4 / ATCC 38163 / CBS 112.46 / NRRL 194 / M139
MDVNNLTMHNFTFTGGDDCIAIKPRSYNINISDVICNGVNGIAIGSLGQYLEDSSVKNVTISHARVPSTRYGTYIKTWMGELVPQPDSYESDYKPQGG

SEQ ID NO: 5479 - protein, 223 aa, Emericella nidulans
  strain FGSC A4 / ATCC 38163 / CBS 112.46 / NRRL 194 / M139
MPLPLLPPLLLPLEALLDLALHLVDSTGVAYSARQVTPTAPLPRLRGSSTSNDVTDNSGCKELTFIFARGTTEIGNMGTVVGPKVGEALKSLTGNKAAIQGVDYPADAAGNAALGGSGGPKMASLVETALKQCPDTKIVLGGYSQGAMVVHNAASKLSSGQVVGAVTFGDPFKSQKPDNIDQFKTFCASGDPVCLNGANVMAHLSYGNDAQTAAQFLVSAAGL

SEQ ID NO: 5480 - protein, 499 aa, Emericella nidulans
  strain FGSC A4 / ATCC 38163 / CBS 112.46 / NRRL 194 / M139
MELEKFKPWRDSHSEHIPVPLTSRQNIIIILLILFSHYHHWYWRCRRPTDRWSLLAVCHKHHQRAPNSLPTSKSLHSFLHSARGWNSWGIQATPNTIPSYPKEELGRVLNQKFIISQCTMLTDPATQDAGYDLCSLDGGWYSSITDKFGCITYNASLFDISALSRYLHGKGLRMGLYSQPGTPCKARHGTNVTVGSAFIDHVDKNNNCYFDYENPNTQLYRELITLWVSWGVDMIKLDYVTPGSTFQDTCMPGNLNASAIAYHCAIEKSGRKFQLDVSSDVCRSQPYWGTWNSNADSIRVDTDINPYDSDDFFFFYMQHCTVEDYRQFVNLQVVDAQNDKPVTLRGNLDNLFVGNPAKVKGVTDKQRNTLMRIWIGASSNLFLGSDMRILDDLGRWLITSPSSIAAADFCAMYPMQPRNPGTGSNQAVQLQACITGPSEHGEAYVLLTNLGPNLGDGGYVTVGGGEQKMSVTLADMGPSRSSANRLDLSPRPIHVLILL

SEQ ID NO: 5481 - protein, 424 aa, Emericella nidulans
  strain FGSC A4 / ATCC 38163 / CBS 112.46 / NRRL 194 / M139
MYLFRILAILTAFTCASAGRLPSRTCVVPASGTNETDDAPAIISAFERCGRGGKVVFKPTTYYVNSVMNISWLQDVDIDLRGNLLWSTDIQYWLNNSLEVGYQNQSTAWILGGDNVRIDGHGIGTLDGNGDYWYEWISQQENTSNYPGRPIALTLSELTNSVVKGVNFLRSQMWTLAIIYSHHVEFDSILVNNTGNRVDSSNTDGADTIRSSHISFNNLTVYNGDDSISFKANSTDITLTNSHFYNGLGVAIGSIGQLKDQFETVERVKVENIVYENTLHAVYFKTWTDDQNGYPPNGGGGGLGYASNMLFKDLDTTSLRGSAVAISQCTRFSGAPGEGNCTNSQFQIRDITVANLHGTTKSERVTSFQCSAVAPCTNIGVFGVDLEFANGTKAEEYLCGNVKNPRGFVCTGAVCEGGSATGEC

SEQ ID NO: 5482 - protein, 303 aa, Emericella nidulans
  strain FGSC A4 / ATCC 38163 / CBS 112.46 / NRRL 194 / M139
MREISFGQRKIHLIDPRLLPGGMHTSINRHQHRQPTHLQTILFSRVLKIIIYFLLLLLPNAISATETTVIVTVTESATATTTATTTTTPKVPQDPSYTSPRQFRSSILRTTNAYRAAHNASNLSWNETLADYAKDWAKGCKWKHSSGPYGENLAYGYKKASSAVTAWGDEAALYDFSKPTGFTEETGHFTQLVWKSTREVGCAAVDCGLTDLDDDEKERAQGWYVVCEYMPAGNVVGADDGLEYFRVNVQEGSEDSDSSSEDDSEHGDGGEGSDVSDFGNRASRGLVEWSKERVACPRRPPPN

SEQ ID NO: 5483 - protein, 510 aa, Emericella nidulans
  strain FGSC A4 / ATCC 38163 / CBS 112.46 / NRRL 194 / M139
MTMSRSSRSSVLALALATGSLVAAGPCDIYSSGGTPCIAAHSTTRALYSSYNGPLYQVQRASDGTTTTITPLSAGGVADASAQDAFCENTTCLITIIYDQSGNGNDLTQAPPGGFNGPDVGGYDNLAGAIGAPVTLNGKKAYGVFVSPGTGYRNNEAIGTATGDEPEGMYAVLDGTHYNDGCCFDYGNAETSSLDTGNGHMEAIYYGTNTAWGYGAGNGPWIMADLENGLFSGQSSDYNAGDPSISYRFVTAILKGGPNLWALRGGNAASGSLSTYYNGIRPTDASGYNPMSKEGAIILGIGGDNSVSAQGTFYEGAMTDGYPDDATENSVQADIVAAKYATTSLISGPALTVGDTVSLKVTTSGYDTRYIAHTGSTINTQVVSSSSSSTLKQQASWTVRTGLASTAAANGCVSFESVDTPGSYIRHSNFALLLNANDGTKLFSEDATFCPQDSFNDDGTNSIRSWNYPTRYWRHYENVLYVASNGGVNTFDAATAFTDDVSWVVADGFA

SEQ ID NO: 5484 - protein, 386 aa, Emericella nidulans
  strain FGSC A4 / ATCC 38163 / CBS 112.46 / NRRL 194 / M139
MVVFSKVAAAAFGLSAVASAMPAAPPRQGFTINQLTRAIPKRTINLPAIYANALSKYGGNVPPHIQDAMAHGSAVTTPEQYDVEYLTPVAVGGTTMNLDFDTGSADLWVFSNELPSSQTTGHSVYKPSDNGTRMSGYSWEISYGDGSSAGGDVYRDTVTVGGVTAPGQAVEAASHISEQFTRDQNNDGLLGLAFSSINTVQPKSQTTFFDSVKSQLESPLFAVTLKHQAPGSYDFGYIDQSKYTGELTYTDVDNSQGFWMFSATAGETDFDAIADTGTTLIMIDQSIAEDYYSQVPLAFNNFFYGGWTFPCSAELPSFTVTINGYDAVVPGEHIKYAPVTDGSSTCFGGIQDNQGLPFSILGDVFLKSQYVVFDSEGPQLGFAPQA

SEQ ID NO: 5485 - protein, 609 aa, Emericella nidulans
  strain FGSC A4 / ATCC 38163 / CBS 112.46 / NRRL 194 / M139
MYLSTVLFPLLALNLGLSHARFVRETLELTWEYGSPNGGTPREMVFTNGEYPGPDLIFDEDDDVEVLVINNLPFNTTVHWHGLEMRETPEADGVPGLTQTPIEPGATFTYRFRAYPAGTFWYHSHYKGLMQDGQVGAMYIRRKPDALRPYAVITEDPRELAEIQYAEDNPYLMLATDWTYLTSAEYHNIEVESGYNVFCVDSLLINGRGSVYCPGYQYLEEVSDDGLTAVLEGTHLTEKGCLQPDLHNVQGDYGPWNLSAVPTEVVFNCTPSSVEPPVIYVDPEFNGWVSLNFIGGAAQKAITFSVDNHPMWVYEVDGQFVEPREVEMVGVYSGARYAVMIKLDQTPGDYAIRIAVNGGDQVMSVYAILSYVNQDWIHRENVPKAAIGPHTDTVGYMNYGGGNTSADVRQLLFTENLPAFGVPPPPPSSEVSTTLRTGMIRVNNSYSWSLGNNVLYEPEMTSSTPLLFEPDPLAVIAPKYALTTENNTWVDIVLEITADPRDLIHPPHPIHKHGNRAYIIGNGVGKFRWENVSAAEAEVPDLFYVNETAALRDTFVTDFFDSRLMDGAWIVIRYFVQDKFPSILHCHIASHQMGGMALALLDGVDVWDS

SEQ ID NO: 5486 - protein, 157 aa, Emericella nidulans
  strain FGSC A4 / ATCC 38163 / CBS 112.46 / NRRL 194 / M139
MKFSIAAAVVAFAASVAALPPAHDSQFAGNGVGNKGNSNVKFPVPENVTVKQASDKCGDQAQLSCCNKATYAGDTTTVDEGLLSGALSGLIGAGSGAEGLGLFDQCSKLDVAVLIGIQDLVNQKCKQNIACCQNSPSSADGNLIGVGLPCVALGSIL

SEQ ID NO: 5487 - protein, 135 aa, Emericella nidulans
  strain FGSC A4 / ATCC 38163 / CBS 112.46 / NRRL 194 / M139
MRFIVSLLAFTAAATATALPASAAKNAKLATSAAFAKQAEGTTCNVGSIACCNSPAETNNDSLLSGLLGAGLLNGLSGNTGSACAKASLIDQLGLLALVDHTEEGPVCKNIVACCPEGTTNCVAVDNAGAGTKAE

SEQ ID NO: 5488 - protein, 225 aa, Emericella nidulans
  strain FGSC A4 / ATCC 38163 / CBS 112.46 / NRRL 194 / M139
MVSFKSLLVLCCAALGAFATPVGSEDLAAREASLLERSTPSSTGWSNGYYYSFWTDGGGDVTYTNGAGGSYTVQWSNVGNFVGGKGWNPGSTRTINYGGSFNPSGNGYLAVYGWTQNPLIEYYIVESYGTYNPGSGGQHRGTVYSDGATYDIYTATRYNAPSIEGTATFEQFWSVRQSKRTGGTVTTANHFNAWAALGMRLGTHNYQIVATEGYQSSGSASITVY

SEQ ID NO: 5489 - protein, 221 aa, Emericella nidulans
  strain FGSC A4 / ATCC 38163 / CBS 112.46 / NRRL 194 / M139
MVSFSSLLLACSAVTAFAAPSDQSIAERSLSERSTPSSTGTSGGYYYSFWTDGGGDVTYTNGDGGSYTVEWTNVGNFVGGKGWNPGSSQTISYSGSFNPSGNGYLSVYGWTQNPLIEYYIVESYGDYNPGTAGTHQGTLESDGSTYDIYTATRENAPSIEGTATFTQFWSVRQSKRTSGSVTTQNHFDAWSQLGMTLGTHNYQIVAVEGYQSSGSASITVS

SEQ ID NO: 5490 - protein, 327 aa, Emericella nidulans
  strain FGSC A4 / ATCC 38163 / CBS 112.46 / NRRL 194 / M139
MVHLKTLAGSAVFASLATAAVLPRQSASLNDLFVAAGKSYFGTCSDQALLQNSQNEAIVASQFGVITPENSMKWDALEPSQGNFGWSGADYLVDYATQHNKKVRGHTLVWHSQLPSWVSSIGDANTLRSVMTNHINEVVGRYKGKIMHWDVVNEIFNEDGTFRNSVFYNLLGEDFVRIAFETARAADPDAKLYINDYNLDSASYAKTQAMASYVKKWLAEGVPIDGIGSQAHYSSSHWSSTEAAGALSSLANTGVSEVAITELDIAGAASSDYLNLLNACLNEQKCVGITVWGVSDKDSWRASDSPLLFDGNYQPKDAYNAIVNALS

SEQ ID NO: 5491 - protein, 403 aa, Emericella nidulans
  strain FGSC A4 / ATCC 38163 / CBS 112.46 / NRRL 194 / M139
MHSFKRSLLLLGALLPAVFGAPVEPRRAAEKVPGKYIVTFKSGLNVDQIDAHTSWASNVHKRNLERRGLAERDQYSGIEKNYKINKFAAYSGSFDDATIEEIRNSADVAHVEEDQIWYIDALTSQSGAPWGLGAISHKGEASTTYVYDTSAGEGTYAYVVDTGINADHEEFGGRASLAYNAVGGQHVDSVGHGTHVAGTIGGETYGVSKKANLLSVKVFQGESSSTSIILDGFNWAANDIVSKGRTGKSAINMSLGGGYSYAFNQAVEDAYDEGVLSVVAAGNDNIDASDSSPASAPNALTVAASTKSNTRASFSNYGSVVDIFAPGQDILSAWIGSTTATNTISGTSMATPHVVGLSLYLIALEGLSSASAVVSRIKELATQGVLSNVQGSPNLLAYNGADE

SEQ ID NO: 5492 - protein, 326 aa, Emericella nidulans
  strain FGSC A4 / ATCC 38163 / CBS 112.46 / NRRL 194 / M139
MRFTPLFLLAAVAIASPAPDLNARHELTRRQASESCPIGYCTQNGGTTGGAAGDTVTVTNLADLTEAAESDGPLTIIVSGSISGSAKIRVASDKTIFGESGSSITGIGFYIRRVSNVIMRNLKISKVDADNGDAIGIDASSNVWVDHCDLSGDLSGGKDDLDGLVDISHGAEWITVSNTYFHDHWKGSLIGHSDNNEDEDLGHLHVTYANNYWYNVYSRTPLIRFATVHIINNYWDSLIDTGVNCRMDAQVLIQSSAFHNCPDRAIFFADSDYTGYAVVDDVDLGGSSNSVPEGTLTPSSLPYAAITALGSGQVASVIPGTAGQKL

SEQ ID NO: 5493 - protein, 328 aa, Emericella nidulans
  strain FGSC A4 / ATCC 38163 / CBS 112.46 / NRRL 194 / M139
MKVNTLLVAVAAGTAMAAPQLKKRAGFTFFGVTEAGAEFGEKSIPGVWGTDYTFPDTESILTLISKGFNTFRIPFLMERLTPEMTGSFDEGYLKNLTSVVNAVTDAGAWAIVDAQNFGRFNGEIISSASDFQTWWKNVAAEFADNKNVIFDTNNEFHDMDQTLVLDLNQAAINGIRAAGATSQYIFVEGNSYTGAWTWTDNNDNLKSLTDPQDKIVYEMHQYLDTDGSGTHETCVSETIGAERVESATQWLKDNGKLGVIGEFAGGNNEICRAAVKSLLDALKENDDVWLGALWWAAGPWWEDYMFSMEPTDGIAYTGMLSTLEAYMN

SEQ ID NO: 5494 - protein, 402 aa, Emericella nidulans
  strain FGSC A4 / ATCC 38163 / CBS 112.46 / NRRL 194 / M139
MSRLVSFASLLAAVNAHGYVQNIVVNGVYYSGWEINTYPYMTDPPVVAAWQIPNSNGPVDVSNGYTTEDIICNLNATNAAGYVEVAAGDKINLQWSAWPDTHHGPVISYLADCGDDCTTVDKTTLEFFKIDAVGLVDDSTVPGTWGDDELIENNNSWMVEIPTSIAPGNYVLRHEIIALHSAGTEGGAQNYPQCFNLKVTGSGTDSPAGTLGTELYNLDDPGILVNIYASLSTYVIPGPTLYSGATSIAQATSAITATGSATSGAGGAAATGSSAATTTAAAASTTATPTTAAAQTAKSASAPSSAATGSVPAAPTTATVSTTTSIATSVGTTLTRTTLATTTTAAAAEPSASAPAPSGNSASGSNPLYAQCGGLNFKGASGCVAGATCKKMNPYYSQCVSA

SEQ ID NO: 5495 - protein, 377 aa, Emericella nidulans
  strain FGSC A4 / ATCC 38163 / CBS 112.46 / NRRL 194 / M139
MRVSAFALLAAAATAAATSVQGAAEGFAKGVTGGGSATPVYPTTTDELVSYLGDDEARVIVLTKTFDFRGTEGTTTAKGCSPWGTASGCQLAINKDGWCDNYQPDAPQTTITYDTAGMLGITVKSNKSLIGQGTAGVIKGKGIRIVNGAKNVIVQNIAITDINPQYVWGGDAITLNDVDMVWIDHVTTARIARQHIVLGTNACNRVTISNNYFNGVSDYSATCDGYHYWGLYLDGSNDMVTLQGNYIHHFSGRSPKVGGNTLLHAVNNYWYDSTGHAFEIAAGSSVLAEGNVFQNINAPVESSSLAGNLFTSPDSNTNKVCSSYLGHTCQLNAFGSSGSFNQADEGFLVNFKGKNVASADAYSAAQSVPNNAGQGKL

SEQ ID NO: 5496 - protein, 847 aa, Emericella nidulans
  strain FGSC A4 / ATCC 38163 / CBS 112.46 / NRRL 194 / M139
MRSFLLLTALLGVAAVAEDGLAAWLRYAPIPHAKSYHKNLPSVIVPLNATAGRPIDTAAYELVDGIKGIFGKRVTLKNETRDDPNLPAVTVGTVEAYAEAGGDVSSVPELIDDGYYLSVAGPSVLILGQNERGALYGTFQYLERLAQGKVSDTSFASNPSAPIRWVNQWDNLQDGGTHGSVERGYGGDSIFFWDGRVRDDLTRASQYARLLASIGLNAVIVNNVNANETILTQENMDGVARIADAFRPYGIQLGLSLNFASPQSLGGLDTFDPFDERVISWWGEITDELYERIPDMAGYLVKANSEGQPGPFTYNRTLADGANLFARALQPHGGIVLFRAFVYDHENLNETLDWKADRANAAVEFFDGLDPQFEDNVVIQIKNGPIDFQVREPVSPLFAHLSQTASAVELQVTQEYLGQQCHLVYLAPMWKEVLDFDLRVDGKDSVVSDIVSGRRFNNTLGGYAGVVNVGLNTTWLGSHLAMSNLYAYGRLAWDPSADSVELLQEWIKMTFSHDQEVVDVITKMSMESWPAYENYSGNLGIQTLTDILLGHYGPNPASQDGNPWGQWTRADADSIGMDRTVWNGTGNAGQYPEEVYQMYENIDTTPDNLLLWFHHVPYTQRLKSGKTVIQHFYDAHYRGSATAQTFVSLWKTIKGKIDKERYEHVLFRLVYQAGHALVWRDSITNFYYNKSGIPDEAGRVGNHPYRIEAEDMELDGYEPYLVSPFEAASGSHCIVTSNNSTEGRASTPLKVKNGKYDIAVNYFDQAIGNSTWRLFLDDDLVGEWKGDLEYILGRAPSPYIDGQTAARITFKHVHIKSRSTLSIVGIPDGMEPAPIDYVSILPEGVID

SEQ ID NO: 5497 - protein, 433 aa, Emericella nidulans
  strain FGSC A4 / ATCC 38163 / CBS 112.46 / NRRL 194 / M139
MKRQALTLIPLLGAAAAQSGPYGQCGGNDWSGATTCVSGYVCVYQNEWYSQCVPGTATSSSTTLTTTTSATTRTTTTTTSTTSVPSSTNFPSASGLNFTIDGVTDYFAGSNSYWISMLTNDADVDLVLDHIASSGHKILRIWGFNDVNTEPSTGQVWFQKHQGGVSTINTGQYGLQRLDAVVSSAEKRGIKLIINFVNNWDDYGGMSAYLNAYGGSTKTDWYTSATIQAAYRTYIKAVIDRFIDSPAIFAWELANEPRCNGCDTSILYDWIADTSAYIKSLDPLHMVCIGDEGFGLDEGSDGSYPFSYNEGLDFAANLAIDTIDFGTFHLYPGSWGVSYDWGNLWAITHGAACATAGKPCLFEEYGAPSDHCAIEVPWQTTAVSSTGIAGDLFWQWGDTLSTGQTHNDGNTIYYGSDEYTCMVTEHMERIAAR

SEQ ID NO: 5498 - protein, 507 aa, Emericella nidulans
  strain FGSC A4 / ATCC 38163 / CBS 112.46 / NRRL 194 / M139
MYVSRLLLFLAPLLVKGQLSGSVGPLTSVSSKSQTKTCNVLDYGAVADKSTDIGPALSSAWDECADGGVVYIPPGDYAIETWVKLSGGKACAIQLDGIIYRTGTDGGNMIMIEHTSDFEFFSSTSKGAFQGYGYEFHAKGSSDGPRILRLYDVSDFSVHDVALVDSPLFHFSMDTCSNGEVYNMAIRGGNMGGLDGIDVWSTNVWIHDVEVTNKDECVTVKSPSKNILVENIYCNWSGGCAMGSLGTDTDISDIVYRNVYTWKSNQMYMVKSNGGSGTVSNLVLENFIGHGNAYSLDIDSAWSSMSTIEGDGVELKNVTIRNWKGTEADGSQRGPIKVKCASGAPCTDVTVEDFAMWTESGDEQTYVCENAFGDGFCLADGDGTSTFTTTLTASAAPSGYSAPSMDADLETAFGTDSEIPIPTIPTSFYPGATPYSALAGASVSSSQVPAASSSAEAKFVASPATSSPTATSTAISSVDPVSAATTTATSHGHGKSHHKHQCRAHRH

SEQ ID NO: 5499 - protein, 449 aa, Emericella nidulans
  strain FGSC A4 / ATCC 38163 / CBS 112.46 / NRRL 194 / M139
MGFKRTIGLLLGILLALDQVSVLAQPGRPTFAKRPDIQPNPIQPYKAIPLHSRRNSHKVCYVKPSLNGGDDAGRVEAALRRCNNGGTIVLDKEYSICTPLDLRFLKHVDVALTGKVEFCPELEFWQQNVFQFHFQNASSWWVWGGEDIHLYGAGTGVIHGNGQPWWDAAAGNSSVRRPLLFITDGWHGGSITGLKLRQSPNWHNFIANSSDLLISDMDIFSRSSSEAWASNLDGWDTFRSDNVVIQNSVINHDDDCVSFKPNSTNIIVQGLHCNGSHGISVGSLGNYPYQYDIVSDLYIYNNTMANTTTAARLKVWPGAEAVKKGNPPWVGGGGKGYVRNVTYDLMINDNNDLAIQIDQCYGAINASECLDHPSGVILTNVLFKNMWGTSNGANDPVAGQLICGSADSCDNIRAENVTLTNSSGQPSEWQCRYMDEELLDLGGVGCIPA

SEQ ID NO: 5500 - protein, 726 aa, Emericella nidulans
  strain FGSC A4 / ATCC 38163 / CBS 112.46 / NRRL 194 / M139
MTNSKARYVLEPVQVTGTTFALNGTTLSYQFHVDEPSADLRSDHFGGSISGPIPVDPEPIVDGWTGMPDRVRREFPDQGRGDFRVPAFRIRQAEGHTVSAFRYREHEIVPGKEVSASGLPGVFGDAHDATTLIVRLVDPYSDLAAELKYTVFPKYDTVVRSASITNKSNSDVTIESLASLSVDFPFDELEMIGLRGDWAREAHRLRRKVDYGVQSFGSTTGFSSHLHNPFVALVHPSTTESQGEAWGFSLIYSGSFTINVEKSSQGLTRVSIGPSQLSWTLKPGETFDSPECVAVYSSTGIGGMSRSLHGLYRKHLMKSKFATEDRPVLLNSWEGLYFHIDQDRMYRLAQEAAALGVKLLVMDDGWFGDEHPRTSDDAGLGDWIPNPARFPDGLTPLVNRITALKVANSQRNMRFGIWVEPEMVNPRSTLYQQHPDWVLHAGNYPRTEQRNQLVLNMSLPEVQEFIISAMSEILNAADITYVKWDHNRGLAETPSPCANHAYMLGAYRVFDVLTTRFPNVIWEGCASGGGRFDPGILQYFPQVWTSDDSDAVERIFIQFGTSLAYPASAMGGHISSVPNHQTGRTTPLTFRAHVAMMCGSFGLELDPAHLTDSERRDIPGLIALAEKISPIVVKGDLWRLALPEDSNWPAALFLSENRTQGVLFFFQLAPMVNHSLPRVRLQGLEDGALYRVDGEGPYSGSMLMNLGLQYSFRGDYGSRLAFIERE

SEQ ID NO: 5501 - protein, 434 aa, Emericella nidulans
  strain FGSC A4 / ATCC 38163 / CBS 112.46 / NRRL 194 / M139
MKLSHLLTSAVSVLSLGLTVEGHFSRSRNDAVGPKRPFKPLPYSHPRKKVCHVRSHGDGRDDSAFILSALKSCNNGGKVVFAEEKEYTIGTALDLTFLKHVDLEILGRIQFTNDTDYWQANSFKHTFQNATTFFQLGGEDVNVYGGGTLDGNGQIWYDLYAEDPLILRPILFGVIGLHGGTIGPLKLRYSPQWYQLVANSSDVLFDGIDISGYSKSENEAKNTDGWDTYRSKNIVIQNSVINNGDDCVSFKPNSTEILVQNLYCNGSHGISVGSLGQYIGEVDIVKNVLVYNISMYNASDMARIKVWPGVASAMSEDLQGGGGLGSVSNITYEDMYIENVDWAIEITQCYGQKNMTLCNEYPSNLTISDVYISNMYGTTSSARDPNIGTIVCSSPDVCSNIYVENIDVVSPSGTNDFICTNVNESLLQVNCTSG

SEQ ID NO: 5502 - protein, 310 aa, Emericella nidulans
  strain FGSC A4 / ATCC 38163 / CBS 112.46 / NRRL 194 / M139
MAPSFVSIDTTPDFDMTPTSSKSADSGKRTLLLAPPSIATQEDKLRTLFTTYDRSTTDLQMLDRVSAGFVSLPANTYDLVLVLTGTDGTRRSEALQLLKREVYAAVVPAMKGGAKLQTEDNFFGEAEDREAVLAGLVKKETGFEKMDVGNGAAVPLRLGRKKKAAPAPAPVVQPPPIISSDDNDLNDDELIDEDTLLSADDLKRPIVPPPECQPKAGKRRRACKDCTCGLAAQIEAEDRERREAADKSLNVMKLESDDLNELDFTVQGKTGSCGNCALGDAFRCDGCPFIGLPAFKPGQEVQILNDVAQL

SEQ ID NO: 5503 - protein, 260 aa, Emericella nidulans
  strain FGSC A4 / ATCC 38163 / CBS 112.46 / NRRL 194 / M139
MFIKNGLLLSLATSVLATHGARSHSQAATSKLSKRFTFPIPNSEGSVTLDEVYEIDGETFDGGMKTYGRGVSCTGQDEGGDSDAVFIVKNGGTLKNVIIGSDQIEGVHCEGSCTIENVWWEAVCEDALSLKTGDGPFNVVGGGAQGADDKVIQHNGGGTVSISDFTVYDFGKLYRSCGNCGDQYERHVVIEGVTAVDGKYLVGINSNYGDTATIDSATCATDVKTICAEYKGTDNNDEEPEEVSDGPSDYCIYTEPLSEC

SEQ ID NO: 5504 - protein, 763 aa, Emericella nidulans
  strain FGSC A4 / ATCC 38163 / CBS 112.46 / NRRL 194 / M139
MAVFKSWNLALLSSLFIPALCQSNYPDCTTGPLSELPICDTSLSPLERAKSLVSALTLEEKINNTGHEAAGSSRLGLPAYNWWNEALHGVAEKHGVSFEESGDFSYATSFPAPIVLGAAFNDALIRRVAEIISTEARAFSNSDHAGIDYWTPNVNPFKDPRWGRGQETPGEDPLHCSRYVKEFVGGLQGDDPEKPKVVATCKHLAAYDLEEWGGVSRFEFDAKVSAVDLLEYYLPPFKTCAVDASVGAFMCSYNALNGVPACADRYLLQTVLREHWGWEGPGHWVTGDCGAVERIQTYHHYVESGPEAAAAALNAGVDLDCGTWLPSYLGEAERQGLISNETLDAALTRLYTSLVQLGYFDPAEGQPLRSLGWDDVATSEAEELAKTVAIQGTVLLKNIDWTLPLKANGTLALIGPFINFTTELQSNYAGPAKHIPTMIEAAERLGYNVLTAPGTEVNSTSTDGFDDALAIAAEADALIFFGGIDNTVEEESLDRTRIDWPGNQEELILELAELGRPLTVVQFGGGQVDDSALLASAGVGAIVWAGYPSQAGGAGVFDVLTGKAAPAGRLPITQYPKSYVDEVPMTDMNLQPGTDNPGRTYRWYEDAVLPFGFGLHYTTFNVSWAKKAFGPYDAATLARGKNPSSNIVDTFSLAVTNTGDVASDYVALVFASAPELGAQPAPIKTLVGYSRASLIKPGETRKVDVEVTVAPLTRATEDGRVVLYPGEYTLLVDVNDEYPTAKFEIKGDVQVLEKFPLSGNDSD

SEQ ID NO: 5505 - protein, 380 aa, Emericella nidulans
  strain FGSC A4 / ATCC 38163 / CBS 112.46 / NRRL 194 / M139
MFYALGPLALFAFATEVMATPVAYPMTTASPTLAKRDSCTFSGSDGAASASRSQTDCATITLSDITVPSGTTLDLSDLEDDTTVIFEGTTSWEYEEWDGPLLQIKGNGITIKGADGAKLNPDGSRWWDGEGSNGGVTKPKFFYAHDLTDSTIQNLYIENTPVQAVSINGCDGLTITDMTIDNSAGDDAGGHNTDGFDIGESSNVVITGAKVYNQDDCVAVNSGTSITFSGGTCSGGHGLSIGSVGGRDDNTVDTVTFKDSTVSNSVNGIRIKAKSGETGEIKGVTYSGISLESISDYGILIEQNYDGGDLDGEVTSGIPITDLTIENISGSGAVDSDGYNIVIVCGDDACSNWTWSDVEVTGGEDYGSCENVPSVASCST

SEQ ID NO: 5506 - protein, 809 aa, Emericella nidulans
  strain FGSC A4 / ATCC 38163 / CBS 112.46 / NRRL 194 / M139
MRKTTLFLAVTFATSNAQGRALRSSSPATYGTTDGSDYILKTGYLIGNGKLGVIPFGPPDTEKLNLNVDSLWSGGPFEVENYTGGNPSSPIYDALPGIRERIFENGTGGMEELLGSGNHYGSSRVLGNITIALDGVEAYSKYKRTLDLSDGVHRTSFTIANRTTAALKSSIFCSYPDQVCVYHLESASDARLPKVTISIENLLVNQSLLQTSCESEAKRAVLRHSGVTQAGPPEGMKYAAVAEVVNPRSSVTTCLGEGALQISSRKKQLTIIIGAATNYDQKAGNAKSGWSFKNAKDPASIVDGIASAAGWKGYQRLLDRHVKDYKKLMGDFSLELPDTTDSASKDTSELIEKYSYASATGNPYLENLLLDYARHLLVSSSRPNSLPANLQGRWTESLTPSWSADYHANINLQMNYWLADQTGLGETQHALWNYMADTWVPRGTETARLLYNASGWVVHNEINIFGFTAMKEDAGWANYPAAAAWMMQHVWDNFDYTHDTAWLVSQGYALLKGIASFWLSSLQEDKFFNDGSLVVNPCNSPETGPTTFGCTHYQQLIHQVFETVLAAQEYIHESDTKFVDSVASALERLDTGLHLSSWGGLKEWKLPDSYGYDNMSTHRHLSHLAGWYPGYSISSFAHGYRNKTIQDAVKETLTARGMGNAADANAGWAKVWRAACWARLNDSSMAYDELRYAIDENFVGNGLSMYWGASPPFQIDANFGFAGAVLSMLVVDLPTPRSDPGQRTVVLGPAIPSAWGGGRAKGLRLRGGAKVDFGWDKRGVVNWVNIVKRGKGTSRVKLVNKEGDILAEM

SEQ ID NO: 5507 - protein, 750 aa, Emericella nidulans
  strain FGSC A4 / ATCC 38163 / CBS 112.46 / NRRL 194 / M139
MFRSTATVAAATAMGLLTATGHGSLAIAQGTTGSNAVVVDGTNFALNGASMSYVFHANSTTGDLVSDHFGATISGAIPAPKEPAVNGWVGMPGRIRREFPDQGRGDFRIPAVRIRQTAGYTVSDLQYQGHEVVDGKPALPGLPATFGEAGDVTTLVVHLYDNYSAVAADLSYSVFPEFDAVVRSVNVTNKGKGNITIENLASLSVDFPLEDLDLVSLRGDWAREANRERRRVEYGIQGFGSSTGYSSHLHNPFFALVHPSTTESQGEAWGFNLVYTGSFSAQVEKGSQGLTRALIGFNPDQLSWNLGPGETLTSPECVSVYSKDGIGGMSRKFHRLYRKHLIRSKFATSDRPPLLNSWEGVYFDFNQSSIETLAEQSAALGIRLFVMDDGWFGDKYPRTSDNAGLGDWTPNPDRFPNGLEPVVEEITNLTVNDTSAEKLRFGIWVEPEMVNPNSSLYREHPDWALHAGAYARTERRNQLVLNLALPEVQEYIIDFMTDLLNSADISYIKWDNNRGIHEAPSPSTDHEYMLGVYRVFDTLTARFPDVLWEGCASGGGRFDAGVLHYFPQIWTSDNTDGVDRVTIQFGTSLAYPPSAMGAHLSAVPNHQTGRTVPLEFRAHVAMMGGSFGLELDPATLQDDPDVPELIQMAEKVNPLVLNGDLYRLRLPEESQWPAALFVAEDGSQAVLFYFQLSPNVNHAAPWVRLQGLDPEASYTVDGDKTYTGATLMNLGLQYTFDTEYGSKVVFLERQ

SEQ ID NO: 5508 - protein, 320 aa, Emericella nidulans
  strain FGSC A4 / ATCC 38163 / CBS 112.46 / NRRL 194 / M139
MKLALSLFLLSGSLAQYSNPGACSGDCWGHDPGFYQRVSDGRYYRFSTGGGIQIHASDNLEGPWEAVGEALPGGSVVDHAGSTNLWAPDIHYEASTNLYYMYYSVSTLGSRDSVIGVATSPNLQPNWTDHGALFRSQAGGNYNAIDANWASIGGSPILTFGSYWNGIHQLPLAGPLSLADGATPTQIAYNSSGNHAIEAGFVFYRRGWYYLTFSSGRAGSYDTNPPATGEEYRIVVCRSASGTGDFVDKSGRSCLTDNGGTTILASHGNVYGPGGQGVFEDRTRGWVLYYHYANPDIGLSTGQYQFGWNVLQWADGWPSV

SEQ ID NO: 5509 - protein, 354 aa, Emericella nidulans
  strain FGSC A4 / ATCC 38163 / CBS 112.46 / NRRL 194 / M139
MKFIAPIALLGMFQAASASPVDIKTSNAGLQVTLSQINNTRIKAVVQNTGSEEVTFMHMNFFKDASPVKKVSIFRNNDEVEFQGIKYRVQTDDLSDEVLTSLAPGASFEDEFDIAATSDLSSGGPVTIRSEGIVPLVTEKSVTGSLSYSSNELTIDVDGAEAAKIETVGAQLSKLSKRTRVSSCSGTRATALQTALRNAASLASRAASAASQGGSTFTTFFKSDSSSTRNAVAARLRAVASESSSTSSGSTTYYCTDVYGYCSSNVLAYTLPAYNIIANCDIYYTYLPALTGTCYAQDQATTTLHEFTHAPGVYSPGTDDLGYGYDAATRLSASQALNNADSYALYANAVYLGC

SEQ ID NO: 5510 - protein, 465 aa, Emericella nidulans
  strain FGSC A4 / ATCC 38163 / CBS 112.46 / NRRL 194 / M139
MFTKTQILALALSIASAEAVSKGFNYGANKPDGTLKVQADFEAEFRTAKNLETTSGFNSARLYTMIQGTGSTPISAIPAAIAEETTLLLGLWASGGNMDNEIAALKAAINQYGDEFAKLVVGISVGSEDLYRNSEIGVQANAGIGIEPEELVSYIQRVREAIAGTALSGAPIGHVDTWNAWTNGSNAAVAEAVDWLGFDGYPFFQNTMQNSIDDAKALFDESVQKTKAVAGNKEVWITETGWPVSGDSQNLAIASVENAKQFWDEVGCPLFDNVNTWWYILQDASGSSVPNPSFGIVGNTLSTTPLFDLSCSASSKKNSSSASASASGSSAQSTGFVSTTKPAASPSGSSGLGHGGSLGSSGSFSGGHYAGVGSSSVIASPSATPSGSAVPGSSSGPGSSSGSASGSSSGFGSGAAADSTSGTSTSGDSTSSTSATPADFTGAGSRLSGSIFGAAMLVAALAVAL

SEQ ID NO: 5511 - protein, 812 aa, Emericella nidulans
  strain FGSC A4 / ATCC 38163 / CBS 112.46 / NRRL 194 / M139
MRVPSLSVLSFLLGTALAAASNFEAGLLSSGKVSLGDWKSAHEKASQFVAKLNTTEKIKLITGSSVTTTNGETFTALDILDGDMGAQAYYYVSAFSLSSALAMTWDKEAMYEQGRAIAAEFYGKGIQMVAGPTSQPLGRTPWGGRLVESFGPDPYLNGIATGLETRAYADVGVIAGAKHFILNEQETNRTGGMGGGGGAPGGGGMGRGAEFSSSVPGGMSPTSSAGAIPSSTSTPGGSGMGGGMAGSSAFSSSSSSGAPYSSNADDKTLHETYLWSFYDAVHSGLGGVMCAMTKVNGTLSCQSSSLLLDILKTELGFPGMVWPDTNGQQDALASAANGLDYGSSSLWSESTIEGYLESNNITEARLNDMAIRNLMGYYYVNLDNGTQPSTAAQDDYVDVRANHAKLIRSHGSKSMVLLKNKNNTLPLYKPHKMAIFGSHARAAVAGPNMQFSVEGSGPTYDGHIATDSGSGQASLPYLITPENALNIKASQDGTMLRWIANDTYSSSTGSALVMQGSSSTSVTPSVSAYSENMDVCLVFINALAGEGADRTELRNTDQDNLINEVADNCDNTVVVINTVGARILDSWIEHENVTAVLYGSLLGQESGNSIVDVLYGDVNPSGRLTYTIAKTESDYNVDICYTAQCNFTEGNYIDYRYFDAYNVTPRYEFGYGLSYTDFAYSNLHIQGPSALSTYPTGQLAVGGYEDLWDTVAKVTVTIRNAGSLDGAEVPQLYISYPDVAKQPVRQLRGFHNVYIKKGQSTKVTFELRRRDISYWDVQHQKWAVAPGTYEAWVGASSRDLRTHGSFVVKTKA

SEQ ID NO: 5512 - protein, 325 aa, Emericella nidulans
  strain FGSC A4 / ATCC 38163 / CBS 112.46 / NRRL 194 / M139
MRNLSTWPTFAALLWSAPRVLAQCGLPSTYSWTSTGPLAEPKDGWASLKDFTAVPYNGQYLVYATYHDTGTSWGSMNFGLFSNWSDMATASQNAMTQSTVAPTLFYFEPKDVWILAYQWGPTAFSYLTSSDPTDANGWSSPQPLFSGSISDSDTGVIDQTVIGDSTTMYLFFAGDNGRIYRASMPIDQFPGDFGTESEIILSDERNNLFEAVQVYTVSGQSKDTYLMIVEAIGAQGRYFRSFTADSLGGSWTPQAATESAPFAGKANSGATWTDDISHGDLVRSTPDQTMSIDPCNLQLLYQGRDPSLNPGYDLLPYRPGLLTLK

SEQ ID NO: 5513 - protein, 850 aa, Emericella nidulans
  strain FGSC A4 / ATCC 38163 / CBS 112.46 / NRRL 194 / M139
MYRQEATTVTILAQAPPNWPAPAFDISGFTSAFRPSRRAQRSNTTMGSIDTNSTDAWHTFAIPRLGIPAMRITDGPNGARGTRYFNGVPSACLPCGTALGATFDTDLLFKLGRLLAAECKAKGAHVLLGPTINIQRGPLGGRGFESFSEDPVLSGNSAASYCAGVKDLGIVPTLKHLVCNDQEHERIAVSAMVTERALREIYLMPFQLAIKNARPGALMTSYNKVNGLHASEDPGLLNHIIRKEWGFEGLIMSDWFGTYSVASAVNAGLDLEMPGPTRFRGPALMHALTSNKVSEKTLDDRVRKVLELVQLTSRAGIPEYAPAQKLDRVEDRVLLRQAAADSIVLLKNANEVLPLDPRKKTLVIGPNADIAAYCGGGSASLLAYYTVTPRQGIAEKCEEVVFSQGCYGHKELPLLGDHLKTETGERGYTFRVYTEPATYEDRQPVDVLHMTNSCAFLMDYSHPKISGDTYYATLEGRFEPTESGVYELGLTVAGTGLLYIDGELVIDNKTKQRHGTSFFGIGTVEERGERYLEAGRQHHVFVEYSTAPTSNLKHHGVVSFGPGGVRLGGCRKLDAETAIKQAVQLAAETEQVVVCVGMNGNWESEGFDRPHMDLPPGTDNLVRAVIEAQPNAVIVVQSGTPVTMPWADQAKALVQAWYGGSEGGNGIADVLFGDVNPSAKLPLTFPRDIAHNPSYLSYRSERGRVLYSEDVYVGYRYYDKVKQAPLFHFGHGLSYTTFKLSGLNVQETDPQASDISAEVVQIYVRPPTTASVGRPVRELKGYEKTMLHPGETKEISVTVPMGVATSFWDEGRSAWLSEKGTYAIEVVGTGERNMLSAPLCVQVSRYWNGL

SEQ ID NO: 5514 - protein, 327 aa, Emericella nidulans
  strain FGSC A4 / ATCC 38163 / CBS 112.46 / NRRL 194 / M139
MQNLKFLIAAVSCLGPALAAPTPTSNFINSNFNKRASVEDSAFGYASLNGGTTGGAGGTTTTVSSYAEFTAAVQGDDPKIVIVSGPIEETAEQVDVGSNTSILGADSSAVLTGFGLRLKEVENVIIRNLGIAKVLADNGDAIGAEYSNNIWIDHVDVSSDRDHDKDYYDGLLDFKRGSDYITVSNSFIHDHWKASLVGHSNSNEDEDSGKLHVTYANNYWYNLNSRAPSIRFGTGHIYNNYYETVSDGINTRIGAQVLVEGNVFVDSKKALYSTDEGYAVERNNDFGDAKNEALEGTLTSVEYEYDLLDTSEVKSAVVGTAGQTLTF

SEQ ID NO: 5515 - protein, 381 aa, Emericella nidulans
  strain FGSC A4 / ATCC 38163 / CBS 112.46 / NRRL 194 / M139
MKHLLSLVCTLGAATLAASAAAEAGSMPSANGLDFVIDGEASYFAGSNAYWLSFLTNNADVDLALDHFAESGLKILRIWGFSDVTAEPSDNKVYFQLHQNGSSTVNTGPNGLERLDYIISGAEKRGIKLVIPLVNYWDDFGGMNAYISAYGGDKPGWYTNDKIQAAYHAYVKAVVSRYVDSPAIFAWELANEPRCSGCDTSIINQWATKTSSFIKSLDPNHMVAMGDEGMGLPGDSNYPYSYYEGNDFALNLAIPDIDFGTLHLYTTDWGVSNNSWGNKWVQDHAAVCKSAGKPCLFEEYGMKGNHCTYELAWQKTALATPGMAADLFWQFGENLSSGQTHNDKYTVYYGSNEWKCVVSDHVAAVAVRRYRLPVGGGQHGP

SEQ ID NO: 5516 - protein, 455 aa, Emericella nidulans
  strain FGSC A4 / ATCC 38163 / CBS 112.46 / NRRL 194 / M139
MIEFLALITLISRANALMRPDGVGRLPALGWSSWNAHECDINATVILTAAAQVVKLGLKDLGYEYINIDDCWSIKTHRDPTTNRMIPDADRFPDGIASVASQIHELGLKVGIYSSAGETTCAGYPASLGYEDIDAETFAEWEIDYLKYDDCGVPDNWKDPYTFCVPDTANNAGPFPNGTCPSLPNPAPANYNWSTSPSAERFRRMLDALNTQDRTILYSLCNWGNAAVNTWGAEIGNSWRMSGDISPGRGEVGPDRTRIAVWERIAEITNEMSFLVREYAEFWGWPDADMLEVGNGEGGMTVAENRAHFALWAAMRSPLLIGTKLDTIRQEHLKILKNPTLLTFHQDPIINRPAYPYKWGYNADYTFDAAHPAEYWSGPSPALEGTLVVMLNSENVTSTRMAVWSEVPELQNQDQGDAFEVMDGWTGEDLGCIKEKYEVELDAHDAAVLVVGNAC

SEQ ID NO: 5517 - protein, 255 aa, Emericella nidulans
  strain FGSC A4 / ATCC 38163 / CBS 112.46 / NRRL 194 / M139
MHFKLLSLAALAGLSVASPLNLDERQLGSSSGNDLRDGDCKPVTFIFARASTEPGLLGMSTGPAVCNDLKADASLGGVACQGVGPKYTAGLAENALPQGTSSAAINEAKELFELAASKCPDTRIVAGGYSQGTAVMHGAIPDLSDEIKDKIAGVVLFGDTRNKQDGGQIKNFPKDKIKIYCATGDLVCDGTLVVTAAHFTYVANTGEASKWLEQQLASMPASTSTSSSSSSSSSAPASQTSQSSGLSSWFSGLGN

SEQ ID NO: 5518 - protein, 355 aa, Emericella nidulans
  strain FGSC A4 / ATCC 38163 / CBS 112.46 / NRRL 194 / M139
MKFSQLILPFSAALSLVGSGVATPTTKPVNPRASRPARNLLAHLVRSAGNGTTLSGQQELKDADWVTDNVGFSPVILGVDLMDYSPSRVEFGAVSTSIEDAITYATQGGIITICWHWGELSHDWMTDERLTTLLTLGSPSGTYNTTEQPWWSNFYTEATSFNLSAAMNPASRDYKLILRDIDAIAEQLARLKDIPVLFRPLHEAEGGWFWWGATGAEPCKALYRLLFDRLTKKHGLNNLLWVWNSKDPLWYPGNEYVDVVSVDVYADNGDHSSQLEAYQALQGLTGNFSKLIALGEVGNIPDPELMREDGAQWAYWVTWNGDFIRGETKNPMEFKKAVYASELVYTLDEIQGWNL

SEQ ID NO: 5519 - protein, 355 aa, Emericella nidulans
  strain FGSC A4 / ATCC 38163 / CBS 112.46 / NRRL 194 / M139
MFKLHSFTAALAAGLLTTIVSAAGLHEAALAAGLEYFGTATDNGELTDIPYVTQLNNTADFGQITPGNTQKWDSTEPSQGTFSFTKGDVIADLADANGQYLRCHTLVWHNQLPSWVTSGSWTNTTLTAALRNHITNVVNHYKGRCIHWDVVNEEYGGAKAAGARAIVQLIKNAGVKIDGVGFQAHFSVGTVPSRSSLASVLQSFTSLGVEVAYTEADVRIQLPTSATTLAQQSTDFQNLAGSCVDTAGCVGFTIWDWTDKYSWVPSTFSGYGAALPWDENFVKKPAYDGLLVGLGGTVTTTTTTTATSTTTSATATSTATSPHWGQCGGIGWTGPTLCASPWTCTYVNDWYSQCL

SEQ ID NO: 5520 - protein, 772 aa, Emericella nidulans
  strain FGSC A4 / ATCC 38163 / CBS 112.46 / NRRL 194 / M139
MLTSWGKTGFVLALALGGRAAENVITSDTFFYGESPPVYPSPEGTGAGDWASAYTKARAFVAQLSDDEKIQLTAGVSSNTACSGFIQPIDRLGFPGICMSDAGNGLRGTDYVNGWSSGISVGASWNRDLAHSRGAYMGQEYRKKGVNMILGPVVGPLGRVALGGRNWEGYAADPYLSGVLVSESVKGLQSQKVATSVKHFIANEQETNRNPTTDSERNVVQSVSSNIDDKTMHELYLWPFQDAVLAGATNLMCSYNRVNNSYACQNSKLLNGVLKTELGFQGYVVTDWGAQHAGIASANAGLDVVMPRSSTWNSNLTTAIANGTMEASRLDDMITRLMATWYYLDQDTEFPSPGVGMPSSPSAAHQAVIATSPEAKPILLQSAIESHVLVKNTDGALPLKSPKLISVFGYDAYAPLTYDLGNNFDFSSTRVRSDLYKNGTLYVGGGSGLNSPAYIDAPIDAIKRRAYEDGSSVLWDFTSENPSVDYTSDVCLVFINAYATEGYDRQALSDTHSDSVVENIAGNCSNTIVVVHNAGIRTAEAWVDHANVTAIIYAHLPGQDIGRALVRLLYGESNFSGRLPYTVAKNSSDYGSLLEPSQPEGKYQYFPQSDFSEGVYIDYRAFDKDGIVPQYAFGYGLSYTTFEYSDLKISKNSDGVPSIYPAKASILPGGNPHLFDELVTVTAKIRNTGNVDGQEVAQLYVGIPDGPVRQLRGFDKVLIESGSSATVTFSLTRRDLSTWDANAQEWSLQRGTYKIFVGRDSRDLPLEETLVF

SEQ ID NO: 5521 - protein, 894 aa, Emericella nidulans
  strain FGSC A4 / ATCC 38163 / CBS 112.46 / NRRL 194 / M139
MAGTLLSWTPLALALMARALSQLPLTDCPGYRVINVEERPRGLTADLTLAGTPCNVYGVDIENLRLETDYDTNQRLHVKIYDADENVYQVPDSVFPRPVVNDQACADENTPELRFSYAEDPFSFAVSRASNDETLFNTTGHNLIFQSQYVNLRTSLPQNPNLYGLGEHSDPLRLNTINYTRTLWNRDAYTIPAGTNLYGAHPMYIDHRGEAGTHGVFLLNSNGMDIKIDKNSDNIQFLEYNILGGVLDFYFFAGPSPKDVSVQYAEVAGLPAMVPYWGLGFHQCRYGYRDIFEVAAVVHNYSEARIPLETMWTDIDYMDHRKVFTLDRERFPLDTVRALVQYLHQRDQHYIVMVDPAVAHSENGAFTRGLEKDVFMRKQDGTLYQGAVWPGATVFPDWFHPNTSDYWINEFALFFNAESGVDIDALWIDMNEAANFCDWPCTDPVAYAEENNLPPEPPAVRPNPSSLPGFPAEFQPVNSNNNNSSRKRETQVVIAARQGFVKVGNDNGNGRRLGLQGRELIDPPYKIANAAGSLSNKTMNTDIFHANGLAEYDTHNLYGTMMSSLSRDAMLYRRPEKRPLVITRSTFAGAGSYVGHWLGDNASTWTKYRISIAQMLAFASIFQIPMVGSDACGFTGNTTEELCSRWATLAAFNPFFRNHNEYGMVSQEFYRWNSVAEAARKAISIRYSLLDYLYTEFHEQTVTGEPFLLPLFFVYPNDPNVVGIDSQFFYGDAILVSPVIEEGKTEVHAYFPGDLFYDWYTGLPLRGNGEVITLTDIGYTDIPLHVRGGKIVPVRTGSAGMNTTTEVRKSGFRLVIAPGLDGRAAGRLYIDDGESLEQTAMVDVVFTYEDGRVSVDGVFTLQTDLRVEAVTVFGDNVVERTIDLPLSGPGGVEL

SEQ ID NO: 5522 - protein, 221 aa, Emericella nidulans
  strain FGSC A4 / ATCC 38163 / CBS 112.46 / NRRL 194 / M139
MRFHTILLAALASLVIATPLPSDTDVSLERRQSMNSNDLEKGDCKSVAFIFARGSTEIGNMGFVVGPGVCSNLKSTLGSDKVACQGVGGAYTAGLIQNALPANTDSGSIKEAVKMFDLAAKCPDTQIVAGGYSQGSAVIDNAIQKLDDSTRDRVKGVVLFGFTRNLQDKGQIPGYPKDQTKVYCAVGDLVCSGTLIITASHMTYGLNAGDAAKFLASQVSV

SEQ ID NO: 5523 - protein, 659 aa, Emericella nidulans
  strain FGSC A4 / ATCC 38163 / CBS 112.46 / NRRL 194 / M139
MRALVPMVVAATALASPAPALKPRLDDGLARTPQMGWNTYNQYNCFPNESIVHENAQALVDTGLADLGYRYVTIDCGWGVEDRLPNGTITWNPELFPQGFPAMGQYLHDLGLLFGVYGDSGILLCGSPPNITGSLYYEDIDARTFAEWGADSLKYDNCYSDAATNYPNVNYAPSTSPHPRFANMSRYIQAQDRDILFQVCEWGIDFPALWAPEIGHSWRIGNDIIPHWRSIFRTLNQAVPQTDFAGPGQWPDLDMLLVGLDGVLTVPEEQTHFSLWSILKSPLTIGAAIPGMRAESLEILSNADVIAFNQDALGVSAALRRRWSDEGYEVWSGPLEGGRTIAAVINWRDEDREITLDLPDIGLQYAETLQNVWADETVNGVKTSYSSVVEAHGVMLVQLAETVEEGVYPADVFAATNRDVTTFSDVYAITSSPNFVLNITLTEVTAAATNITIITDSSRRPISTSIPAGSSSISTSVSLIAGSNNTITIRNAPPLSSITLSPPEPTYYTGAQDFTLTSPAGAYTCPDAYCLPAGSKIVDLSTESAATAHINSSTSGSKYLEIDYINNEVAFDSSWGWGANSRNLTIKVNDNNPVRLEVPLSGRHSELFGPGLGWWDSGRLGVLTDGWIKGTNELVLSNEGGEGGFTKYAPDVVGIAVYD

SEQ ID NO: 5524 - protein, 527 aa, Emericella nidulans
  strain FGSC A4 / ATCC 38163 / CBS 112.46 / NRRL 194 / M139
MLSKTFLLSSAVLWARVANAAFGITDNGSSYTIDANSPNPLKFTVNKSSCDITSIVYYGSEFQYSGKGSHIGSGLGSATVSATQSGDYIKVTCDTSSLTHYFVVHNGDPIIHMATYITAEPDIGELRFIARLNSNLLPNEEPFGDVSTTSGGSAIEGSDVFLVNGETRSKFYSSERFIDDHRHCISGSAHRVCMILNQYESSSGGPFFRDINSNNGGDYNALYWYMNSGHVQTESFRTGLHGPYSMYFSRSGTPSTNIDTSFFASLGIKGYVAANGRGTVTGKASGADSSMDWVVHWYNNDAQYWTYTASDGSFTSPAMKPGTYTMKYYQGEFPVAETTVTVSAGSSTTKNISGSVKTGTTIFKIGEWDGQPTGFRNADKQLRMHPSDSRMDSWSSTYTVGSSSLSDFPMAVFKSVNNPVTIKFTATSAQTGAATLRIGTTLSFAGGRPQATINSYTGPAPSAPTNLNSRGVTRGAYRGLGEVYDVSVPAGTIVTGENTITISVISGSSGDAFLSPNVVFDCIELFQ

SEQ ID NO: 5525 - protein, 390 aa, Emericella nidulans
  strain FGSC A4 / ATCC 38163 / CBS 112.46 / NRRL 194 / M139
MKLSTALVLGATATGAWSYAIPQLEQEVLELPETHYEQQEKYLIELSPYQTRWVTEEEKWALKLDGVNFIDITEDRNYGLFPTLDAGSYVNYPQKMGYVDTVKGLIAGLSMDNMRKDLENFTSFHTRYYKSSSGVESAQWLYDQVSKVVRDSGADKFGATVQKFDHSWGQFSIIARIPGLSKKTVVLGAHQDSINLFLPSFLGAPGADDDGSGTVTILEALRGLLKSDIVAHGQSPNTIEFHWYSAEEGGMLGSQAIFSKYKKNQADVKAMLQQDMTGYVQGTKHAGQKESIGVMTDFVDPALTSFLKNTIVTYCAIPFVETKCGYACSDHTSASKYGYPSAMATESTMENSNKHIHTTDDKISYLSFDHMLEHAKLTLGFAYELAFAAL

SEQ ID NO: 5526 - protein, 654 aa, Emericella nidulans
  strain FGSC A4 / ATCC 38163 / CBS 112.46 / NRRL 194 / M139
MDKHRRDDSPSGLSDIVERDGLLGTGITSRHIEAFGRKVTSTAGHLMGPSGDPSTSTHYQNAMVDIHRELRRPSTQRKVFALAQTTPTDLVRSKLSTSEIQSRAISSLPDELLLNIPDDTSSYSLFEGFQATQNDHEYRKAHRRGRSKGKKLLKDKDGEQADPPSTLTELKKERDLLSRRMELMGVRKNMCSSEIVDIDNKIANFHRMRQIVLDRLAGLEMEEAELEHEVNEIDNKLDDMAEEEAAQAAQAAAAAAAATTAGSETHEEPASEDPAMDASFMSESIYQKLPSPRSLKHRSIRKRSMPVLHEHFAPGSEIKEFQAHTDVVTALDLDYPFGTMITAALDDTVRVWDLNIGRCTGFLEGHNASVRCLQIEDNVVATGSMDATVKLWDLSRARTTHRDNRVNKDEDDDAVSVAYSTSLEDCHVYSLDAHVGEVTALHFKGNTLVSGSADKTLRHWDLVKGRCVQTLDVLWAAAQASSLGNESQWRPSGRLPDASADFVGAVQCFDAALACGTADGMVRLWDLRSGQVHRSLVGHTGPVSCLQFDDVHLVTGSLDRSIRIWDLRMGSIYDAYGYDKPVTSMMFDTKRIVAAAGENVVKVYDKADGHHWDCGAGVGADETGPDPAIVERVRLKDGFLIEGRRDGIVAAWTC

SEQ ID NO: 5527 - protein, 257 aa, Emericella nidulans
  strain FGSC A4 / ATCC 38163 / CBS 112.46 / NRRL 194 / M139
MPVLSKLLPTLTLTLPLLAGPCLAAANPKLSKRFTFPIPSSTGSVTFSEPYEIAAGEIYDGELQTFGRGVECTGQDEGGESDTVFIVQEGGTLKNAIIGADQIEGVYCLGACTIENVWWEKVCEDALSLKEGSGPYVVTGGGAQGAEDKVIQHNSEGEVIVDGFTVYDFGKLYRSCGTCGDIQRSATITNVVAVSGSTIAGANGNFGDVVTIDSSNCATDVSAICTTYEADADGGEPEEVSTDVTEACVFEELPACE

SEQ ID NO: 5528 - protein, 514 aa, Emericella nidulans
  strain FGSC A4 / ATCC 38163 / CBS 112.46 / NRRL 194 / M139
MKRCALLTPLLPLALACNNPNDPAHSCASIYSVSSDEAASFCATFTASVVSEPTGVPDAFLSACDSKIKHLSSACSCLGPVDSATATPVPATSTVPASVPVITTSTATATPSRIPVFVPSSSSSSAVVTFKTQIKSSSPGPSSSFAAAATTEAPTSTRASPYTPYTGNGGTTCTVTDYAGISSAVASCSNIMLSDVYAPPSSTIDLQDLQTGAAVIFAGKTTFGDTSDSDFDPIVISGTNLTITGTEDHVIDGNGQAYWDGQGSNGGSDKPDHFIVLKHVYNSVVANLNIQNWPVHCFDIENTESLTLTGITLDNSAGDEPNDSSDGDPAAHNSDGFDIKSSTDLILKDSNVYNQDDCVAITSGTNITVDNMYCSGGHGLSIGSIGGKSDNTVDGVVFSNSQVVNSQNGCRIKTNEGETGEVSNIKYENISLSGISKYGIVVQQDYLNGGPTGEPSNGVSITNVEFTDVTGTMSGGKDYYILCGDGSCENFTFSGVSITGGSDDSCNYPDSGCP

SEQ ID NO: 5529 - protein, 773 aa, Emericella nidulans
  strain FGSC A4 / ATCC 38163 / CBS 112.46 / NRRL 194 / M139
MKLSVLSVLLVSVAQAAAAPWRPREPRAAGSKRLTFNETVISAALSPSSISVQWIATENDGDYVYQEEDGSIKIESIVTNRSQTIVPAEKIPADAYSYWISPDLSAVLWATNYTKQYRHSFFADYYIQDVETLETVPLVEDMVGDIQYAEWSPSGDSIAFVRGNNLWTWSDGTVTAITKDGGPDMFHGVPDWIYEEEILGDRFALWFSPDSELLAFLTFNETGVPTFTVQYFMDNQEIAPPYPRELDIRYPKVSETNPTVKLNILQLSDNTVSTIPIDVFDPSELIVGEVAWVTDTHTELAVKAFNRVQDESKVVIVETASGETKIAHERDGTDGWLDNLLSISYVGPLALGSGDASSAYYVDLSDHSGWTHLYLFSTSGGDPIPLTEGEWEVTSIVSIDQERELVYYLSTQHHSTERHLYSVSYRTFEITPLVDDTVEAYWSVSFSAKAGYYILTYAGPSVPYQELYSVNQTAPLRTLTSNAALIEKLEEYALPNISYFELEIPSGEKLNVMQRLPVGFSPDKKYPVLFTPYGGPGAQEVSKRWQSLDFNAYIASDPELEYVTWTVDNRGTGYRGREFRSLVAKQLGKLEAEDQVYAAKQAAKLDWVDSEHIAIWGWSYGGYLTGKVLETDSGAFSLGLLTAPVSDWRLYDSMYTERYMKTLSTNAEGYNTTAIRHTDGFKNVEGGFLIQHGTGDDNVHFQNAAALGDTLIGNGVTPEKMQVQWFTDSDHSIRYNGGNVFLYRQLAQRLYKEKNRAKKEQHQWSKRSQDWVV

SEQ ID NO: 5530 - protein, 399 aa, Emericella nidulans
  strain FGSC A4 / ATCC 38163 / CBS 112.46 / NRRL 194 / M139
MIFSTLLSLALLATTATARKGFVTTKGDKFQLDGKDFYFAGSNAYYFPFNNNQTDVELGLSAAKKAGLLVFRTWGFNDKNVTYIEDGLPQYGGEGAGTTEVVFQWWQNGTSTIDLEPFDKVVNAAAKTGIKLIVTLVNNWADYGGMDVYTVNLGGQYHDDFYRLPQIKKAYKRYVKEMVTRYRNSPAIMAWELANEPRCGADGVRNLPASDECTPELLTSWIDEMSTYVKRLDPHHLVTWGGEGGFNYDSDDWAYNGSDGGDFEAELKLKNIDFGVFHSYPDWWSKTVEWTNKWIVDHARAARRVGKPVVHEEYGWLTPQGRLDNLGTVSNITRLEAVGGWQSISLREKMSDMFWQFGYSGYSYGRNHDDGFTIYLDDAEAQELVYKHAKEVNKLNRRR

SEQ ID NO: 5531 - protein, 660 aa, Emericella nidulans
  strain FGSC A4 / ATCC 38163 / CBS 112.46 / NRRL 194 / M139
MRLGVCFSLAAAASVARAALTATENDTSIVLENDRLRATFDKGRGSIIDLYLDGQDFLGPQSGSTGIGPYLDCYCTPSGFYTAGSTNPVTELVQGTDSTGTKYAGIILNDTYTPTGQEFQQYWFLRDGETGFHMFSRLAYYNETTPFLRNLQELRTLFRPNTDLWTHLTSSDLQTAPLPSDEAIAEQIVVQDATWRLNNTPDDAYYQQFSEYFTKYTFSNHWRDNDVHGLYADGSTSDGTTYGAWLVMNTKDTYYGGPLHSDLTVDGIIYNYIVSNHHGEGTPNITNGFDRTFGPQFYLFNGGGSSSLEELRDEARSLASPSWNADFYDSIAKHVIGYVPSSQRGSVKGTIKLPKNAKSPIAVLTVDGHYFQDNSAVPSSHQYWADIDKNGRFSIDRVVAGKYRLTVYADGIFGDFTRDGIVVKARKSTSIKETWKPESAGTEIWRLGTPDKSSGEFRHGAARDPTHPRHPPEYLIYWGAYDWQSDFPGGIDYMIGESDPATDFNTVHWAVFGPTPDNPVAESNTTHDWRIRFDLSAKQLHARKTATLTIQLAGAKAASGNTDVYNASEPYANLPLRSYINEQEEPLTMVIGYDQSSSCIVRSAVSCYQVREKWEFPASWLKEGSNLLRLSLPTNGTNYESAVLPTSVYVQYDALRLELK

SEQ ID NO: 5532 - protein, 310 aa, Emericella nidulans
  strain FGSC A4 / ATCC 38163 / CBS 112.46 / NRRL 194 / M139
MSALSLENITGVYAPSALLVVGTFILKKEWVPFAVALAAGFVAWKLSVGGSSKPRKVLNPNEFQNFVLKEKNDISHNVTIYRFALPRPTDILGLPIGQHISLAATIEGQPKEVVRSYTPISSDNEAGYFDLLVKAYPQGNISKYLTTLKVGDTMKVRGPKGAMVYTPNMCRHIGMIAGGTGITPMLQIIKAIIRNRPRNGGNDTTQVDLIFANVNPDDILLKDELEKLAAEDDGFRIYYVLNNPPEGWTGGVGFVTPDMIKERLPAPASDIKILLCGPPPMVSAMKKATESLGYTKARPVSKLEDQVFCF

SEQ ID NO: 5533 - protein, 400 aa, Emericella nidulans
  strain FGSC A4 / ATCC 38163 / CBS 112.46 / NRRL 194 / M139
MAVIFVLFFLVSMALSARIRPSFNGTALSGTSNKHPFEPGPNTIFREEVPPSAAASGFPSAHGTELRTHDPSIIKVGSIYYSYSVGPSITIHQAFSLDGPWTEVGALLSGESVIKKGDRKAPWAANTIYINGRYYCYYSVSNSGCRDSAIGVASSAFPGPGEWTDHGLIIQSGTGEGSDVFPLNQSNTIDPNVFVDGDGTAYLNFGSFWTGLWQVPLEEELVTVKGLQDGTLDAVHLAAEPGKVWRSKLANSKAKTVSTSKTGSPICGDPTGGHPIEGGFMAYHAPYYYMWFSWGRCCEFKDPAMRSNGKEYRIRVGRSTSARGPFVDKQGIDLVDGGGETVYGSNGDVFAPGGQGILTDEFGDILYYHYLNSSVSYDFADARLGYNRLEYVDGWPVAVY

SEQ ID NO: 5534 - protein, 153 aa, Emericella nidulans
  strain FGSC A4 / ATCC 38163 / CBS 112.46 / NRRL 194 / M139
MTSSNLPYAADAESPLKPAELQVLRAQYEKEGDYVGVQTKFNYAWGLIKSNFRADQQEGVRLLSEIFRAHPERRRECLFYLALGNYKLGNYGEARRYNDLLIDKEPGNLQAASLRTLIDDRVSREGMVGIAIVGGLALAAGVVGGLLFRGQRR

SEQ ID NO: 5535 - protein, 233 aa, Emericella nidulans
  strain FGSC A4 / ATCC 38163 / CBS 112.46 / NRRL 194 / M139
MLSKLALASTLIPAALACLGYEGGVPTPTASYSNSAPIEIAAGQTFDAGWARYDRGSGACTDGEGGNDDAVFILRSGATLKNVIIGKNQKEGVHCEGPCTLEFVWFEDVCEDAITVRGDSAGDHTWIIGGGAYHASDKIVQHNGCGTVNIINFYAEDYGKVYRSCGNCSSQCKRNVYIEGVTAYDGGDICGINSNYGDTCTLNNVCTDADHPCVLYEGCAGGCEPEKVGYCSG

SEQ ID NO: 5536 - protein, 304 aa, Emericella nidulans
  strain FGSC A4 / ATCC 38163 / CBS 112.46 / NRRL 194 / M139
MVKLQYLLSILLYAYSCTALMLDRRDPTPGQLSQVTDFGDNPTNVGFYIYVPQNLASNPAIIVAIHYCTGTAQAYYSGTPYAQYAETYGFIVIYPESPYSGTCWDVSSQSTLTHNGGGNSNSIANMVDWTINQYNADASRVYVTGTSSGAMMTNVMAATYPNLFAAGIAYAGVPAGCFYSEANVEDQWNSTCAQGQSISTPEHWAQIAQAMYSGYEGSRPKMQIYHGSADATLYPQNYYETCKQWAGVFGYNYDSPQEVQNDTPVAGWAKTIWGENLQGILADGVGHNIQIQGEEDLKWFGFTS

SEQ ID NO: 5537 - protein, 819 aa, Emericella nidulans
  strain FGSC A4 / ATCC 38163 / CBS 112.46 / NRRL 194 / M139
MTSASQILVWGLLAASGAQAQNYGGGSSRSDDAFSYVQPKNTTILGAYGHSPAVYPSPNTTGSGGWETALAQAQDFVAQLTLEEKANMVTGQPGPCVGNIIAIPRLNFSGLCLQDGPLAIRVTDMASVFSAGVTAAASWDRKILYERGYAMGQEFKAKGAHVALGPVAGPLGRSAYSGRNWEGFAADPYLTGVAMEETIQGYQDAGVQACPKHFIGNEQETMRNPTFNDSAPLGTVIQEAVSSNIDDRTMHELYLWPFANAVHAKAASIMCSYQRINGSYGCENSKTLNGLLKGELGFQGYVMSDWGATHSGVAGIKSGQDMDMPGGLGAYGQTFINRSFFGGNVTAAVNNGTLEESRIDDMILRIMTPYFWLGQDQDYPTVDPSTADYNTFSPRNTWYQDFNLTGERSRDVRGNHAALIRKQAAEATVLLKNKNNALPLKAPKTLAVFGNDASDITNGPYNDATYEYGTLAAGGGSGTGRFTYLVSPLTAINARAQKDNTSLVQFWLNNTQIATSDVQADLLRVPTPPTACLVFVKTWAEEGADREHLRLDYNGTEVVEAVAAACNNTIVVTHSSGINELPFANHPNVTAILAAHFPGQESGNSIVDVLYGDVNPSGRLPYTIARNGSDYNAPPTTAVTTSGREDWQSWFDEKLEIDYRYFDAHNIPVLYEFGFGLSYTTFNISDIYATRVVDSITSAPEDRAIQPGGNPELWETIYNVTVSVTNTGDVEGATVPQLYVTFPDSTPEGTPPKQLRGFDKVSLQPGESTKVIFELMRRDLSYWDTVSQQWLIPEGDFTIRVGFSSRNLKEVTTITPVSE

SEQ ID NO: 5538 - protein, 274 aa, Emericella nidulans
  strain FGSC A4 / ATCC 38163 / CBS 112.46 / NRRL 194 / M139
MHFTQFISTSLSISLLAGSALAIPTGSYSHSNSTDGSGSNIDSLLPPIVPVNPRSGNKELITSLLLAPTQADRAALLTEPGDYIFDFNEGGAPEGAEAKGLGGFSIAAHSKTFPALIGNGASMTLGFLGPCGMNTPHVHNRATELNVVVKGRLVTNFILENGVSPVENTLDLYQMAVFPQGSIHQEFNPDCGETVFVAGFNDADPGVSQVAQGLFGLRGDVVQATLGGIQTFNGQDIESFREMIPKNVALGIEACLAKCGLQKNEKRELKELMN

SEQ ID NO: 5539 - protein, 166 aa, Emericella nidulans
  strain FGSC A4 / ATCC 38163 / CBS 112.46 / NRRL 194 / M139
MRLNYIYTATLTLALALSVLASTGGFSSTNTAIETRNIGTAEWMEYDSLSPDLNSGVDHGAGDHLRPQKRKLVADPYKVPYPLQTGPTRYAPLAKKPGTATATTLPTPQFPASPYKIATKYLNPGTVQTTLSATETLSVTMMENTRGRELGMTLTRTGRYDAFAAQ

SEQ ID NO: 5540 - protein, 424 aa, Emericella nidulans
  strain FGSC A4 / ATCC 38163 / CBS 112.46 / NRRL 194 / M139
MNLSILAALALVSFSTASTEQQSPLFSHADRSPKSIIDASPFLSLHRDLVSIPSVSGNESAVGEFLASFLESHNFNVIKQPVEGRTSRFNVFAYPSSAPSKPSILLTSHIDTVPPFIPYSVQYSDNERDIVISGRGCDDAKGSVAAQVVAALETLAENPSAPLALLFVVDEEVGGAGMRAFSFNTTLNPSPDSPSSLVDGYKTIIFGEPTDLALVSGHKGMLSFHVHVTGKSSHSGYPWLGESALSTILPALSVIDKLGDIPVEKGGLPSSEKYGRTTVNIGRVEAGVAGNVVPAAADADVTVRLAAGTPEEAMDIVLAAVANATGDNPHVVVKFAEGPNGGVGGYAPQDLDTDVPGFEITTVNYGTDVPNLKVYEENDVKRYLYGPGSIHVAHGDHESITVAQLEEAVKGYKKLITAALERIY

SEQ ID NO: 5541 - protein, 350 aa, Emericella nidulans
  strain FGSC A4 / ATCC 38163 / CBS 112.46 / NRRL 194 / M139
MILSSLLPLSLVTLTSAALTYRGADISSLLIEEDSGVAYKNLNGETQAFELILANNGVNSIRQRIWVNPSDGSYNLEYNLELAKRVQDAGMSVYLDLHLSDTWADPGDQATPSGWSTTDIDTLAWQVYNYTLDVCNTFAENNVAVEIVSIGNEIRNGLLHPLGSTDHYDNIARLLHSGAWGVKDSSLSTTPKILFHLDNGWDWDAQKYFYDTVLATGTLLSTDFDLIGVSYYPFYNADATLSSLKTSLTNLKSNYGKNVLVVETDWPVQCSSPEYAFPSDLSSIPFSADGQETFLGRLADTLEDVGGVGIYYWEPGWVDNAGLGSSCEDNLMVDWRDRTVRESISVFGDL

SEQ ID NO: 5542 - protein, 421 aa, Emericella nidulans
  strain FGSC A4 / ATCC 38163 / CBS 112.46 / NRRL 194 / M139
MQPLHTLLALLPLCRSTTALLAFPGAEGFGANAVGGRGGDVYVVTNLEDSGEGSLRDAVSETDRIVVFAVGGVINIEDRLVVSKRVTILGQTAPGDGITVYGNGWSFSNADDAIVRYIRVRMGRGGDSGKDGITIAEGSNMIFDHVSVSWGRDETFSISGTAENITVQDSIIAQGLETHSCGGLMQTDGGVSLFRNLYIDNKTRNPKVKGVNEFTNNVVYNWGGGGGYIAGDSSGQSFGNYFISGPSTSVTAFTRGNENFHGYVENNYYDPDQDGTLNGNELGVSSSNYGGMDIVDTKYDYPAAQYIMTPDEAVSYVTENVGASLVRDGVDSNLIDQVLSYGTDGALISDEDDFGGVGDLDGGETPTDTDGDGIPDDVETQLGTDPNIADSTEIDSSTGYSWLEVWANSLVPEGYASTRKC

SEQ ID NO: 5543 - protein, 213 aa, Emericella nidulans
  strain FGSC A4 / ATCC 38163 / CBS 112.46 / NRRL 194 / M139
MKLQLHLALSLLAAIVAANPIRLDQRQITGNELRDGSCHDVTFIFARGSTELGYLGSTVGPATCNVLKLRKPGQVACQGVAPAYIADLASNFLPQGTNQIAINEAKSLFELAASKCPNTKIVAGGYSQGAAVMHAAISTLSSTVQDQIKGVVLFGDTRNKQDGGRIPNFPTDKTKIICAFGDLVCEGTLVITAAHLSYIDDVPDAADFLVGKL

SEQ ID NO: 5544 - protein, 455 aa, Emericella nidulans
  strain FGSC A4 / ATCC 38163 / CBS 112.46 / NRRL 194 / M139
MHYSASGLALAFLLPAIQAQQTLYGQCGGSGWTGATSCVAGAACSTLNQWYAQCLPAATTTSTTLTTTTSSVTTTSNPGSTTTTSSVTVTATASGNPFSGYQLYVNPYYSSEVQSIAIPSLTGTLSSLAPAATAAAKVPSFVWLDVAAKVPTMATYLADIRSQNAAGANPPIAGQFVVYDLPDRDCAALASNGEFAISDGGVQHYKDYIDSIREILVEYSDVHVILVIEPDSLANLVTNLNVAKCANAQSAYLECTNYAVTQLNLPNVAMYLDAGHAGWLGWPANLQPAANLYAGVYSDAGSPAALRGLATNVANYNAWAIDTCPSYTQGNSVCDEKDYINALAPLLRAQGFDAHFITDTGRNGKQPTGQQAWGDWCNVIGTGFGARPSTNTGDSLLDAFVWVKPGGESDGTSDTSAARYDAHCGYSDALQPAPEAGTWFQAYFVQLLQNANPSF

SEQ ID NO: 5545 - protein, 270 aa, Emericella nidulans
  strain FGSC A4 / ATCC 38163 / CBS 112.46 / NRRL 194 / M139
MLRAVLLPTLLAFGAFTPVHGANSPGCGKQPTLTNGVNQINGREYVLKIPDGYDPSKPHHLIFGLHWRGGNMYNVVNGDSIQPWYGLEARAQGSAIFVAPNGLNAGWANTNGEDVAFIDAIMEQVEDDLCVDQASRFATGFSWGGGMSYALACARAAEFRAVSVLSGGLISGCDGGNDPIAYLGIHGINDPVLPLDGGVTLANTFVSNNGCQPTDIGQPASGSGGSVRTDFSGCSHPVSFIAYDGGHDGAPLGVGSSLAPDATWEFFMAA

SEQ ID NO: 5546 - protein, 446 aa, Emericella nidulans
  strain FGSC A4 / ATCC 38163 / CBS 112.46 / NRRL 194 / M139
MYQRALLFSALLSVSRAQQAGTAQEEVHPSLTWQRCEASGSCTEVAGSVVLDSNWRWTHSVDGYTNCYTGNEWDATLCPDNESCAQNCAVDGADYEATYGITSNGDSLTLKFVTGSNVGSRVYLMEDDETYQMFDLLNNEFTFDVDVSNLPCGLNGALYFTSMDADGGLSKYEGNTAGAKYGTGYCDSQCPRDIKFINGLGNVEGWEPSDSDANAGVGGMGTCCPEMDIWEANSISTAYTPHPCDSVEQTMCEGDSCGGTYSDDRYGGTCDPDGCDFNSYRMGNTSFYGPGAIIDTSSKFTVVTQFIADGGSLSEIKRFYVQNGEVIPNSESNISGVEGNSITSEFCTAQKTAFGDEDIFAQHGGLSAMGDAASAMVLILSIWDDHHSSMMWLDSSYPTDADPSQPGVARGTCEQGAGDPDVVESEHADASVTFSNIKFGPIGSTF

SEQ ID NO: 5547 - protein, 259 aa, Emericella nidulans
  strain FGSC A4 / ATCC 38163 / CBS 112.46 / NRRL 194 / M139
MAPITDDVVAGLKSTIGKLEARIEDLESRLGGEPKPKSIAEHMRIILMGPPGAGKGTQAPKIKEKYCVCHLATGDMLRSQVAKKTDLGREAKKIMDQGGLVSDEIMVNMIKSELENNAECKNGFILDGFPRTVAQAERLDEMLVARNQKLQHAIELKIDDALLVARITGRLVHPASGRSYHKIFNPPKEAMKDDITGEPLVQRSDDNAEALKKRLVTYHAQTAPVCDYYKKTGIWRGIDASQEPGQVWKSLLGVFNNKN

SEQ ID NO: 5548 - protein, 836 aa, Emericella nidulans
  strain FGSC A4 / ATCC 38163 / CBS 112.46 / NRRL 194 / M139
MKKPNHAVLGIGLALCIEAAYSAASQSYTWKNVVTGGGGGFVPGIVFNPSEEGLAYVRTDIGGAYRLNSDDTWTPLTDFVGNSNWNRWGVDALATDPVDTNRLYLAVGMYTNEWDTSNGAILRSTDKGETWTETALPFKVGGNMPGRGMGERLAVDPHKNSILFFGARSGHGLWKSTDYGATWSNVTSFTWTGTYFQDSSSTYTSDIVGIAWVTFDSTSGSSGSPTPRIFVGVADTGKSVFVSEDAGATWNWVTGEPQYGFLPHKGVLSPAEKTLYISYSNGAGPYDGTNGTVHKYDISSGTWTDISPTSMEDTYYGYGGLSVDLKVPGTLMVAALNCWWPDELIWRSVDSGANWSPIWAWNGYPNINYYYDYEVSNAPWLEDTTSTDGFPVRVGWMVEALSIDPFDSNHWLYGTGATIYGGHDLTSWDSIHRVTLQSLASGIEETAVQALIVPPGGPPLLSAVYDVGGFYHSDLDTPPTQAYHTPTYGSTNGLDYAGNNPATIVRSGSTDADDPTVALSNDFGRTWSANYAASSATGPGPVAISADGDTILLMSNTQGALRSQYQSTFAAVTSLPSGAVIASDKANNTVFYGGSSGSFYVSTNTGTSFTKTATLGSSSTVNAIRAHPSLAGDVWASTDTGLYHSTDYGRTFTKTGSSCTAGWGFGLGKPSSTSAYPVIYGFFTVDGVTALSKTEDEGTTWAMISDSEHGFGAASANVVNGDMGNYGRVFVGTNGRGIFYGEPNGSSPPSSSSTSTTATTSSTSTTLTTTSTPTTTVTTTTTSTTATATATASPYGQCGGSEYTGPTACPSGWTCTFFNHFYSQWLYGVLLAVWGR

SEQ ID NO: 5549 - protein, 464 aa, Emericella nidulans
  strain FGSC A4 / ATCC 38163 / CBS 112.46 / NRRL 194 / M139
MAIIRSVIAATALLGAAVNAQVVGTPFGFGAGTTGGGDATPAAPADTAELTEWLADDEPRVILIDKEFNFLGDECTDCECCIPDSNTCGDAGQNAIEVGIGWCGDYPTTTCTYDNAGLDGLDVGPNKSIVGVGDAGVIRGKGLRIHGTENVIVQNIHITELNPQYIWGGDAISLDGADKVWIDHVKISLVGRQMFVTGYESSGSVTFSNNELDGTTDWSASCDGHHYWTILALGENDKVTFANNYIHTTSGRAPKVGAPSFWHVYNNYWSDNTGHAFDVEESGTNVFIEGNVFEDINSAYNDDGTGAIFAVDSGSEATCSSVLGRTCVANSLTNSEYTAVADESVLSAFPADEEGDITILPVDQVAAYVLANAGVGKLSASGSTSGSSSSIAPSSSVPVIPTSTPLVYPTFTPPAVETNAIQKEHEVSTPAVPTPTPVPSSVGSHGSTAGSSHPPAFSRTSFES

SEQ ID NO: 5550 - protein, 88 aa, Emericella nidulans
  strain FGSC A4 / ATCC 38163 / CBS 112.46 / NRRL 194 / M139
MASHPEQQSSSSSADVSSSSWGKVERKFTNKSASEYYDPCQDFADRSLRCMKRNPDDRDMCHDYFQAYRDCKKQWLTQKKLGSSSTAK

SEQ ID NO: 5551 - protein, 364 aa, Emericella nidulans
  strain FGSC A4 / ATCC 38163 / CBS 112.46 / NRRL 194 / M139
MHFLQNSLIAAAMGAALVAAAPAADLDARSSCTFTSASAAKSGASKCSTVTLKSIQVPAGETLDLTGLKSGATVIFEGETTFGYKEWKGPLISMSGDKITVKQASGAKINCDGARWWDTKGSNGGKTKPKFFSAHKLNNSKIQGLKIYNTPVQGFSIQSDHLTISDVTIDNSAGTSKGHNTDAFDIGSSTYITIDGATVYNQDDCIAINSGEHITFTNGYCSGGHGLSIGSVGGRSDNTVKSVTISNSKVVDSQNGVRIKTVYKATGSVTDVTFQDIELSGITKYGLIVEQDYENGSPTGTPTNGVEVEDITFKKITGSVDSSATRVNILCGSGSCKDWTWSGVDITGGKKSSKCKNVPSGASC

SEQ ID NO: 5552 - protein, 634 aa, Emericella nidulans
  strain FGSC A4 / ATCC 38163 / CBS 112.46 / NRRL 194 / M139
MLCCMRICVCGDEGTGKSSLITSLVKGVFVTNKIQPILPQITIPPTIGTPENVTTTTVVDTSAVPQERSNLAREIRKSNVILLVYSDHYSYERVALFWLPYFRSLGVNVPVVLCANKSDLAADHTETQVIEDEMLPLMSEFKEIDSCIRTSAREHRNVNEAFFLCQKAVTHPIAPLFDAKESALKPAAVAALQRIFYLSDKDRDGYLSDKEIKDFQMRCFEKPLSEEDLVHIKETIQKTHPDSVTPSGIDCRGFIHLNKMYAEKGRHETVWIILRAFQYTDSLSLQESYLHPKFEVPPFASAELSPEGYRFFVNLFLLSDKDNDGGLNDAELASLFAPTPGLPPSWADGSFPSCTVRNEAGHVTLQGWLAQWSMTTFTSPKTTLEYLAYLGFESSDRSNPSTTAALKVTRPRKRRKRPGRVGRNVVLGHIVGAPGSGKSALLDAFLSRGFSTTYHPTIQPRTAVNTVELPGGKQCYLIMDELGELEPAILENQAKLLDQCDVIVYTYDSSDPDSFAYIPALRAKYPHLEELPSVYIALKADLDRTTQRAEHQPHEYTALLNMPGPPLHVSVTWSSIQEVFVHIAEAAMEPSTAFPRSEEDVEGKWMSWGIALGAVVCAGAAAVMIWRRVSGSGV

SEQ ID NO: 5553 - protein, 1041 aa, Emericella nidulans
  strain FGSC A4 / ATCC 38163 / CBS 112.46 / NRRL 194 / M139
MFASTLRKTFVFLGLATYSAAALTTTSNSTHYTISNSRFSVAVAKSNGHVVDANLDGQDLLGPLSGNSGKGPYLDCSCTPEGFWTPGAEPALVNGTDSTGTPYVGVIMTDTYETTNQTLSQYLFLRGEETGLHAFSRVTYYNESDYFLRGLGELRTLFRPNTNLWTHFSGSEGNYGPMPLSSTEKITVQDATTYLGDTTDDPYVSQYSDYFTKYTLTESWRDHDVHGHFSNGSTSGDGNTYGAWLVHNTRETYYGGPLHADLVVDGIVYNYIVSGHYGAPNPNLTHGFDRTFGPQYYHFNSGGPGTTLEELRADAAQYASPEWNAEFYDSIAKHIPNYVPSTGRTTFRGKVNLPKGAKKPIIVLSENEQDFQLNVFKKDSLQYWAEIDGSGAFTIPRVVKGTYRVTIYADEIFGWFIKDNVKVIGSNAHTFTWKEETAGKEIWRIGVPDKSSGEFLHGYAPDTSKPLQPEQYRIYWGKYDYPSDFPEGVNYHVGKSDPAKDLNYIHWSFFPSQGNHLRNEPYYQNVNNWTITFDLTASQLRNTKTATFTVQLAGTRNANGNSKWNPDPAKYNNLPWTVNVNGIYEDTWEIPYWRSGSCGVRSGVQCQNTEHKFVFDAGKLRKGRNEFVLSLPFNATSVETALLPNSLYVQVVSMEAVSVSNDMRVLVQAFMPLVTWGTAVEKRVLLTGIVSVSAMAKEDYPMISRPCPRKGGTRRRKKERKKEGKKQGRTVLDALLQRSEQDSFWSRFCRSPIESVAQYVYGQGSTALRKKTTDNLVRVVCVSDTHNTKPNLPDGDILIHAGDLTESGTKEELEKQIYWLDSQPHRYKIVIAGNHETFLDRNYHSHHGNERVTMDWKSLIYLENTSAILDLGAGHQLKVFGSPYTPKHGNGAFQYPRTDTTTWEEIPKDTDLLVTHGPPKAHLDLGHLGCRVLRQALWEMESRPLLHVFGHIHGGYGKEVVCWDLCQRAYEAIMDGESRWWNLCVLFYCWILRLFFDWTADGRATVLVNAATVGGVRDLKRREAICVDIQAGSKRFLSGCT

SEQ ID NO: 5554 - protein, 863 aa, Emericella nidulans
  strain FGSC A4 / ATCC 38163 / CBS 112.46 / NRRL 194 / M139
MKLGWLEAAALTAASVASAQVKQDDLPVSPPYYPSPWSNGEGEWAEAYNRAVQIVSQMTLDEKVNLTTGTGMSEKCVGQTGSVPRLGINSICLQDGPLGIRFTDYNSAFPAGVNVAATWDRQLAYIRGHAMGQEFSDKGIDVQLGPAAGPLGRFPDGGRNWEGFSPDPVLSGVLFAETIKGIQDAGVIATAKHYLLNEQEHFRQVPEANGYGYNITETLSENVDDKTLHELYLWPFADAVRAGVGAIMCSYQHLNNTQACQNSHLLNKLLKAELGFQGFVMSDWSATHSGVGSALAGMDMTMPGDIAFNDGLSYYGPNLTISVLNGTVPQWRVDDMAVRVMAAFYKVGRDRLATPPNFSSWTRAEKGYEHASIDGGAYGTVNEFVDVQQDHASLIRRVGADSIVLLKNEGSLPLTGKERNVAILGEDAGSNPYGANGCDDRGCAQGTLAMGWGSGTANFPYLVTPEQAIQQEVLKGRGNVFAVTDNWALDKVNKTASESTVSLVFVNAGAGEGFISVDGNEGDRKNLTLWKNGENLIKAAASNCNNTIVVIHSVGAVLVDQFYEHPNVTAILWAGLPGQESGNSLVDVLYGRVNPNGKSPFTWGKTREAYGAPLLTEANNGNGAPQTDHTEGVFIDYRHFDRTNQTPIYEFGHGLSYTTFKYSNLTVQKLNAPAYSPASGQTKAAPTFGTIGEAEDYVFPDSITRVREFIYPWINSTDLKESSGDPNYGWDDEDYIPEGAKDGSPQDVLPSGGGAGGNPRLYDDLFRITAIIKNTGPVAGTEVPQLYVSLGGPNEPKVVLRGFDKLVIQPGEERVFTTTLTRRDLSNWDMEKDDWVITSYPKKVFVGSSSRKLPLRASLPAVQ

SEQ ID NO: 5555 - protein, 405 aa, Emericella nidulans
  strain FGSC A4 / ATCC 38163 / CBS 112.46 / NRRL 194 / M139
MFPRISQAAILAHSLLAVCTSAATLAEKVRGVNLGGWLVLEPWITPSLFDEAGDEAVDEYTLTEVLGVEEAAARLSEHWNTFITEEDFALIAEAGLNYVRIPIGYWAAAPLDGEPYVSGQLEHLDNAVAWARAHNLKVIVDLHGAPGSQNGFDNSGRRGPIGWQQGDTVEQTILAFETLAQRYLADDDTVTMIEALNEPHVPGGINQDQLKDYYEETLARVRKNSPEATLLLHDGFVQTEGWNGFMTGENVMMDTHHYEVFEGGQNAWSIEKHIDAACQLGRQHLQAADKPVIVGEWTGALSDCTRYLNGKGIGIRYDGTLGSNTAVGACGSKSEGSVAGLSADEIANTRRFIEAQLDAFELRNGWVFWTWKTEGAPGWDMQDLLANGVFPQPLTDREFPNQCNF

SEQ ID NO: 5556 - protein, 670 aa, Emericella nidulans
  strain FGSC A4 / ATCC 38163 / CBS 112.46 / NRRL 194 / M139
MHSNILPVLTSVATLLGLVQGQSQQPYRDWAKAYEAAETLVLPWTLEQQANISVRDGTAPGFVPFEPSDGVRSVQGSGKDYDNPAMRTSSNLDDRTLHELYLWPWIDGVANGLGSVMCVMNRVNGIIGCENDHIMNGILKNETGFRGFIVPDVTAPVDKAAGLLGGLGWNSGYSVSEIMAAVKNGSIPESVMTEHALRIVATQLNLLQPPEEYAFPVETADLNVRDPSSKDFIRRAGSESIVLLKNKNNTLPLRSPMSLGIFGKDAANLATGPTPQSDFSNFAGDTYDGHLITGGGSYSPAPYVVSPLDALTARAADGQGFGYKYILSDNWTVTPSESTGEGFFQTSGVSVSQYARESEHCLVFINAFGKEGSDRRTLADETGDKLVNDVADYCGSTIVIINNAGVRLVDAWIEHENVTVFTDLIPCSNQVHTNMFCFPGCPERRRSRQESGHAIVDVLFGDVNPSAKLVYTIAKSKDDYNGQICECCECDYTEGLYIDYRHFDQAGIEPRFEFGFGLCFKSDGRANIAAYTTFTHSDLTINPSTDITTLQPYATGPITEGGPSDLFEQILTISASISNTGGVAGAEVAQLYLSFPDAAKAPVRQLRGFEKVYLEPGETKFVSFPIQRRDLSIWDEQTSKWKIVGGKYGVVLGRSSRDFTVEETLELLTI

SEQ ID NO: 5557 - protein, 868 aa, Emericella nidulans
  strain FGSC A4 / ATCC 38163 / CBS 112.46 / NRRL 194 / M139
MAHRWLILALVAAAAPRALASPGPSLNERQSDDEPFSPPYYPAPNGGWVSTWAEAYEKAHSIVSNLTLAEKVNLTTGTGIFMGPCAGQTGSVPRLGIPNLCLHDSPLGVRNTDHNTAFPPGITVGATFDKSLMYERGVGLGEEARGKGVNVLLGPSVGPLGRKPRGGRNWEGFGFDPVLQGIGGAETIKGMQSTGLIACIKHFVGNEQEMHRMSSVVTQGYSSNIDDRTLHELYIWPFAEGVRAEVGSVMIAYNDVNKSSCSQNSKLINGVLKDELGFQGFVVTDWLAHYGGVSSALAGLDMDMPGDGAVPLFGNSYWGPELSRSILNGTVPVERLNDMVTRILATWYKMGQDQDYPLPNFSSNTEDEKGLLYPGAVISPIGVVNQYVNVQGNHNITARAIARDAITLLKNEGDLLPLRRNDSLKVFGTDAGPDPQGLNSCADKGCNRGVLTMGWGSGTSKLPYLITPQEAIANITPTAEFFITDSFPSSVDANDEDIAIVFINSDSGENYITVDGNPGDRKTSGLHAWHNGDELVKAAAERFSQVVVVIHTVGPIILEEWIDLDSVKAVLIAHLPGQEAGYSLTDVLFGDYSPSGHLPYTIPYQESNYPSSVGLLQQPFGQIQDYYTEGLYIDYRHFLKEDITPRYAFGHGLSYTTFEFSEPALSVVTPLDSAYPPSRPAKGPTPTYPNTIPPASEAAWPAKFNRIWRYIYPYLNNPQADAAVANSSKTYPYPDGYSTDPQPPPRAGGAEGGNPALWDVAFSVQVTVTNTGQHSGRAVAQLYVELPDSLGLDTPSRQLRQFEKTKVLETGQSETLTLEVTRKDVSVWDVEVQDWKTVVGGEGVKIHIGESVLDIRTECEVGGRCVTL

SEQ ID NO: 5558 - protein, 831 aa, Emericella nidulans
  strain FGSC A4 / ATCC 38163 / CBS 112.46 / NRRL 194 / M139
MTRTFDIDYVLANISDQDKIALLSGIDFWHTHPIPQFNVPSVRVTDGPNGIRGTKFFAGVPAACLPCGTALGATWDRDLLRRAGELLGDECIAKGAHCWLGPTVNMQRSPLGGRGFESFSEDPYLAGVAAASMIVGCESKGIIATVKHFVGNDQEHERRAVDVIVTPRALREIYLRPFQIVARDARPGALMTSYNKVNGKHVVEDPKMYDLIRKDWGWDPLVMSDWYGTYTTIDSTNAGLDLEMPGVSRYRGKYIESAMQARLIKSSTLDARARKVLEFVQRASRTKVSEVEKGRNHPEDRALMRTLCSNSIVLLKNEENILPLPKNVKKIALIGSHIKTPAISGGGSAALKPYYASTLYDAVREALPNAEVLYETGAHAHNMLPVIDRLLSNAVIHFYNEPMTQPNRKCLGTEPVTTTAFQFMDYKLAGLNRALFWSTLIGDFTPDQSGIWDFGLSVFGTANLYINDELIIDNTTKQTKGTSFFGKGTREEIGSMKLTAGQTYKIRIEFGSANTTTMKTTGMVNFGGGAANLGASLRLDAEEMINRAVKAAEDADYAIICTGLNQDWESEGFDRPHMDLPPVGIDKMISGVLDIAAHKTVIVNQSGTPVTMPWASRAKSIVHSWYGGNETGHGIADILFGDVNPSGKLSLSWPIDVRHNPAYLNYASVGGRVLYGEDIYVGYRFYEKTGREVLFPFGHGLSYTTFAVSPEALVSPGTFTPENPSNATVKIKNIGGAAGAQVLQLYVAAPNSPTPRPQKELQGFEKVFLRPGEEKTVIIRLDKYATSFWDEIEGMWKSEAGVYEVLIGTSSEDIVARGQFEVNQTRYWSGL

SEQ ID NO: 5559 - protein, 409 aa, Emericella nidulans
  strain FGSC A4 / ATCC 38163 / CBS 112.46 / NRRL 194 / M139
MKFILPLFTSLPVALAWLPGIDKDIYSAAGTNIFNVTSASSKRWLPASKKIRGVNLGSHFVIEPWMASMAWSNMGCSGQRSEFDCVMALGQETADQAFADHWGSWITQDDINQMVQYGLNTIRIPVGYWLKEDLVYADSEHFPKGGIGYLEDVCGWASDAGMYIIIDLHGAPGAQQPKQPFTGQYAPNPGFYQDYQYDRALEFLEWMTTSIHQNNKFRNVGMLEIVNEPVQNADQASSMINSYYPSAFTRIRNTESSLGITSNNYLHIQMMNEKWGSGDPTQSLTDNYFAAYDDHRYVKWDSSVAVDKESYISASCVDDRGGNWPTIVGEWSLSVPDNVEHTADWEPSSNTDFYARWFAAQAIAYEKQEGWVFWSWKAQLGDYRWSYKDAVDAGVIPKDLDSIYDYSPC

SEQ ID NO: 5560 - protein, 430 aa, Emericella nidulans
  strain FGSC A4 / ATCC 38163 / CBS 112.46 / NRRL 194 / M139
MALLLSLSLLATTISAQQIGTPEIRPRLTTYHCTSANGCTEQNTSVVLDAATHPIHDASNPSVSCTTSNGLNPALCPDKQTCADNCVIDGITDYAAHGVETHGSRLTLTQYRNVNGALSSVSPRVYLVDESDPDEQEYRALSLLAQEFTFTVNVSALPCGMNGALYLSEMSPSGGRSALNPAGASYGTGYCDAQCYVNPWINGEGNINGYGACCNEMDIWEANSRSTGFTPHACLYEPEETEGRGVYECASEDECDSAGENDGICDKWGCGFNPYALGNTEYYGRGQGFEVDTKEPFTVVTQFLTDDGTSTGALTEIRRLYIQNGQVIENAVVSSGADSLTDSLCASTASWFDSYGGMEGMGRALGRGMVLAMSIWNDAGGYMQWLDGGDAGPCNATEGAPEFIEEHTPWTRVVFEDLKWGDIGSTFQAS

SEQ ID NO: 5561 - protein, 360 aa, Emericella nidulans
  strain FGSC A4 / ATCC 38163 / CBS 112.46 / NRRL 194 / M139
MKFIAPAALLAVLQAASASPVDIRTSTTGLQVTLSQVDNTRIKAVVQNTGSQEVTFMHLNFFKDASPVKKVSLFRDSMLHPILSSCNDEVKFEGIKYRVQSSNLSDKVLTSLAPGASFEDEFDIATTADLSSGGPITIRSQGTVPLVKDRSIKGRIPYTSNELTIEVDGAEASKIGTVGSKVKRTELSGCSGDRGAALETALQNAVSLANKAASAASEGGEAFTTFFKDDSSSTRETVAARLKAVAEEAGSTSGGSTTYYCTDTLGYCEQNVLAYTLPSQDLIANCDIYYSELPALADTCYDQDQATTTLHEFTHAPGVYSPGTDDLGYGYDAATALDTDDALNNADSYALYANAINLGC

SEQ ID NO: 5562 - protein, 325 aa, Emericella nidulans
  strain FGSC A4 / ATCC 38163 / CBS 112.46 / NRRL 194 / M139
MRVQSYLSLFSLVGAALCAPREHFKRTARTSAPAGCLTVGGSGTYSTIGAAFAALGSSSSEACIYISAGTYKEQLTFQYAGPLTLYGETTDTSSYKKNTVTITHTISSPEAGSLVASATVNAAMDNFTMYNINVVNGYGKGAQAVALAASGERQGYYGCQFLGYQDTLYARVGVQYYSNCYIEGAVDYIFGDASAWFGECDIVSNGAGYITAMSRETASDPAWYCFDHCNIYGKSGLDLTGDVYLGRPWRVLARVIYQNSELSDIINAAGWTTMAEGATPLYYEIGNTGDGADTSKRLYLSEISAAVTKATVLGSDWTDWLDWSY

SEQ ID NO: 5563 - protein, 399 aa, Emericella nidulans
  strain FGSC A4 / ATCC 38163 / CBS 112.46 / NRRL 194 / M139
MTFGKAAFLSFSLFGASWAGPSRTLQARAVCTPKAGGSSSIDDVPAIVKSISACGDGGTIVFPEDSTYYLNSVLDLAGCSGCELQVEGLLKFASDTDYWNGRTAMINVKNIDGLTIRSLTGSGVIDGNGQNAYDRFAEDSSYDRPTPLYITGGGDIKVSNFRLKNAPNVFVSVKGGTTNAVFSDMRLDATSKSENLPKNTDGFDIGESTYVTISGTTVSNNDDCVAFKPGCNYLTVTDITCTGSHGLSVGSLGKSSDDIVQNVRVEGATMISSTKAAGIKTYPSGGDHGLSTVTNVTWKDITIQNCDYAIQIQSCYGEDEEYCETNPGDAVFSGIAFEGFSGTTSSKYDPVTGNLNCGEDGKCDVSVVDYSVKAPSGGAAENLTVTTYKNRCLCQARSV

SEQ ID NO: 5564 - protein, 843 aa, Emericella nidulans
  strain FGSC A4 / ATCC 38163 / CBS 112.46 / NRRL 194 / M139
MGAFTQHVLSEGWSFKDSGDQSPDAWLSVPTVPSVVHQDLQANGKLDDPFIGLNELSARWVNEKSWTYRNVFQKPTVPAGSSIFLVFDGLDTFAKVKLDGQVILESDNMFLAHRVDITKALDVEGEHTLEIDFDCALLRARELRKQHPDHKWVGFNGDTARLSVRKAQYHWGWDWGPVLMTAGIWKEVRLEVYSAKISDLWTEVHLAEDHSKARITAAAEVETQGTGNSYKATFTLSLQGQQIGKEVATLDGNVAKTTFDVQEPSLWWPNGYGDQTLYEISVSLEKEEEQAHQVSKKFGIRTAEVIQRPDKHGKSFFFRINGVDIFCGGACWIPADSLLTNITPDRYRKWIELMAVGHQVMIRVWGGGIYEDESFYQACDEVGVMVWQDFMFGCGNYPTWPEILESIEKEAEYNLRRLRHHPSIVIWVGNNEDYQVQEQQGLTYNYADKDPESWLKTDFPARYIYEHLLPKAVQKIIPSAYYHPGSPWGDGKITSDPTVGDMHQWNVWHGTQEKYQIFDTLGGRFNSEFGMEAFPHMSTIDHFVTNEADKYPQSHVLDFHNKADGHERRIATYLVENLRTATDLEVYIYLTQVVQAETMMFGYRGWRRQWGDERHCGGALLWQLNDCWPTISWAIVDYFLRPKPAFYAVSRVLKPLAIGVRREHHDWSVSHAQPPKTSKYELWVVSSLLKEVIGKVELRFISIKTGLAIHESIVRENVTIVPNGTTNILDGVIDHAVDEPHVLAARLWVDGELVARDVDWPQPFKYLDLSDRGLEITRISKTESEQVLELSARKPVKCLVFEERDNVRVSDSAIDIVPGDEQFVTIKGLKRSDAPLKYKFLGQ

SEQ ID NO: 5565 - protein, 383 aa, Emericella nidulans
  strain FGSC A4 / ATCC 38163 / CBS 112.46 / NRRL 194 / M139
MKFSQALLSLASLALAAALPHASTPVYTPSTTPSPTPTPSASGSFATTSGIQFVIDGEAGYFPGSNAYWIGFLKNNSDVDLVFDHMASSGLRILRVWGFNDVNTAPTDGSVYFQLHQDGKSTINTGKDGLQRLDYVVHSAEKHGIKLIINFVNYWDDYGGMNAYMRAYGGGDKADWFENEGIQAAYQAYVEAVVKRYINSTAVFAWELANEPRCTGCEPSVLHNWIEKTSAFIKGLDEKHLVCIGDGSDGSYPFQYTEGSDFAAALTIDTIDFGTFHLYPDSWGTNNDWGKLWITSHAAACAAAGKPCLFEEYGVTSNHCAIEKQWQNAALNATGIAADLYWQYGDTLSSGPSPDDGNTFYYGSEEFECLVTNHVETIERSAK

SEQ ID NO: 5566 - protein, 254 aa, Emericella nidulans
  strain FGSC A4 / ATCC 38163 / CBS 112.46 / NRRL 194 / M139
MYQPLLLLPLLLTSAFANPHDPHIHHSLEKRASFPIPSSKGSVTFSSPKTISGTFDGGMKTYGRGVKCTGQDEGGDEDAVFILKDGATLKNAIIGADQIEGVHCEGSCTIENVWWTDVCEDALSLKGSGSGTHKIIGGGARNADDKVIQHNSGGKVIIQDFTVQNFGKLYRACGNCKKQFKRTVKISGVKASSGKALVGINSNYGDTASIKGCATSVKEICVEYEGTNNNSKEPKKKSSGPSSYCKYSEPLSKC

SEQ ID NO: 5567 - protein, 387 aa, Emericella nidulans
  strain FGSC A4 / ATCC 38163 / CBS 112.46 / NRRL 194 / M139
MRLIHAVLGLLAGAAPALVAASPAAPIGNGRDQVSKAVGRHFEIDGKVQYFAGTNCWWLGNLLNDFEVELAVSQIAETGYKVVRTWGFFGVNDPSNPGQPVYYQVLNESLYEGGLGINYGSNGIRRLDTVVSLAERYDIQLVLTFMNNWNDFGGINIYSNAFGSNATTWYTDKKSQRAYREYIKFIVNRYKGSSAIFAWELGNEPRCKGCDPSVIYNWAKSVSAYIKKLDKKHMVALGDEGWLCPPEGDGTYAYDCSEGVDFVKNLEIETLDYGTFHLYPESWGYNYSWGSEWVLQHDAIGKRFNKPVVFEEYGTPLNHTQLERPWQLTTVKETQVAADFIWQFGTVLPVEGTEWGDVNSIYYGTEEYEVLAVQHAWEMARKKVPRH

SEQ ID NO: 5568 - protein, 686 aa, Emericella nidulans
  strain FGSC A4 / ATCC 38163 / CBS 112.46 / NRRL 194 / M139
MKVAVALTLVAGVLSAPTPTFWGPGWGDGSASAEGSAGLSGSAGLSGSAGIGGSAGLGGSAGLGGSAGASGSASGSADASASGSADAEGSGDAEGSAGLGGSAGLGGHAGLGGSAGIGGSGSATGEAGASASGAAGLGGHAGLGGSAGIGGSGSATGEADASASGSAGLGGHAGLGGSAGIGGSAGIGGSGSAGLGGSAGVGGSGSASASAGLGGHAGLGGSAGLGGSAGIGGSGSATGEAGASASGAAGLGGSAGGSAGLGGSGSGSAGIGGSAGGSAGLSGSASGSAGGSASGSAEGSAGLGGSGSAEGFTSGSASGSASGSASGSASGSASGSASGSASGSASGSGSLGGSGSFDGLFPSATPIWSTSFSTSFSTAGIPTPTGASPVAGEDCGCEEQEAVPTDVSPFANGGSKSELIPTGLGGFDLSSLGSLFGSGDASASATPSATATGSTTGSGSALGGFNWGSLFGSSSDSDSSSSSSSSSSGLGSFGSLLGKLPRALGKSRSGSSTSNDVTDNSGCKELTFIFARGTTEIGNMGTVVGPKVGEALKSLTGNKAAIQGVDYPADAAGNAALGGSGGPKMASLVETALKQCPDTKIVLGGYSQGAMVVHNAASKLSSGQVVGAVTFGDPFKSQKPDNIDQFKTFCASGDPVCLNGANVMAHLSYGNDAQTAAQFLVSAAGL

SEQ ID NO: 5569 - protein, 737 aa, Emericella nidulans
  strain FGSC A4 / ATCC 38163 / CBS 112.46 / NRRL 194 / M139
MRSLIRSGALNAFLAASLATGQVLTWDEAYTKATSDLSLLSQEEKVGIVTGVTWQGGPCVGNTYEPTSIPYPSLCLQDGPLSVRFANPVTVFPAGINAGATWDRELIRARGVAMGAESRGLGVHVQLGPVAGALGKIPSAGRNWEGFSNDPYLAGIAMAEAIQGMQSSGVQACAKHYLLNEQEYNRDTISSNADDRTIHELYLWPFYDAVKANVASVMCSYNKINGTWACEHDALLNGLLKGELGFKGHVLSDWNAQHSTVQSANTGLDMTMPGSDFSTPPGSIYWGDNLAAAIADGSVPQERLDDMVTRILAAWYLVGQDQGHPPVAFSSWDGGAASVNVTTPEHGELARTIARDSIVLLKNTNGSLPLAKPASLAVIGSDAIVNPDGANACADRGCNKGTLAQGWGSGTAEFPYLVAPLDAIEEKLAGAGTAIITSTTDDATSGAEAAAAAETAIVFITSDSGEGYITVEGHEGDRNNLDPWHNGNLLVQAVARTNTPTIVVLHSVGPVTLETILAEPNVVAVVWAGLPGQESGHALTDVLFGDYAPSGKLPFTIGKSEEDYGADWTTSQVDDFAEGLFIDYRHFDQYGIEPRYEFGFGLSYTSFNYSTLSTSISTTPGPTTGETIVGGPSDLFAPIGTVSAYVANTGHVAGAEVVQLYIGYPDSAPSIPPKQLRGFDKLHLVPGESGIATFELTRRDISYWDVGLQKWVVASGTFEVFVGASSRDIRLTGSFTV

SEQ ID NO: 5570 - protein, 327 aa, Emericella nidulans [sequence omitted]

SEQ ID NO: 5571 - protein, 838 aa, Emericella nidulans
  strain FGSC A4 / ATCC 38163 / CBS 112.46 / NRRL 194 / M139
MGEISPRGGDFDIDYILENASSLEKISLLAGHDFWHTAPLPRFNVPSVRVSDGPNGVRGTKFFDGVRAACLPCGTGLAATWDQSLLFDAGVLIGQECLAKGAHCWLGPTVCIQRSPLGGRGFESFAEDPYATGKLAAAYIRGAQSTGVISTIKHFAANDQEHERISVNAVMSERALREVHLLPFQIAIADAAPGAVMTCYNKINGQHVSESKEMLDGLLRKEWGWKGLIMSDWFGTYSTAEALNAGLDLEMPGPTRLRGPLLELAISSRKVSRSTLDERARTVLEFVKRANKAEVSTVESTRDFPEDRRLNRKLAADSIVLLKNESGLLPLNLKALKSAALIGPNMKTAAFCGGGSASLQPYYSISPYQGIMNQLPPGVEIIYETGASSYVFIPELEASEVRTPEGQPGLRMRFYREPPSVKERRVVEETILQESSWQLMGFSNPQLDRLFYADIEAELIAPATGPFEFGLAVYGSGSLFIDDQLIIDNTTVQRGGNFFFGKGTREEKATVDLVKGQLYKIRVEFASGPSSKLMKPGVVNFGGGAGRLGMVQAIDPELAIARAVEAAKRADVTILGVGLTRDHESEGFDRSHMDLPPAVASLVTAVLDVAPDAILMTQSGTPFNMLPWADNVKTHLHAWFGGNELGNGIADVLFGVVNPSGKLPLSFPRRIEDTPTYLNFGSERGQVTYGEGIYVGYRYYEKVLRDVLYPFGHGLSYTSFAYSDFAVDTASATLNVRNSGDVAGAEVVQLYIAADATTSSIARPVKELKGFAKVTLQPGETCSVSIPFDRFTTAFWDQEAHVWTCEKGQYRVMVGSSSQNILLEGVLEIKETTTWSGL

SEQ ID NO: 5572 - protein, 722 aa, Emericella nidulans
  strain FGSC A4 / ATCC 38163 / CBS 112.46 / NRRL 194 / M139
MGALRWLSLAAAASSALALTPEQLISAPRRSEAIPNPSGNIAVFSSSQYSFDTHESSSAWNLLDLRSGKITPLTNDSNVSEIVWLNDSTLLYINGTNAQIPGGSELWVSGLSNFPSGYKAASLPASFSGLKAVTTKSGDIKFVAYAQSYRNGTAYNEELAETYLSSARIYDSIYVRHWDTYLTTTFNAVFSGTLKKTQHARYASAGSLKNLVAPIPNAESPYPPFGGSSDYDISADGKWVAYKSKAPDVPQANHTTAYIYLVPHDGSETPVPINGPGSAPEGIEGDSNNPVFSPDSKSLAYLQMKDPTYESDRRVIYIYDLASKKITPLATEWDRSPDSLKWTDKSTIVAGSEDEGSGNLFLIPVKKATGDFIPEKLTNGKYASAFYLASGNTLVVTGSTLYSSWYVDLVSLNPKRGTIKNLVSAHEIDPELSGLGPEDISDIWFAGNWTDIHAWVIYPEGFDKSKTYPLAFLIHGGPQGAWYNSWSSRWNPKVFADQGYVVVAPNPTGSTGYGDELTDAIQNNWGGAPYEDLVKAWEYVRDNLDYVDTDRGVAAGASYGGFMVNWIQGSDLGREFKALVTHDGTFVADAKISTEELWFMEREFNGTFWDVRDNYRRFDPSAPERILRFATPHLIIHNDLDYRLPVAEGLSLFNVLQERGVPSRFLNFPDENHWVTSPENSLVWHQQVLGWLNKYSGIAEDNEDAVTLEDTVVPVVNINPPA

SEQ ID NO: 5573 - protein, 379 aa, Emericella nidulans
  strain FGSC A4 / ATCC 38163 / CBS 112.46 / NRRL 194 / M139
MRLHAPILSLLAAAASTSAAGVTGSAEGFAKGVTGGGSATPVYPSTTAELVSYLGDSSARVIVLTKTFDFTGTEGTTTETGCAPWGTASACQVAINKNDWCTNYQPNAPSVSVTYDNAGVLGITVKSNKSLVGEGSSGVIKGKGLRIVSGASNVIIQNIAITDLNPKYVWGGDAITLDNADMVWIDHVTTARIGRQHLVLGTSASNRVTVSNSYFNGVTSYSATCDGYHYWGIYLTGSNDMVTLKGNYIYHMSGRSPKVGGNTLLHAVNNYWYDSSGHAFEIDSGGYVLAEGNVFQNIPTVIEGTVGGQLFTSPDSSTNAICSTYLGHTCQVNGFGSSGTFKQADTAFLVNFQGKNIASASAYTVAQSSVPSNAGQGKL

SEQ ID NO: 5574 - protein, 264 aa, Emericella nidulans
  strain FGSC A4 / ATCC 38163 / CBS 112.46 / NRRL 194 / M139
MFFKQLAVLSFATSALAAHGVRNPGTNSLNFNRIDKRFTFPIPESQGSQTFEATYTISGNETFDGGMKTYGRGVDCSGQAEGGDSDAVFIVKDGGTLKNAIIGADQIEGVHCEGSCTIENVWWEAVCEDALSLKTGDGPFTVIGGGAQNADDKVIQHNGGGTVSISGFTAYNFGKLYRSCGNCDEMYERHVTLESVTAVSGSASLVGINSNYGDTATIKSDTCVTDVDTVCTEYEGTDNNDEEPQEISTGPSNACQYTDPLPSC

SEQ ID NO: 5575 - protein, 565 aa, Emericella nidulans
  strain FGSC A4 / ATCC 38163 / CBS 112.46 / NRRL 194 / M139
MPLSAAIKSSLSVSVRADAKGLVGFANTGYNGITVLKQTYWTSFYMKGEYSGTVLLRLTGTDSGTVYGSRNLSVKSTGGKWTQYETTFEANESYVAENEWQLLFDAATAKGHPLHFGLVQLFPPTYKNRTNGLRNDIARPIADLKPKFLRFPGGNNIQADRPGDWHYPNTDALGLDEYLWWCEDMDMVPVLSVWDGKSYGGIVSGEELQPYLDDIKDELEVTLPLTLLSHPLRAYLTPNTNEQYLLGPPSTPFGALRARNGHPDPWPIQYIEIGNEDDYSGGCDTYPDRLVQIYDTIHASYPNLTLIANNMDENCLPEIPLPGLWHDYHYYRSADDLVAMFNYWDNHDRGDRVLVGEYGCRNDSNPDGVFWSFMQGSCAEAVHMIGLERNSDVVMMAAYAPLLQHFGYTQWSVCTPSASLAYLGIHPADRGEEQPTLFGFESRPNSLTLSTSYYVNRMFSTNQGSTVHKVHSTAGFGPLYWVATSNETAYQVKLANYGAANQTVNIRVPGVGRGVLEMISGPKDASNLPGDIKIVPVSRNIRAGKEGYTVHMPPWGVAVLVVVFK

SEQ ID NO: 5576 - protein, 322 aa, Emericella nidulans
  strain FGSC A4 / ATCC 38163 / CBS 112.46 / NRRL 194 / M139
MYLPTLAASASLLVGVAHGYASPGACSGACNIHDPALIRRESDGKYFRFSTGNKISYASASSIEGPWTAIGSVLPGGSSIDLDGNDDLWAPDVQLVNGVYYVLYSVSTFGSQNSAIGLATSDTMDLNTWTDHGSTGIRSDSSKPYNAIDGNLFQDDSGTWYMNFGSFWNDIYQAQMKSPPTAVASSSYQIAYQPAGEHAVEGAYLYKYGNYYYLFFSEGKCCGYDSSRPATGEEYKIKVCRSTTATGNFVDANGVSCTSGGGTIVLESHDNVYGPGGQGVFTDPTLGPVLYYHYVDTTIGYADSQKLFGWNVLDFSSGWPVV

SEQ ID NO: 5577 - protein, 803 aa, Emericella nidulans
  strain FGSC A4 / ATCC 38163 / CBS 112.46 / NRRL 194 / M139
MRSLISVAVLSALPTAFSQANTSYTDYNVEANPDLFPLCLQHLNASFPDCASGPLSLTPVCDRSLSPKDRATALVSLFTFDELVNNTGNTGLGVSRLGLPNYQVWGEALHGVGRANFVESGNFSWATSFPMPITMMAALNKTLIHQIGTIVSTQLRAFSNAGLGGVDVYSPNINTFRHPVWGRGQETPGEDAFLTSVYGYEYITALQGGVDPETLKIIATAKHYAGYDIESWNNHSRLGNDMQITQQELSEYYTPPFIVASRDAKVRSVMCSYNAVNGVPSCANKFFLQTLLRDTFEFSEDGYVSGDCGAVYNVWNPHGYASNEAAASADSILAGTDIDCGTSYQWHSEDAFEDSLVSRSDIERGVIRLYSNLVQAGYFDGEDAPYRDITWDDVLSTDAWNIAYEAAVEGIVLLKNDETLPLSKDIKSVAVIGPWANVTEELQGNYFGPAPYLISPLTGFRDSGLDVHYALGTNLTSHSTSGFEEALTAAKQADAIIFAGGIDNTIEAEAMDRENITWPGNQLDLISKLSELGKPLVVLQMGGGQVDSSSLKDNDNVNALIWGGYPGQSGGHALADIITGKRAPAGRLVTTQYPAEYAEVFPAIDMNLRPNETSGNPGQTYMWYTGTPVYEFGHGLFYTTFEESTETTDAGSFNIQTVLTTPHSGYEHAQQKTLLNFTATVKNTGERESDYTALVYVNTTAGPAPYPKKWVVGFDRLGGLEPGDSQTLTVPVTVESVARTDEQGNRVLYPGSYELALNNERSVVVKFELKGEEAVILSWPEDTTSDFVSSIDGGLDRKQDVIA

SEQ ID NO: 5578 - protein, 379 aa, Emericella nidulans
  strain FGSC A4 / ATCC 38163 / CBS 112.46 / NRRL 194 / M139
MKTTFLVSLATAALSSTAAAVSVSGSAEGFAKGVTGGGSATAVYPDTIDELVSYLGDDEARVIVLSKTFDFTDSEGTTTETGCAPWGTDAACQVAINQNDWCTNYQPDAPSVSVTYDNAGTLGITVNSDKTLIGEGSAGVIKGKGLRLVSGTSNVIIQNIAITDINPKYVWGGDAITLNDVDMVWIDHVTTARIARQHIVLGTEADNRVTISNSFINGESDYSATCDGYHYWGIYLDGSSDMVTMKGNYIYHTSGRSPKVQGNTLLHAVNNYWHDNSDHAFEIGEGAYVLAEGNVFQNIPTVAEDPIEGELFASPSESANEVCSTYLGRVCELNGFGSSGTFNQADTDFLSKFEGKNIASADSYSSVASSVASSAGNTL

SEQ ID NO: 5579 - protein, 839 aa, Emericella nidulans
  strain FGSC A4 / ATCC 38163 / CBS 112.46 / NRRL 194 / M139
MPQLDVDKTIEELRLGEKIDLVSGIDFWHTASVPRLNIPSLRMSDGPNGVRGTRFFNGVPAACFPCATALGATWDTELLHKVGHLMGEEAIAKGAHVILGPTINTQRSPLGGRGFESFAEDGVLAGHLAGYCSKGIQEKGVAACLKHFVCNDQEHERLAVDSIVTDRATREIYLLPFQIAMRICKTATVMTAYNKINGTHVSENKKYITDILRKEWGWDGLVMSDWFGTYSCTSESIIAGLDIEMPGKTRWRGDALAHAVSSNKVHEFVLDERVRNVLNLVNYVEPLGIPENAEEKVLNRPEDQALLRRAAAESIVLLKNEDNILPFNKEKSIAVIGPNAKIAAYCGGGSASLDAYYTITPFEGVSAQSKGEVHFAQGSYSYKDLPLIGHLLKTDDGKTGFKFRVYDEPASSSNRELLHELHLVSSQGFLMDYRHPKIKSYLYYVDMEGYFTPEESGVYDFGVVVVGTGKLLVDDEVVVDNTKNQRLGSAFFGNGTVEEKGSKELMAGQKYKITFQFGTAPTSDIDTRGVVIFGPGGFRFGAARRQTQEELISKAVEVASKADQVVVFAGLTSEWETEGYDRPDMDLPPGSDELISKILEVKPNAAIVIQSGTPVTMPWAPKAKALLQAWFGGNECGNGIADVLYGNVNPSGKLPLTFPVRLQDNPSYLNFRSERGRVLYGEDIYVGYRYYEKAQLPPLFPFGHGLSYTTFTREKLELNTSPEKDKLQDGEPITARVTVTNTGKVAGAETVQLWVVPPPTEVNRPVRELKGFAKVHLEPGESKDVEIVVEKKLATSWWDEKREAWASEKGVYWVQVTGTGEGVLTAEFEVKKTRFWTGL

SEQ ID NO: 5580 - protein, 1084 aa, Emericella nidulans
  strain FGSC A4 / ATCC 38163 / CBS 112.46 / NRRL 194 / M139
MYLFRILAILTAFTCASAGRLPSRTCVVPASGTNETDDAPAIISAFERCGRGGKVVFKPTTYYVNSVMNISWLQDVDIDLRGNLLWSTDIQYWLNNSLEVGYQNQSTAWILGGDNVRIDGHGIGTLDGNGDYWYEWISQQENTSNYPGRPIALTLSELTNSVVKGVNFLRSQMWTLAIIYSHHVEFDSILVNNTGNRVDSSNTDGADTIRSSHISFNNLTVYNGDDSISFKANSTDITLTNSHFYNGLGVAIGSIGQLKDQFETVERVKVENIVYENTLHAVYFKTWTDDQNGYPPNGGGGGLGYASNMLFKDLDTTSLRGSAVAISQCTRFSGAPGEGNCTNSQFQIRDITVANLHGTTKSERVTSFQCSAVAPCTNIGVFGVDLEFANGTKAEEYLCGNVKNPRGFPWATYTQKDPSNNSSMISLPLLALATGAVASASCWRNTSCTGPSKPSFPGPWDSNNFAPGSRLIQPKSILSLPDGTYISDYTSDSHPSITTEDAGLVFDFGLEVGGIVTIDYSSSVPNTTLGLAFTEAKDYIGRTSDNSNGGTGADGALATLLTEGEGSYTMPDSQLRGGFRYLALFIPSSSSSNASLTIQSITLELAFQPTWSNLRAYQGYFHSSDPVLNKAWYAGAYTLQTNSVPRTTCRVSVSSATGWNNNAVCGPGETLLLDGAKRDRWVWIGDMGVAVPSASVSTGDTESTKNALLAIWDNQTPSGLLPKAGPPYLRADSDTYHLWTIIGTYNYFLFTEDYDFLAGIWQKYVKALDYSLAKITPLGIMNATQTADWGRWNYGTLASSANMLLYRSLTTAAFLAPYAGDNPENYTDLASTLRSAIVTHLYDSAVGAFRDSPNSTLYPQDANSMALAFSFFSQSPLNCSSSFNLAEAARVSSYLESNWTPIGPEVPELPNNISPFISSIELEGHFASGHADRAIELIRMLWGWYLAHPNGTQSTVPEGYLVDGSWGYRGDRGYRNDPRYVSHAHGWSSGPTSTLTEYAVGLKITKPKGSEWSLRPASFGIQGFEEAQAGFTTGLGKFKAAFRVQGKRATVTWDTPAGTKGWVQLPGEEGSWVEGGMGSLTVKL

SEQ ID NO: 5581 - protein, 135 aa, Emericella nidulans
  strain FGSC A4 / ATCC 38163 / CBS 112.46 / NRRL 194 / M139
MRIFTRLLYAAPSNMGSAASLSEALALLPPIPLYRRILRVHRKKLDPEMRILGDSYVKSEFRAHRGTENPLHIIGFLTEWQLYAQKLEGDSWIGEKLDQGKLDKMSDQQLGQLYELMQTIQNKDGKGEGEGESEK

SEQ ID NO: 5582 - protein, 561 aa, Emericella nidulans
  strain FGSC A4 / ATCC 38163 / CBS 112.46 / NRRL 194 / M139
MAFNFNWSPLTADANFYTRAQDLLTAALNKSPKPPIIVDDIIVTELNLGSIPPELEILEVGDLAEDRFRGIFKMSYSGDAFLTLKTRVQANPLNTYLLTRPSFASPLPLAAATPLTIPLQITLSDFKLSGFVVLVFSKQKGITVVFRNDPLESLKVSSTFDSIPFVRDFLQKEIEAQLRILFMDELPAIIHRLSLRLWVPEYRDGEQLETQDTASRTEGPGQDPLASPPQDPVDALGNALNESDIASLSLESSVETHSLFSQKNLLRLAALTDSQRTLSLFTPSIREVVYRAWTSPTDSGEATAGVISPASPALSRTHSQVGNISSFPDTASMVSSQTRSTTSTHSFSSYGLNTGSSRSKVHSRKRKKRVVDLRRPKTTDDAASVSDESAFTESTSAPSVYSAPLPIVREQPDDPVTPPLSPETGLHLPPVPERHRLSTSRPGIRRGADAFVQSGESSSSARRRSDVDVDATPRGTMRSHVAMTRCSEKPEPEAPQQLPSTILPFADEKASSNLVDQALVERLAGEIARRMRDEKMPGSSTCTPFWDRLNHDEAPPPAYGH

SEQ ID NO: 5583 - protein, 618 aa, Emericella nidulans
  strain FGSC A4 / ATCC 38163 / CBS 112.46 / NRRL 194 / M139
MRVDSTVLALVALATDCLGLAIKSNEPELLRRDALPIYKNASYCVDERVRDLLSRMTLEEKAGQLFHKQLSEGPLDDDSSGNSTETMIGKKHMTHFNLASDITNATQTAEFINLIQKRALQTRLGIPITISTDPRHSFTENVGTGFQAGVFSQWPESLGLAALRDPQLVREFAEVAREEYLAVGIRAALHPQVDLSTEPRWARISGTWGENSTLTSELIVEYIKGFQGEGKLGPKSVKTVTKHFPGGGPMENGEDSHFYYGKNQTYPGNNIDEHLIPFKAALAAGATEIMPYYSRPIGTNWEAVGFSFNKEIVTDLLRGELGFDGIVLTDWGLITDTYIGNQYMPARAWGVEYLSELQRAARILDAGCDQFGGEERPELIVQLVREGTISEDRIDVSVARLLKEKFLLGLFDNPFVNASAANNIVGNEHFVNLGRDAQRRSYTLLTNNQTILPLAKPGEGTRFYIEGFDSAFMSARNYTVVNTTEEADFALLRYNAPYEPRNGTFEANFHAGSLAFNATEKARQAKIYSSLPTIVDIILDRPAVIPEVVEQAQAVLASYGSDSEAFLDVVFGVSKPEGKLPFDLPRSMDAVEAQAEDLPFDTENPVFRYGHGLEYEDN

SEQ ID NO: 5584 - protein, 527 aa, Emericella nidulans
  strain FGSC A4 / ATCC 38163 / CBS 112.46 / NRRL 194 / M139
MALLRHLLPVLTVGSAVQSAVLVQDQFQTRCENFAGKIDLPNVKVNFASYIPGSTNLTLDNVPTCDQSQVVSSDICRVAMAVTTSNASEITLEAWFPRDYTGRFLSTGNGGLGGCIQYSDLDYASRLGFATVGANNGHNGTSGEPFYKAPEVLEDFVYRSVHTGIVVGKQLTKLFYDEGFDTSYYLGCSTGGRQGFKLAQDFPGEVDGIIAGAPAINFVGLLSWSAHFYPITGPVGSATYLSLDDWDLVHEEILRQCDGLDGAEDGIIEDPDLCHPNATTLLCSPGATSGSCLTATQVNTVHEVYAPLLSSNSTLIYPRMQPGGEQFAAPAMYNGQPFQYSKDWWRYVVYSDPTWNATKWTIRDAEAALRQNPYNIQTWNADLSPLRDSGSKLLTYHGLQDQLISSDDSKLYYHRLMKTMGVTSNQLDEFYRFFQISGMAHCQDGDGAYGIGNRAETEFSTEPEDNVLMAMVRWVEEGIAPETVRGAKFSDGVGSEVEYYRKHCRYPRRNVYKGPGDYTDETAWECV

SEQ ID NO: 5585 - protein, 233 aa, Emericella nidulans
  strain FGSC A4 / ATCC 38163 / CBS 112.46 / NRRL 194 / M139
MANVALIGCTGMVGAHILTSLIANPAVTRIDTISRRTPQAASSAPQAKLTTIVSTDTSKWASELSSLTPIPSIFISALGTTRAAAGSFENQYKLDHDLNLEMAKAARDAGTKVYVLISSSGADVKSNFAYTRMKGEIEEGVKALGFERTVILRPGLIAGQREESRPAEAVARFFAGALGKVHSSLKDGWAQESDVIGKAAVNAGLKALNGEVPAGSEKVWYLYGSDIIQHGKE

SEQ ID NO: 5586 - protein, 940 aa, Emericella nidulans
  strain FGSC A4 / ATCC 38163 / CBS 112.46 / NRRL 194 / M139
MHFHGIATQAVLASNITTGSGRHVSLSDVKWTLSSSALNSTVPASLPSQAHLDLLNAGVIDDPYYGLNEIDLQWIAQANWTYTSDPIPDLLEEYESTWLVFEGLDTFATVTFCGHNIASTNNQFRQYAFDVSSALKECTGGPVVRIDFASAPNTVDAIAADPKTPVWPVQLTAQLPNRWLMRKQQSDFGWDWGPAFAPCGPWKPAYVVQLEKTAPIHVLNTDLDIYRQGNINHLPPDQKQPWVVNASIDFIGRLPAEPRLLIEIKELETGDVLASQISDSVTLIGTSITGVTTLKDASPKLWWPSSLGAQNLYNVTITVFNKTEEVARITKRTGFRTIFLNQRNITATQLSQGIAPGANWHFEVNGKEFYAKGSNFIPPDTFWPRVTKQKMTRLLDAVVAGNQNMLRIWSSGAYLPDFIYDLADERGILLWSEFQFSDSMYPVDEDFLDNVAQEVVYNVRRVNHHPSLALWAGGNEIESLMLPLTREADPDNYPKYLAEYEKLYISLILPLVYENTRSISYSPSSTTEGYLSVNLSAPVPMTERYENDEPGAYYGDTDYYNYDTTVSFDYSIYPVGRFANEFGFHSMPSLQTWQQVADPEDLYFNSTTVVIHNRHYTSEGYGRIENSSRGMAEMTLGVERYYPIPDNPDSVANFSAWCLATQLFQADFYKSQIQFYRRGSGMPERQLGSLYWQLEDIWQGPTWAGIEYDGRWKVLHYVARDVYQPIIVSPFWNYTTGDLEIYVTADLWESAAGTVNLKWLNLSGEQIIDNAGTPTEIPFTVGAINTTKVYSTNIHDLNLPDTRASILTLSLSSQANLPNAAVKTSLTHENHFTPSFPKDLELVNPGLELSYDAHSGIFTVEAKSGVSLYTWLDYPAGLVGYFTENAFLLVPGQKKKVQFVVQDGPKDQDWEWQSEVTVRSLWDQKSSTFLYALRVATGRP

SEQ ID NO: 5587 - protein, 357 aa, Emericella nidulans
  strain FGSC A4 / ATCC 38163 / CBS 112.46 / NRRL 194 / M139
MKFSSVLALAASAKLVASHATVFAVWINDEDQGLGNTADGYIRTPPNNSPVTDVTSTDLTCNVNGDQAAAKTLEVAAGDKITFEWHHNSRDSSDDIIADSHKGPVLVYMAPTEAGSAGKNWVKIYEDGYNDGTWAVDTLIANKGKHSVTVPDVPAGNYLFRPEIIALHEGNREGGAQLYMECVQFKVTSDGTTQLPEGVSLPGAYTATDEGILFDIYSSFDSYPIPGPAVWDGASSGSGSSGSGSSSSAAATSSAEKTATSTTAAATTTAVATSTSSATQVQPTSVATFTTSVRPTTSAAPTTSAPTSSAAPTGGTGTGSIQIYQQCGGMNYKGATGCASGLTCKQWNPYYHQCVQA

SEQ ID NO: 5588 - protein, 555 aa, Emericella nidulans
  strain FGSC A4 / ATCC 38163 / CBS 112.46 / NRRL 194 / M139
MRGAILATAAAFAGTAVADMHMRRHAHEGLHHRALHASSAVPEEECGCTTEVITYWGEPTTIPLSVPTSTVTSETTETVHSTSYSTVTVTATSSAAPVETPSETPSPTPEVTLPTAGVTSYSETGTYTIPATTITVTDTTTVCGATTTELPSGTHTYGGVTTIVETATTITCPYATVKPTGSTVTSVIETTTYVCPSAGTYTIAPTTTFVPTSTVVVYPTPETVTPGTYTNPGTTITVTRTEDVYVCPYTNGNVPTSVPALPTTSAASTTTAVPSSSTTTSSATSVPTGASGNKMGMTFTPYNNDGSCMAKNDVLEQVGLIKGKGFSHVRVYGTDCHTLEYVGAACSTHGLKMILGVNVEGSTGFDGARSQFKDITNWGQWDLVSLIVVGNEVVTSNIASAAQLASFVSEGASAFSAAGYTGQVTTAEPIDVWLSNGATLCPVVDILGANLHPFFNPEFTAAEAGTLVSNQIKDLKQVCTGKDVINLETGWPNAGSANGKAIPGQSQQTTAIKSLVEKVGDVSVFFSYADDGWKSKFATSDKYNVEQHWGCIDQF

SEQ ID NO: 5589 - protein, 810 aa, Emericella nidulans
  strain FGSC A4 / ATCC 38163 / CBS 112.46 / NRRL 194 / M139
MRAKNGPGSWLALTAIATSLNTLALAAAKTINHSYEFNPVVVSGGGYITGIIAHPTEKNLLYARTDIGGTYRWNADEDKWIPLNDFISGADENLLGTESVALDPNDPDRLYLAQGRYLNSENSAFFVSQDRGATFDVYPAPFKMGANELGRNNGERLAVNPFKTDELWMGTRDAGLMVSEDGAQTWRNVSGFPQANANGIGIYWVIFDPRSEGTVYVGVGVPGGIYVTRDSGESWEAVPGQPVEWDEDILVFPAESQPQSTGPQPMKGVLAENGALYVTYADAPGPYGVTYGGVYVYNTTSSAWTNITPKTNNSFPAPFDNQTFPAGGFCGISVDSKNPERLVVVSLDRDPGPALDSMYLSHDGGKSWKDVSQLSTPSGSGGYWGHPIEEAAFKDGTAVPWLSFNWGPQWGGYGAPSPVRGLTKFGWWMTAVVIDPSDSDHVLYGTGATIWATDNLSKVDKNQSPGWYIQAQGIEESVALALASPNGGDSHLLTGLGDINGYRYGDLDVPQPMFDLPVLSNLNALDWAGQKPEIIIRAGPCGHNYTDGCGLAAYSADGGSSWTKFATCIPGINTSSSNPGVIAIDASGKDIVWSSAMTAYWPTLQAITPRTNQSGPYVTTDLGQTWVSPTGLNVQTPNISADRVQPRTFYSFTDGTWYLSRDGGLSYRAYKAKEVGLPAYSGALPIANFNRAGEIWLGLGDHGIYHTRNFGKKWTKITGRGVTARQLTIGAGARRSSEPTLFIVGKAASHGALSKDGVYRSDDNGKTWVRVNDEKHQYGGIAMIQGDPRVYGRVYLGTGGRGIIYADIKE

SEQ ID NO: 5590 - protein, 326 aa, Emericella nidulans
  strain FGSC A4 / ATCC 38163 / CBS 112.46 / NRRL 194 / M139
MRSLVLLSSVLALVAPSKGAFTWLGTNEAGAEFGEGSYPGELGTEYIWPDLGTIGTLRNEGMNIFRVAFSMERLVPDSLAGPVADEYFQDLVETVNGITALGAYAVLDPHNYGRYYGNIITSTDDFAAFWTILATEFASNELVIFDTNNEYHTMDQSLVLNLNQAAIDAIRASGATSQYIFAEGNSWTGAWTWVDVNDNMKALTDPQDKLIYEMHQYLDSDGSGTNTACVSSTIGSERVTAATNWLRENGKLGVLGEFAGANNQVCKDAVADLLEYLEENSDVWLGALWWAAGPWWGDYMFNMEPTSGIAYQEYSEILQPYFVGSQ

SEQ ID NO: 5591 - protein, 504 aa, Emericella nidulans
  strain FGSC A4 / ATCC 38163 / CBS 112.46 / NRRL 194 / M139
MTTFTKLSEQEAPGISIHPDRRISKINPNIYAGFAEHMGRCIYGGIYDPGNPLSDENGFRKDVLEALKELKVPVIRYPGGNFTATYHWIDGVGPRDQRPARPELAWLGTETNQFGTDEFLKWCEVLGTEPYLCLNMGTGTLDEALAWVDYCNGTRDTYYANLRRKNGREEPYNVKYWALGNEVWGPWQVEQSTKEEYAHKAYQWAKALKLLDPSIELILCGKEGPTSWDYYTLKQTMLPVHSPLSTSAVPLIDMHSIHLYTAHSSHLPNVTAPLAAERAIEITSSLIDLARVENGVPPEQRRPTICFDEWNVWDPIRAEGSKGAEESYNLSDALAVGVWLNVFVRKSKDVGMACIAQSVNVISPLMTTKDGIVKQTTWWPLYLFSNYMRGWTISAHISVSAYEGETHPKWVRGVKDTPWLDVSATLGEDGYVNVVVINIHEEKGIEAKLDGPSGEVTVFTVTGDNPAVTNMKGKEEVGLVETKWDAQGPYVFPKHSLTLLRWKA

SEQ ID NO: 5592 - protein, 373 aa, Emericella nidulans
  strain FGSC A4 / ATCC 38163 / CBS 112.46 / NRRL 194 / M139
MKKYLLSLLAAVTYTTAQSVSGSAEGFASGVTGGGGATPVYPADTAELESLLSSEGEQVIVLTKTYDFTGTSATGTACYSWGTGEGCQLILQDDCGDTPSTTVTYDAAGKTPIPVASDKTLLGVGSEGVIKGKGLSFTDNVSNIIVQNIKITELNPEYVWGGDALTFDGSSNICIDHVETSLIGRVHYVFGYNPNSGITLSNNFINGETTYSTSCDGYQYWGLELVGKNDSITFKGNYLYKTSGRSPALSGSTKFHACNNVWSDNNGHAIEGNEKGQGLFEGNVFQEVATVVSSTFWEAGDLFLSSADGTGNDACASYIGRNCASSIYMNDGGDYTSYTDVSWLGDWSGLTIAECAEAREIEGTVPTSAGNTL

SEQ ID NO: 5593 - protein, 314 aa, Emericella nidulans
  strain FGSC A4 / ATCC 38163 / CBS 112.46 / NRRL 194 / M139
MKYSMILGAALCALGAMAEVEPSYVTEWTTTTVTDWTIVTITKTITVTPTSAATSTTTSVPEPTSVPATQAKVQDTAPAAAAETEAAVESVSTAAPSSTVESTSTVIAEQPEATTWSSAWSSTWSTTQAATTETAAQSTATASSTQTAANAYQSNVLYSHNVHRANHSSPDVAWSSDLESSAQVLASRCVYEHDTSINGGGYGQNIGYGTSADEVAVMISNLMYNDEMGYFENLYGQATPDMTLFEKWGHFSQIVWKGTTEVGCATVDCPSLGNVDSASSVPFTVCNYSPAGNYDGEYADNVLKPLGNPVWSAS

SEQ ID NO: 5594 - protein, 1025 aa, Emericella nidulans
  strain FGSC A4 / ATCC 38163 / CBS 112.46 / NRRL 194 / M139
MATAFWLLLFLLGSLHVLTAAQNSSQSEWPIHDNGLSKVVQWDHYSFYINGQRIFLFSGEFHYWRIPVPALWRDILEKIKAIGFTGFAFYSSWAYHAPNNQTVDFSTGARDITPIYDLAKELGMYIIVRPGPYVNAEASAGGFPLWLTTGAYGSTRNDDPRYTAAWEPYFAEVSEITSKYQVTDGHYTLCYQIENEYGQQWIGDPRDRNPNQTAIAYMELLQASARENGITVPLTGNDPNMNTKSWGSDWSDAGGNLDTVGLDSYPSCWSCDVSVCTGTNGEYVPYKVLDYYDYFQEVQPTMPFFMPEFQGGSYNPWDGPEGGCTEDTGADFANLFYRWNIGQRVSAMSLYMMFGGTNWGGIAAPVTASSYDYSAPISEDRSIGSKYYETKLLALFTRCAKDLTMTDRLGNGTQYTDNEAVIASELRNPDTNAAFYVTTHLDTTVGTDESFKLHVNTSKGALTIPRHGGTIRLNGHHSKIIVTDFNFGSETLLYSTAEVLTYAVFDRKPTLVLWVPTGESGEFAIKGAKSGSVAKCSGCSNIKFHRDSGSLTVAFTQGEGISVLQLDNGVRVVLLDRQKAYTFWAPALTDNPLVPEGESVLVSGPYLVRTARLARSTLTLRGDSKGETLEIFAPRKIKKVTWNGKAVEATRTSYGSLKAILAKPPSVELPTLNGWKYSDSLPERFPTYDDSGAAWVEIDANHMTTPNPNKPATLPVLYADEYGFHNGVRLWRGYFNSSASGVYLNIQGGAAFGWSAWLNGHFLGSHLGSASIQQANGTLDFPANTLNTEGTPNVLLVVHDDTGHDQTTGVLNPRGILEARLLSEASDNNDDDSPGFTHWRVAGTAGGESDLDPVRGVYNEDGLYAERVGWHLPGFDDSKWATVNGTSLSFTGATVRFFRTVIPPLSIPENTDVSISFVFSTPNVNNTSAGNTSAFRAQLFVNGYQYGRYNPYVGNQVVYPVPPGILDYNGENTIGVAVWAQTEAGARLNLDWRVNYVLGSSLDAGRLDLSFVAIAYVYIFECLQL

SEQ ID NO: 5595 - protein, 436 aa, Emericella nidulans
  strain FGSC A4 / ATCC 38163 / CBS 112.46 / NRRL 194 / M139
MSIEVNWGTATSGPDGEALAERIRSFIHDKFQQVPLPRFIRSVQVHSFDFGTVAPDLEIKDFCEPFADFYEDDEDGDSGSEISEELQHRTHDNPWDRTQSELNETSFRDDRPVTSHHALRDPFDEDFRQHTSSPLRSPIALGDHLNPHFLPRAGTPGIPGGTSTLGYHLMSLGGLSGTQTPLAAVAGGSPFTTNWTDPSPMGQGNKTGIRPSPLHRADADIDSSNPASRPSTASTHPSGSNRSSHPDGHPEHNDDPISSSENPLLQNQPPPRMRERRPEDFQILCHVKYAGDIRLSLTAEILLDYPMPSFVGLPLKLNVTGITFDGVAVIAYIRKRVHFCFLSPEDAEALVGSGSYSGQQETPGPSTGSSGGGNPSPHQKGLSLLQEIRVESEIGRKEDGKQVLKNVGKVERFVLAQVRRIFDEELVFPSFYTFLI

SEQ ID NO: 5596 - protein, 1007 aa, Emericella nidulans
  strain FGSC A4 / ATCC 38163 / CBS 112.46 / NRRL 194 / M139
MRLLPVWTAALLAAQAAGVALTHKLNGFTITEHPDAEKRELLQKYVTWDDKSLFINGERIMIFGAEIHPWRLPVPSLWRDILQKVKALGFNCVSFYVDWALLEGKPGEYRAEGSFAWEPFFDAASDLGIYLIARPGPYINAEASGGGFPGWLQRLNGTIRSSDQSYLDATENYVSHIGGLIAKYQITNGGPVILYQPDNEYSGGCCGQEFPNPDYFQYVIDQARRAGIVVPTISNDAWPGGHNAPGTGKGEVDIYGHDNYPLGFDCANPDVWPEGNLPTDYRDLHLEISPSTPYALVEYQVGAFDPWGGPGFEQCAALTGYEFERVFHKNTFSFGVGILSLYMTFGGTNWGNLGHPGGYTSYDYGSPIKETREITREKYSELKLLGNFIKSSPGYLLATPGKLTNTTYTNTADLTVTPLLGNGTGSFFVLRHSDYSSQASTPYKLRLPTSAGQLTIPQLGGSLVLNGRDSKVHLVDYDVAGTKILYSTAEVFTWKKFHDGKVLVLYGGPGEHHELAVSSKAKVKVVEGLGSGISSKQIRGAVVVAWDVEPARRIVQIGDLKIFLLDRNSAYNYWVPQLGTETSIPYATEKAVAASVIVKAGYLVRTAYVKGRDLHLTADFNATTPVEVIGAPKTAENLFINGKKAHHTVDKNGIWSTEVGYSPPKIVLPVLEDLKWKSIDTLPEIQPSYDDSPWPDANLPTKNTIYPLRTPTSLYASDYGFHTGYLLFRGHFTANGRESNFSIQTQGGQAFGSSVWLSGTYLGSWTGDNDYQDYNATYTLPSLKAGKEYVFTVVVDNMGLNENWIVGQDEMKKPRGILNYELSGHEASDITWKLTGNFGGEDYVDKVRGPLNEGGLYAERHGYHQPYPPTKSKDWKSSTPLTGLSKPGISFYTASFDLDIKSGWDVPIYFEFGNSTTPAPAYRVQLYVNGWQYGKYVNNIGPQTRFPVPEGILNYKGTNWVAVTLWALEGSGAKLDSFKLVHGIPVRTALDVEGVELPRYQSRKGVY

SEQ ID NO: 5597 - protein, 121 aa, Emericella nidulans
  strain FGSC A4 / ATCC 38163 / CBS 112.46 / NRRL 194 / M139
MQLTKTLSLLAASLSVLLAPVTAAPAPGTSCHVGASWPDHHDCHKFFECAAGGHPVRKTCGPGTAYSPEIGVCDYEWKVRSCRAHSWTHGAEEGASGSHSGWDKSKNEKGHEGHWSGAGRH

SEQ ID NO: 5598 - protein, 517 aa, Emericella nidulans
  strain FGSC A4 / ATCC 38163 / CBS 112.46 / NRRL 194 / M139
MTVLAPWALWEKTKDVMVLEQQYQSMCTWIAAIPENMKRHRHLCDPVVLQFAVAVRESNPWAVMTAYHKINGVHCSEDPRLIRDIPRSEWKYDGLVLCDWWGIYSTSELINAGMDLEMPGPTDWRCKILAWATRSRKVSIETIDSSVRRVLKLVNRVLAAQSEPVKDSDTEKNRALLRETTAVPVVLLKKNEANVLPLVKDSKTRYALIGDHWKNPAVAGDDSSEVTPYYVSTPYSAFVEAVGEDSFICAMGCYSHKFAPLLYSTITQPGSDAHGMLLEFFNKDPNGSSDAELLYTTTTEKTDLKFADSLPPDTVPEYTSSGSAPSRGSRWGCAGWIREAVEIARQVDIPVILTGLSADYEYEGIDRKSLGLPGRVDELIERVTEANPKTIIITEAGTATTMPWADKTPTVIHSWFGRQETGHGIVDILFGDVNPSGRLPLTFPRNLEVPPVYESDPKHIMTISVSLKNTGQCPGAEIVQVYVKDVSSSVQRPRKELKSFKKVHLAPGENMKIEVTS

SEQ ID NO: 5599 - protein, 239 aa, Emericella nidulans
  strain FGSC A4 / ATCC 38163 / CBS 112.46 / NRRL 194 / M139
MKLLALSLASLASAATITRRADFCGQWDTATAGNFIVYNNLWGQDNADSGSQCTGVDSANGNSVSWHTTWSWSGGSSSVKSYANAAYQFTATQLSSLSSIPSTWEWQYSTTDVVANVAYDLFTSSSIGGDSEYEIMIWLAALGGAGPISSTGSSIATVTLGGVTWNLYSGPNGSMQVYSFVASSTTESFSADLMDFINYLVENQGLSNSQYLTHVQAGTEPFTGSDATLTVSSYSVSVS

SEQ ID NO: 5600 - protein, 322 aa, Emericella nidulans
  strain FGSC A4 / ATCC 38163 / CBS 112.46 / NRRL 194 / M139
MFSRYAFRCAQPLRQSARQYSTEAPKSKSLAPVYVAVGLAGLGVGLYRYQSGAATAEAPAERPKVFTGGDQGWVNLKLSDIEILSHNTKRLRFEFPDKEAVSGLHIASALLTKYSPPDGSKPVIRPYTPTSDEDQPGYLELVVKRYPNGPMSEHLHNMNVDQRLDFKGPLPKYPWEANKHKHICLVAGGTGITPMYQLAREIFKNPEDKTKVTLVFGNVSEEDILLKREFEDLENTYPQRFRAFYVLDNPPEGWTGGKGYITKELLKTVLPEPKEENIKIFVCGPPGMYKAISGPKVSPKDQGELTGILKELGYSKDQVYKF

SEQ ID NO: 5601 - protein, 1206 aa, Emericella nidulans
  strain FGSC A4 / ATCC 38163 / CBS 112.46 / NRRL 194 / M139
MSKARNGPRTGTKPRRDVLASLKMASMEEISRASLPAEIMASILDHLSPIDLIRAARASKLLREMAYDDSRWVQRLKRIGCWDEAEARKNAEEKFGTIANRASVELQDSTVAQQVPSQPKIDVTPISDGFDQINLSASAANDVVDLDTDPVLGALKLARSIRGEARQEYGKIHAALAPFYDDIATLGPSPENLLFQRYTEPQQQAQILSQLQAFARCDTTTGCENRHENLRAAVSMFETAALKEFRHGYETDDIDGRMKNYAHVLYTLNGGGSASELFTHHNHIITRKAELGQTNDCIDTLTQKVKLHQTQAFFTRLSVAFNEEVSIINRAFPPALQLAQPFVEKVGRDVLYPFLTAIFDELHRSNKEEYLVSVSSTFAQCMNLCDNLLPIQNSLDTFEDLLHQTIAQVYEPHMDLYLAEELDFFRKGSEASVAEWDRQLSEQAASTESFLLSNVNRQADKRDFLTSFKKVIMAPVNILPSFSNKSSEQQKPDRDSLAGDSGSTPRANRFSTISSPGTPPIQEAPTTELAAKAAIMKSKLEGIRSLFSIEVALGLVHAAKSSLERAARFMAIGGETGAAVKQQCEAIFVALLRILGHGHLIKGFDKAVDHLSDYRPREQGDRDQSGVEPLVTFLELVNVGDLILQMIDVFYEQEMIGSNITDRNDFLDPAVKEKKKFEQNLDERVAAGLNKGIDVLMEEVDYILATRQLATDFNPDVSTDPHRKTMDVSVTEAAAAVVDVVSSHTQMLVGSTDKSTLDVFNQEVGLRLFTALCKHLKRQRISIEGSLKLISDMNHYFKFIQRLKNNELLIYFKAFRELSQIYLIDSSDAKELANFIADAGRFSGIWRVEEVYEFAERRADWYQIKRDVERAMYGIGCNKYLDAPLPKRTNITEEQESYPLKAEMREISFGQRKIHLIDPRLLPGGMHTSINRHQHRQPTHLQTILFSRVLKIIIYFLLLLLPNAISATETTVIVTVTESATATTTATTTTTPKVPQDPSYTSPRQFRSSILRTTNAYRAAHNASNLSWNETLADYAKDWAKGCKWKHSSGPYGENLAYGYKKASSAVTAWGDEAALYDFSKPTGFTEETGHFTQLVWKSTREVGCAAVDCGLTDLDDDEKERAQGWYVVCEYMPAGNVVGADDGLEYFRVNVQEGSEDSDSSSEDDSEHGDGGEGSDVSDFGNRASRGLVEWSKERVACPRRPPPN

SEQ ID NO: 5602 - protein, 440 aa, Emericella nidulans
  strain FGSC A4 / ATCC 38163 / CBS 112.46 / NRRL 194 / M139
MRLHFLPLVALCATTASSLAFDSSTSQPPGAQVYSVNDAAGLKRIGAHHPKYHDRRTVTIRSSHNDTDDVSADFLWGIRRANHGGRLLLKKGQKYVIGRKLDLSFLDNVEVQLDGELKFTDDVPYWQENNFYYDFQKSISFWRWGGHDVRIFGRGTLNGNGQRWYNEFAGQEILDPDNTYYRPILFVAENATRLSVEGITELNSPCWTNFLVNSKDISFDNVFINAYSTNASAEPKNTDGFDSLNVNGLSVTNTRVDIGDDCFSPKPNTTNIFVQNLWCNNTHGVSMGSIGQYPGVLDIIEHAYIENVTLLNGENGARLKAWAGEDVGYGRINNITYKNIHVENTDYPIVLDQCYFNIPADECASYPSQVNVTNIVFENVYGTSSGAEGNVVAELICSPNAICEDIKLKGINLTTPEGEKGVVVCDGISGGVGVECQSSE

SEQ ID NO: 5603 - protein, 427 aa, Emericella nidulans
  strain FGSC A4 / ATCC 38163 / CBS 112.46 / NRRL 194 / M139
MLDFMDYIQLAFAEGTQRNCDNSYSSLTATTQNLLDFTTPERVRIHLSSLSTPNFATSYTLGTVGLIEGSISYLYSNISFDNTPSKSALIPLRKLAPGYRQVQAPIAPPSSKGQKATLLHATLHLPPPTTLNALFLRRISPTMQLSLAVSSTRGPPLSKSAPQATLLTQLTHDTGKYSNEYLFSTDNSLFGWRGLWNFGPDPRFNNNAQRLSLLSAGAEAYYSPVSSLIGMSTGLRFCTLPAATSSTPNPNTPISTFPYTLTLTLTPLTGSLSTSYSVRASPNLSFSSRFGFNVYSWESEMVAGFELWRQSRKAAIVDNDGLEWARNKARIWDIPASSQVPEPITPSEEETQESVLKVRVDQSWNVRLLWEGRVKELLVSAGVGLGPSSFSPSSYANSQATAGAQGSSGGPPTSYWRGVGVSVSYSS

SEQ ID NO: 5604 - protein, 526 aa, Emericella nidulans
  strain FGSC A4 / ATCC 38163 / CBS 112.46 / NRRL 194 / M139
MASSFQLYKALLFFSSLLSAVQAQKVGTQQAEVHPGLTWQTCTSSGSCTTVNGEVTIDANWRWLHTVNGYTNCYTGNEWDTSICTSNEVCAEQCAVDGANYASTYGITTSGSSLRLNFVTQSQQKNIGSRVYLMDDEDTYTMFYLLNKEFTFDVDVSELPCGLNGAVYFVSMDADGGKSRYATNEAGAKYGTGYCDSQCPRDLKFINGVANVEGWESSDTNPNGGVGNHGSCCAEMDIWEANSISTAFTPHPCDTPGQTLCTGDSCGGTYSNDRYGGTCDPDGCDFNSYRQGNKTFYGPGLTVDTNSPVTVVTQFLTDDNTDTGTLSEIKRFYVQNGVVIPNSESTYPANPGNSITTEFCESQKELFGDVDVFSAHGGMAGMGAALEQGMVLVLSLWDDNYSNMLWLDSNYPTDADPTQPGIARGTCPTDSGVPSEVEAQYPNAYVVYSNIKFGPIGSTFGNGGGSGPTTTVTTSTATSTTSSATSTATGQAQHWEQCGGNGWTGPTVCASPWACTVVNSWYSQCL

SEQ ID NO: 5605 - protein, 124 aa, Escherichia coli
  MOD_RES (42)..(42): Any amino acid
MNKVKCYVLFTALLSSLYAHGAPQTITELCSEYRNTQIYTIXDKILSYTESMAGKREMVIITFKSGETFQVEVPGSQHIDSQKKAIERMKDTLRITYLTETKIDKLCVWNNKTPISIAAISMEN

SEQ ID NO: 5606 - protein, 998 aa, Escherichia coli
MTVNKIKNIFNNATLTTKSAFNTASSSVRSAGKKLILLIPDNYEAQGVGINELVKAADELGIEIHRTERDDTAIANQFFGAAEKVVGLTERGVAIFAPQLDKLLQKYQKVGSKIGGTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGPLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAAFHKETGAIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQSGKYEYMTSLIVNGKDTWSVKGIKNHKGVYDYSKLIQFVEKNNKHYQARIISELGDKDDVVYSGAGSSEVFAGEGYDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYGQNYGHHTIADEGGKGDRLHLSDISFDDIAFKRVGNDLIMNKAINGVLSFNESNDVNGITFKNWFAKDASGADNHLVEVITDKDGREIKVDKIPHNNNERSGYIKASNIASEKNMVNITSVTNDINKIISSVSGFDSGDERLASLYNLSLHQNNTHSTTLTTTV

SEQ ID NO: 5607 - protein, 367 aa, Escherichia coli
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGGAISSSKRTDDQNSPLYIGNGDRAETYTGGLKYDANNIYLAAQYTQTYNATRVGSLGWANKAQNFEAVAQYQFDFGLRPSVAYLQSKGKNLGVINGRNYDDEDILKYVDVGATYYFNKNMSTYVDYKINLLDDNQFTRDAGINTDNIVALGLVYQF

SEQ ID NO: 5608 - protein, 374 aa, Escherichia coli
MKVKVLSLLVPALLVAGAANAAEVYNKDGNKLDLYGKVDGLHYFSDNKSEDGDQTYVRLGFKGETQVTDQLTGYGQWEYQIQGNTSEDNKENSWTRVAFAGLKFQDVGSFDYGRNYGVVYDVTSWTDVLPEFGGDTYGSDNFMQQRGNGYATYRNTDFFGLVDGLNFAVQYQGKNGSVSGEGMTNNGRGALRQNGDGVGGSITYDYEGFGIGAAVSSSKRTDDQNFGLNGYGERYLGNGDRAETYTGGLKYDANNIYLAAQYTQTYNATRVGSLGWANKAQNFEAVAQYQFDFGLRPSVAYLQSKGKNLGVVAGRNYDDEDILKYVDVGATYYFNKNMSTYVDYKINLLDDNQFTRDAGINTDNIVALGLVYQF

SEQ ID NO: 5609 - protein, 120 aa, Escherichia coli
MKKYILGVILAMGSLSAIAGGGNSERPPSVAAGECVTFNSKLGEIGGYSWKYSNDACNETVAKGYAIGVAMHRTVNYEGGYSIQSSGIVKPGSDFIMKGGKTYKGHKKVSAGGDTPYWYK

SEQ ID NO: 5610 - protein, 89 aa, Escherichia coli
MKKTLLIAASLSFFSASALATPDCVTGKVEYTKYNDDDTFTAKVGDKELFTNRWNLQSLLLSAQITGMTVTIKTNACHNGGGFSEVIFR

SEQ ID NO: 5611 - protein, 89 aa, Escherichia coli
MKKTLLIAASLSFFSASALATPDCVTGKVEYTKYNDDDSFTVKVGDKELFTNRWNLQSLLLSAQITGMTVTIKTNACHNGGGFSEVIFR

SEQ ID NO: 5612 - protein, 89 aa, Escherichia coli
MKKMFMAVLFALASVNAMAADCAKGKIEFSKYNEDDTFTVKVDGKEYWTSRWNLQPSLQSAQLTGMTVTIKSSTCESGSGFAEVQFNND

SEQ ID NO: 5613 - protein, 89 aa, Escherichia coli
MKKMFMAVLFALVSVNAMAADCAKGKIEFSKYNENDTFTVKVAGKEYWTSRWNLQPLLQSAQLTGMTVTIKSSTCESGSGFAELQFNND

SEQ ID NO: 5614 - protein, 89 aa, Escherichia coli
MKKMFMAVLFALVSVNAMAADCAKGKIEFSKYNENDTFTVKVAGKEYWTSRWNLQPLLQSARLTGMTVTIKSSTCESGSGFAEVQFNND

SEQ ID NO: 5615 - protein, 89 aa, Escherichia coli
MKKMFMAVLFALASVNAMAADCAKGKIEFSKYNEDDTFTVKVDGKEYWTSRWNLQPLLQSAQLTGMTVTLKSSTCESGSGFAEVQFNND

SEQ ID NO: 5616 - protein, 89 aa, Escherichia coli
MKKMFMAVLFALASVNAMAADCAKGKIEFSKYNEDDTFTVKVAGKEYWTSRWNLQPLLQSAQLTGMTVTIKSSTCESGSGFAEVQFNND

SEQ ID NO: 5617 - protein, 89 aa, Escherichia coli
MKKMFMAVLFALVSVNAMAADCAKGKIEFSKYNEDDTFTVKVAGKEYWTSRWNLQPLLQSAQLTGMTVTIKSSTCESGSGFAEVQFNND

SEQ ID NO: 5618 - protein, 89 aa, Escherichia coli
MKKMFMAVLFALVSVNAMAADCAKGKIEFSKYNEDDTFTVKVDGKEYWTSRWNLQPLLQSAQLTGMTVTIKSSTCESGSGFAEVHFNND

SEQ ID NO: 5619 - protein, 89 aa, Escherichia coli
  MOD_RES (35)..(35): Any amino acid
MKKMFMAVLFALVSVNAMAADCAKGKIEFSKYNEXDTFTVKVDGKEYWTSRWNLHPLLQSAQLTGMTVTIKSSTCESGSGFAEVQFNND

SEQ ID NO: 5620 - protein, 258 aa, Escherichia coli
MKNITFIFFILLASPLYANGDKLYRADSRPPDEIKRSGGLMPRGHNEYFDRGTQMNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNSSRTITGDTCNEETQNLSTIYLREYQSKVKRQIFSDYQSEVDIYNGIRDEL

SEQ ID NO: 5621 - protein, 124 aa, Escherichia coli
MNKVKFYVLFTALLSSLCAHGAPQSITELCSEYHNTQIYTINDKILSYTESMAGKREMVIITFKSGATFQVEVPGSQHIDSQKKAIERMKDTLRITYLTETKIDKLCVWNNKTPNSIAAISMEN

SEQ ID NO: 5622 - protein, 124 aa, Escherichia coli
MNKVKFYVLFTALLSSLCAYGAPQSITELCSEYRNTQIYTINDKILSYTESMAGKREMVIITFKSGATFQVEVPGSQHIDSQKKAIERMKDTLRITYLTETKIDKLCVWNNKTPNSIAAISMEN

SEQ ID NO: 5623 - protein, 258 aa, Escherichia coli
MKNITFIFVILLASPLYANGDKLYRADSRSPDEIKRSGGLMPRGHNEYFDRGTQMNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNLSRTITDDTCNEETQNLSTIYLREYQSKVKRQIFTDYQSEVDIYNRIRDEL

SEQ ID NO: 5624 - protein, 124 aa, Escherichia coli
MNKVKFYVLFTALLSSLCAHGAPQSITELCSEYRNTQIYTINDKILSYTESMAGKREMVIITFKSGATFQVEVPGSQHIDSQKKAIERMKDTLRIAYLTETKIDKLCVWNNKTPNSIAAISMEN

SEQ ID NO: 5625 - protein, 258 aa, Escherichia coli
MKNITFIFFILLASPLYANGDKLYRADSRPPDEIKRSGGLMPRGHNEYFDRGTQMNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNSSRTITGDTCNEEAQNLSTIYLREYQSKVKRQIFSDYQSEVDIYNRIRDEL

SEQ ID NO: 5626 - protein, 258 aa, Escherichia coli
MKNITFIFFILLASPLYANGDKLYRADSRPPYEIKRSGGLMPRGHNEYFDRGTQMNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNSSRTITGDTCNEETQNLSTIYLRKYQSKVKRQIFSDYQSEVDIYNRIRDEL

SEQ ID NO: 5627 - protein, 124 aa, Escherichia coli
MNKVKCYVLFTALLSSLCAHGAPQSITELCSEYRNTQIYTINDKILSYTESMAGKREMVIITFKSGATFQVEVPGSQHIDSQKKAIERMKDTLRITYLTETKIDKLCVWNNKTPNSIAAISMEN

SEQ ID NO: 5628 - protein, 258 aa, Escherichia coli
MKNITFIFFILLASPLYANGDKLYRADSRPPDEIKRSGGLMPRGHNEYFDRGTQMNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPRGCGNSSRTITGDTCNEETQNLSTIYLRKYQSKVKRQIFSDYQSEVDIYSRIRDEL

SEQ ID NO: 5629 - protein, 258 aa, Escherichia coli
MKNITFIFFILLASPLYANGDKLYRADSRPPDEIKRSGGLMPRGHNEYFDRGTQININLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNSSRAITGDTCNEETQNLSTIYLREYQSKVKRQIFSDYQSEVDMYNRIRDEL

SEQ ID NO: 5630 - protein, 258 aa, Escherichia coli
MKNITFIFFILLASPLYANGDKLYRADSRPPDEIKHSGGLMPRGHNEYFDRGTQININLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNSSRTITGDTCNEETQNLSTIYLRKYQSKVKRQIFSDYQSEVDIYNRIRDEL

SEQ ID NO: 5631 - protein, 258 aa, Escherichia coli
MKNITFIFFILLASPLYANGDKLYRADSRPPDEIKHSGGLIPRGHNEYFDRGTQMNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNSSRTITGDTCNEETQNLSTIYLRKYQSKVKRQIFSDYQSEVDIYNRIRDEL

SEQ ID NO: 5632 - protein, 258 aa, Escherichia coli
MKNITFIFFILLASPLYANGDKLYRADSRPPDEIKRSGGLMPRGHNEYFDRGTQMNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEGGYRLAGFPPDHQAWREEPWIHHAPQGCGNLSRTITDDTCNEETQNLSTIYLREYQSKVKRQIFTDYQSEVDIYNRIRDEL

SEQ ID NO: 5633 - protein, 124 aa, Escherichia coli
MNKVKFYVLFTVLLSSLCAHGAPQSITELCSEYRNTQIYTINDKILSYTESMAGKREMVIITFKSGATFQVEVPGSQHIDSQKKAIERMKDTLRIAYLTETKIDKLCVWNNKTPNSIAAISMEN

SEQ ID NO: 5634 - protein, 258 aa, Escherichia coli
MKNITFIFVILLASPLYANGDKLYRADSRPPDEIKRSGGLMPRGHNEYFDRGTQMNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNLSRTITDDTCNEETQNLSTIYLREYQSKVKRQIFTDYQSEVDIYNRIRDEL

SEQ ID NO: 5635 - protein, 258 aa, Escherichia coli
MKNITFIFFILLASPLYANGDKLCRADSRPPDEIKRSGGLMPRGHNEYFDRGTQMNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNLSRTITDDTCNEETQNLSTIYLREYQSKVKRQIFTDYQSEVDIYNRIRDEL

SEQ ID NO: 5636 - protein, 206 aa, Escherichia coli
MSLLEVIIVLGIIGTIAAGVVILAQRAFDSRAVTDLVTNTNTVRVAMKDAYQRDGKYPDFVDPLSLTANTIKTDTNGIPAAQLVQLGKITPDEVRNNISGDFIAIGGALTSNGAQVKKGFAIELNGLSQEQCRSILGQVGNNWEYVAIGTSASGSYAMTATGVDMSVAASTTVLRSLGNNGQTTLTADKILSTCTAQVNSITLGSR

SEQ ID NO: 5637 - protein, 206 aa, Escherichia coli
MSLLEVIIVLGIIGTIAAGVVILAQRAFDSRAVTDLVTNTNTVRVAMKDAYQRDGVYPDYVSPLKLTSDTIKKDTGKIPAAQLVQLGKITPDEVRNNISGDFIAIGGALTSNGATVKKGFAIELNGLSQEQCRSILGQVGNNWEYVAVGNSASGSYAMQAAEVDMSVAATGDILRTLGTDGQKTLTAERILGTCTATVNSITLGSR

SEQ ID NO: 5638 - protein, 206 aa, Escherichia coli
MSLLEVIIVLGIIGTIAAGVVILAQRAFDSRAVTDLVTNTNTVRVAMKDAYQRDGVYPDYVSPLNLTSDTIKTDTGKIPAAQLVQLGKITPDEVRNNISGDFIAIGGALTSDGATVKKGFAIELNGLSQEQCRSILGQVGNNWEYVAVGNSASGSYAMQTAGVNMSVAATGNILRTLGTDGQKTLTAERILGTCTATVNSITLGSR

SEQ ID NO: 5639 - protein, 206 aa, Escherichia coli
MSLLEVIIVLGIIGTIAAGVVILAQRAFDSRAVTDLVTNTNTVRVAMKDAYQRDGVYPDYVSPLNLTSDTIKTNTGKIPAAQLVQLGKITPDEVRNNISGDFIAIGGALTSNSATVKKGFAIELNGLSQEQCRSILGQVGNNWEYVAVGNSASGSYAMQAAGVDMSVAAAGDILRTLGTDGQKTLTAERILGTCTATVNSITLGSR

SEQ ID NO: 5640 - protein, 206 aa, Escherichia coli
MSLLEVIIVLGIIGTIAAGVVILAQRAFDSRAVTDLVTNTNTVRVAMKDAYQRDGVYPDYVSPLKLTSDTIKKDTGKIPAAQLVQLGKITPDEVRNNISGDFIAIGGALTSNGATVKKGFAIELNGLSQEQCRSILGQVGNNWEYVAVGNSASGSYAMQAAEVDMSVAATGDILRTLGTDGQTTLTADKILSTCTAQVNSITLGSR

SEQ ID NO: 5641 - protein, 206 aa, Escherichia coli
MSLLEVIIVLGIIGTIAAGVVILAQRAFDSRAVTDLVTNTNTVRVAMKDAYQRDGVYPDYVSPLNLTSDTIKTDTGKIPAAQLVQLGKITPDEVRNNISGDFIAIGGALTSDGATVKKGFAIELNGLSQEQCRSILGQVGNNWEYVAVGNSASGSYAMQTAGVNMSVAATGNILRTLGTDGQTTLTADKILRTCTAQVNSITLGSR

SEQ ID NO: 5642 - protein, 206 aa, Escherichia coli
MSLLEVIIVLGIIGTIAAGVVILAQRAFDSRAVTDLVTNTNTVRVAMKDAYQRDGVYPDYVSPLNLTSDTIKTDTGKIPAAQLVQLGKITPDEVRNNISGDFIAIGGALTSDGATVKKGFAIELNGLSQEQCRSILGQVGNNWEYVAVGNSASGSYAMQTAGVNMSVAATGNILRTLGTDGQTTLTADKILSTCTAQVNSITLGSR

SEQ ID NO: 5643 - protein, 207 aa, Escherichia coli
MSLLEVIIVLGIIGTIAAGVVILAQRAFDSRAVTELVTNTNTVRVAMKDAYQRDGAYPDYLSPLSLTADTINTTTDKIPAAQLVQLGKISPDEVRNNISGDFIGIGGAKTSAAATVNKGFVIELNGLSQEQCRTILGQVGNNWEYVAVGNSASGAYSLTNTALDMTTAANGTSILRSLGANSQDTLTAEKILATCTATVNSITLGSR

SEQ ID NO: 5644 - protein, 206 aa, Escherichia coli
MSLLEVIIVLGIIGTIAAGVVILAQRAFDSRAVTDLVTNTNTVRVAMKDAYQRDGKYPDFVDPLSLTANTIKTDTSGIPAAQLVQLGKITPDEVRNNISGDFIAIGGALTSNGAQVKKGFAIELNGLSQEQCRSILGQVGNNWEYVAIGTSASGSYAMTATGVDMSVAASTTVLRSLGNGGQTTLTADKILSTCTAQVNSITLGSR

SEQ ID NO: 5645 - protein, 840 aa, Escherichia coli
MKNKADNKKRNFLTHSEIESLLKAANTGPHAARNYCLTLLCFIHGFRASEICRLRISDIDLKAKCIYIHRLKKGFSTTHPLLNKEIQALKNWLSIRTSYPHAESEWVFLSRKGNPLSRQQFYHIISTSGGNAGLSLEIHPHMLRHSCGFALANMGIDTRLIQDYLGHRNIRHTVWYTASNAGRLRDNTTWSYNSSDSSSGSKNKWQHINTWLERDIIPLRSRLTLGDGYTQGDIFDGINFRGAQLASDDNMLPDSQRGFASVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 5646 - protein, 1024 aa, Escherichia coli
MPTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGSAENIGDNLGKAGSVLSTFQNFLGTALSSMKIDELIKKQKSGSNVSSSELAKASIELINQLVDTAASINNNVNSFSQQLNKLGSVLSNTKHLNGVGNKLQNLPNLDNIGAGLDTVSGILSAISASFILSNADADTGTKAAAGVELTTKVLGNVGKGISQYIIAQRAAQGLSTSAAAAGLIASVVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQAFDPLKGNIDLSDSKSSTLLKFVTPLLTPGEEIRERRQSGKYEYITELLVKGVDKWTVKGVQDKGSVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGKNLTETDNLYSVEELIGTTRADKFFGSKFTDIFHGADGDDHIEGNDGNDRLYGDKGNDTLSGGNGDDQLYGGDGNDKLIGGAGNNYLNGGDGDDELQVQGNSLAKNVLSGGKGNDKLYGSEGADLLDGGEGNDLLKGGYGNDIYRYLSGYGHHIIDDDGGKDDKLSLADIDFRDVAFRREGNDLIMYKAEGNVLSIGHKNGITFRNWFEKESGDISNHQIEQIFDKDGRVITPDSLKKALEYQQSNNKASYVYGNDALAYGSQDNLNPLINEISKIISAAGNFDVKEERAAASLLQLSGNASDFSYGRNSITLTASA

SEQ ID NO: 5647 - protein, 876 aa, Escherichia coli
MFFGDGGQLLSDKSLTGSAGGGNNRMKFNILPLAFFIGIIVSPARAELYFNPRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQLYMSNQARGYIAPEYWDNGITAALLNYDFSGNRVRDSYGGTSDYAYLNLKTGLNIGSWRLRDNTSWSYSAGKGYSQNNWQHINTWLERDIVSLRSRLTMGDSYTRGDIFDGVNFRGIQLASDDNMVPDSQRGYAPTIHGISRGTSRISIRQNGYEIYQSTLPPGPFEINDIYPAGSGGDLQVTLQEADGSVQRFNVPWSSVPVLQREGHLKYALSAGEFRSGGHQQDNPRFAEGTLKYGLPAGWTVYGGAWIAERYRAFNLGVGKNMGWLGAVSLDATRANARLPDESRHDGQSYRFLYNKSLTETGTNIQLIGYRYSTRGYFSFADTAWKKMSGYSVLTQDGVIQIQPKYTDYYNLAYNKRGRVQVSISQQTGESSTLYLSGSHQSYWGTDRTDRQLNAGFNSSVNDISWSLNYSLSRNAWQHETDRILSFDVSIPFSHWMRSDSTSAWRNASARYSQTLEAHGQAASTAGLYGTLLGDNNLGYSIQSGYTRGGYEGSSKTGYASLNYRGGYGNASAGYSHSGGYRQLYYGLSGGILAHANGLTLSQPLGDTLILVRAPGASDTRIENQTGVSTDWRGYAVLPYATDYRENRVALDTNTLADNVDIENTVVSVVPTHGAVVRADYKTRVGVKVLMTLMRNGKAVPFGSVVTARNGGSSIAGENGQVYLSGMPLSGQVSVKWGSQTTDQCTADYKLPKESAGQILSHVTVSCR

SEQ ID NO: 5648 - protein, 843 aa, Escherichia coli
MNLVMRGMKDRIPFAVNNITCVILLSLFCNAASAVEFNTDVLDAADKKNIDFTRFSEAGYVLPGQYLLDVIVNGQSISPASLQISFVEPQSSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNTISVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 5649 - protein, 998 aa, Escherichia coli
MTVNKIKNIFNNATLTTKSAFNTASSSVRSAGKKLILLIPDNYEAQGVGINELVKAADELGIEIHRTERDDTAIANQFFGAAEKVVGLTERGVAIFAPQLDKLLQKYQKVGSKIGGTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGSLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAAFHKETGAIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQSGKYEYMTSLIVNGKDTWSVKGIKNHKGVYDYSKLIQFVEKNNKHYQARIISELGDKDDVVYSGAGSSEVFAGEGHDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYRQNYGHHTIADEGGKGDRLHLSDISFDDIAFKRVGNDLIMNKAINGVLSFNDSNDVNGITFKNWFAKDASGADNHLVEVITDKDGREIKVDKIPHNNNERSGYIKASNIASEKNMVNITSVANDINKIISSVSGFDSGDERLASLYNLSLHQNNTHSTTLTTTV

SEQ ID NO: 5650 - protein, 998 aa, Escherichia coli
MTVNKIKNIFNNATLTTKSAFNTASSSVRSAGKKLILLIPDNYEAQGVGINELVKAADELGIEIHRTERDDTAIANQFFGAAEKVVGLTERGVAIFAPQLDKLLQKYQKVGSKIGRTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGSLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAAFHKETGAIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQSGKYEYMTSLIVNGKDTWSVKGIKNHKGVYDYSKLIQFVEKNNKHYQARMISELGDKDDVVYSGAGSSEVFAGEGHDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYRQNYGHHTIADEGGKGDRLHLSDISFDDIAFKRVGNDLIMNKAINGVLSFNESNDVNGITFKNWFAKDASGADNHLVEVITDKDGREIKVDKIPHNNNERSGYIKASNIASEKNMVNITSVANDINKIISSVSGFDSGDERLASLYNLSLHQNNTHSTTLTTTV

SEQ ID NO: 5651 - protein, 998 aa, Escherichia coli
MTVNKIKNIFNNATLTTKSAFNTASSSVRSAGKKLILLIPDNYEAQGVGINELVKAADELGIEIHRTERDDTAIANQFFGAAEKVVGLTERGVAIFAPQLDKLLQKYQKVGSKIGGTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGSLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAAFHKETGAIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQSGKYEYMTSLIVNGKDTWSVKGIKNHKGVYDYSKLIQFVEKNNKHYQARIISELGDKDDVVYSGAGSSEVFAGEGHDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYRQNYGHHTIADEGGKGDRLHLSDISFDDIAFKRVGNDLIMNKAINGVLSFNESNDVNGITFKNWFAKDASGADNHLVEVITDKDGREIKVDKIPHNNNERSGYIKASNIASEKNMVNITSVANDINKIISSVSGFDSGDERLASLYNLSLHQNNTHSTTLTTTV

SEQ ID NO: 5652 - protein, 998 aa, Escherichia coli
MTVNKIKNIFNNATSTTKSAFNTASSSVRSAGKKLILLIPDNYEAQGVGINELVKAADELGIEIHRTERDDTAIANQFFGTAEKVVGLTERGVAIFAPQLDKLLQKYQKVGSKIGGTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGPLGDGLDVVSGILSAVSASFILGNSDAHTGTKAAAGIELTTQVLGNVGKAVSQYILAQRMAQGLSTTAASAGLITSAVMLAISPLSFLAIADKFERAKQLESYSERFKKFNYEGDALLAAFHKESGAIDAALTTINTVLSSVSAGVSAASSASLIGAPISMLVSALTGTISGILDASKQAMFEHVADKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFVTPTFTPGEEVRERKQSGKYEYMTSLIVNGKDTWSVKGIKNHKGVYDYSNLIQFVEKDNKHYQARIISELGDKDDIVYSGAGSSEVFAGEGHDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYRQNYGHHTIADEGGKGDRLHLSDISFDDIAFKKVGNDLIMNKAINGALSFNESNDVNGITFKNWFAKDASGEDNHLVEVITDKDGREIKADKISHNNNEQSGYIKPSNIASEKNMVNITSVANDINKIISSVSGFDSGDERLASLYNLSLHQNNTHSTTLTTTV

SEQ ID NO: 5653 - protein, 998 aa, Escherichia coli
MTVNKIKNIFNNAALTTKSAFNTASSSVRSAGKKLILLIPDNYEAQGVGINELVKAADELGIEIHRTERDDTAIANQFFGTAEKVVGLTERGVAIFAPQLDKLLQKYQKVGSKIGGTAENVGNNLGKAGTVLSPLQNFTGIALSGMALDELLRKQREGEDISQNDIAKSSIELINQLVDTVSSINSTVDSFSEQLNQLGSFLSSKPRLSSVGGKLQNLPDLGPLGDGLDVVSGILSAVSASFILGNSDAHTGTKAAAGIELTTQVLGNVGKAVSQYILAQRIAQGLSTTAASAGLITSAVMLAISPLSFLAIADKFERAKQLESYSERFKKLNYEGDALLAAFHKETGAIDAALTTINTVLSSVSAGVSAASSASLIGAPISMLVSALTGTISGILEASKQAMFEHVADKFAARINEWEKEHGKNYFENGYDARHAAFLEDSLSLLADFSRQHAVERAVAITQQHWDEKIGELAGITRNADRSQSGKAYINYLENGGLLAAQPKEFTQQVFDPQKGTIDLSTGNVSSVLTFVTPTFTPGEEVRERKQSGKYEYMTSLIVNGKDTWSVKGIKNHKGVYDYSNLIQFVEKDNKHYQARIISELGDKDDIVYSGAGSSEVFAGEGHDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYRQNYGHHTIADEGGKGDRLHLSDISFDDIAFKRVGNDLIMNKAINGVLSFNESNDVNGITFKNWFAKDASGADNHLVEVITDKDGREIKADKIPHNNNERSGYIKASNIASEKNMVNITSVADDINKIISSVSGFDSGDERLASLYNLSLHQNNTHSTTLTTTV

SEQ ID NO: 5654 - protein, 998 aa, Escherichia coli
MTVNKIKNIFNNATLTTKSAFNTASSSVRSAGKKLILLIPDNYEAQGVGINELVKAADELGIEIHRTERDDTAIANQFFGAAEKVVGLTERGVAIFAPQLDKLLQKYQKVGSKIGGTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGSLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAAFHKETGAIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQSGKYEYMTSLIVNGKDTWSVKGIKNHKGVYDYSKLIQFVEKNNKHYQARIISELGDKDDVVYSGAGSSEVFAGEGHDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYRQNYGHHTIADEGGKGDRLHLSDISFDDIAFKRVGNDLIMNKPINGVLSFNESNDVNGITFKNWFAKDASGADNHLVEVITDKDGREIKVDKIPHNNNERSGYIKASNIASEKNMVNITSVANDINKIISSVSGFDPGDERLASLYNLSLHQNNTHSTTLTTTV

SEQ ID NO: 5655 - protein, 997 aa, Escherichia coli
MTVNKIKNIFSNATSTTKSAFNTASSNVRTAGKKIILLIPDDYEAQGVGINELVKAADELGIEIHRTERDDTAIANQFFGTAEKVLGLTERGVAIFAPQLDKLLQKYQNVGSKIGGTAENVGNNLGKAGTVLSALHNFTGIALSGMALDELLRKQRGGEDISQNDIAKSSIELINHLVDTVSSINSTVDSFSEQLNQLGSFLSSKPSLSSVGGKLQNLPDLGPLGDGLDVISGILSAVSASFILGNSDAHTGTKAAAGIELTTQVLGNVGKAVSQYILAQRMAQGLSTTAASAGLITSAVMLAISPLSFLAIADKFERAKQLEAYSERFKKLNYEGDALLAAFHKETGAIDAALTTINTVLSSVSAGVSAASSASLIGAPISMLVSALTGTISGILEASKQAMFEHVADKFAARINEWEKEHGKNYFENGYDARHAAFLEDSLSLLADFSRQHAVERAVAITQQHWDEKIGELAGITRNADRSQSGKAYINYLENGGLLEDQPKEFTQQVFDPQKGTIDLSTGNVSSVLTFVTPTFTPGEEVRERKQSGKYEYMTSLIVNGKDTWTVKGLKSHKGVYDYSNLIQFVEKDNKYHQAKIISELGDKNDIVYSGSGSSEVFAGEGHDTVSYNKTDAGKLTIDATGASKPGEYIVSKNMYGDVKVLQEVVNEQEVSVGKRTEKIQYRDFEFRAGGISYDVIDKLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGIDLLDGGEGNDYLNGGFGNDIYVYRQNYGHHTIADEGGKGDRLHLSDISFDDIAFKKVGNDLIMNKAINGVLSFNESNDVNGITFKNWFAKDASGADNHLVEIITDKDGREIKSDNIPHKNNDWSGYIKASSIASEKNMVNITSVANDINKIISSVSGLDSGDERLASLYNLALHQNNTHSTTLTTTV

SEQ ID NO: 5656 - protein, 997 aa, Escherichia coli
MTVNKIKNIFSNATSTTKSAFNTASSNVRTAGKKIILLIPDDYEAQGVGINELVKAADELGIEIHRTERDDTAIANQFFGTAEKVLGLTERGVAIFAPQLDKLLQKYQNVGSKIGGTAENVGNNLGKAGTVLSALHNFTGIALSGMALDELLRKQRGGEDISQNDIAKSSIELINHLVDTVSSINSTVDSFSEQLNQLGSFLSSKPSLSSVGGKLQNLPDLGPLGDGLDVISGILSAVSASFILGNSDAHTGTKAAAGIELTTQVLGNVGKAVSQYILAQRMAQGLSTTAASAGLITSAVMLAISPLSFLAIADKFERAKQLEAYSERFKKLNYEGDALLAAFHKETGAIDAALTTINTVLSSVSAGVSAASSASLIGAPISMLVSALTGTISGILEASKQAMFEHVADKFAARINEWEKEHGKNYFENGYDARHAAFLEDSLSLLADFSRQHAVERAVAITQQHWDEKIGELAGITRNADRSQSGKAYINYLENGGLLEDQPKEFTQQVFDPQKGTIDLSTGNVSSVLTFVTPTFTPGEEVRERKQSGKYEYMTSLIVNGKDTWTVKGLKSHKGVYDYSNLIQFVEKDNKYHQAKIISELGDKNDIVYSGSGSSEVFAGEGHDTVSYNKTDAGKLTIDATGASKPGEYIVSKNMYGDVKVLQEVVNEQEVSVGKRTEKIQYRDFEFRAGGISYDVIDKLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGIDLLDGGEGNDYLNGGFGNDIYVYRQNYGHHTIADEGGKGDRLHLSDISFDDIAFKKVGNDLIMNKAINGVLSFNESNDVNGITFKNWFAKDASGADNHLVEIITDKDGREIKSDNIPHKNNDWSGYIKASSIASEKNMVNITSVANDINKIISSVSGLDSGDERLASLYNLALHQNNTHSTTLTTPV

SEQ ID NO: 5657 - protein, 998 aa, Escherichia coli
MTVNKIKNIFNNATLTTKSAFNTASSSVRSAGKKLILLIPDNYEAQGVGINELVKAADELGIEIHRTERDDTAIANQFFGAAEKVVGLTERGVAIFAPQLDKLLQKYQKVGSKIGGTAENVGNNLGKAGTVLSALQNFTGIALSGMALDELLRKQRAGEDISQNDIAKSSIELINQLVDTVSSINSTVDSFSEQLNQLGSFLSSKPRLSSVGGKLQNLPDLGPLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAAFHKETGAIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQSGKYEYMTSLIVNGKDTWSVKGIKNHKGVYDYSKLIQFVEKNNKHYQARIISELGDKDDVVYSGAGSSEVFAGEGYDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYGQNYGHHTIADEGGKGDRLHLSDISFDDIAFKRVGNDLIMNKAINGVLSFNESNDVNGITFKNWFAKDASGADNHLVEVITDKDGREIKVDKIPHNNNERSGYIKASNIASEKNMVNITSVANDINKIISSVSGFDSGDERLASLYNLSLHQNNTHSTTLTTTV

SEQ ID NO: 5658 - protein, 179 aa, Escherichia coli
RKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLT

SEQ ID NO: 5659 - protein, 89 aa, Escherichia coli
MKKMFMAVLFALVSVNAMAADCAKGKIEFSKYNENDTFTVKVAGKEYWTNRWNLQPLLQSAQLTGMTVTIKSNTCAPGSGFAEVQCNND

SEQ ID NO: 5660 - protein, 89 aa, Escherichia coli
MKKMFMAVLFALVSVNAMAADCAKGKIEFSKYNEDDTFTVKVDGKEYWTSRWNLQPLLQSAQLTGMTVTIKSSTCASGSGFAEVQFNND

SEQ ID NO: 5661 - protein, 213 aa, Escherichia coli
MLSVYNRTQKMKEEARKKLAKYHELRKQRGMSLLEVIIVLGIIGTIAAGVVILAQRAFDSRAITELVTNTNTVRVAMKDAFQRDGVYPAYASPLSLTGDTIKTTPDKIAAAQLVKLGKITADEVRNNISGDFIGIGGAITTSGSKVLKGFAMELNGLSQEQCRSILGQVGNNWEYVGVGSSGSGTYSLNAAGVDMTQAADGSTILRSLGQDSQ

SEQ ID NO: 5662 - protein, 233 aa, Escherichia coli
MKRIALFFCFIFSFAAHANNIIVNGTRFIYPGNEKEITVQLSNNADRPALAQAWLDNGDADATPDTITTPFIITPPISRVDAKSGQTLRIKLGSSAGLAKDKETLWWLNLLEIPPVVANQKNEGQNVLQLAIRSRFKFIYRPAGLGNRDAAAEKLTLTASGSSLAINNPTPFYITVSRISRDGGKALNSKTVMLAPQSSQTVALSSAVNRGETLTVNNINDYGADVAVKVAVK

SEQ ID NO: 5663 - protein, 831 aa, Escherichia coli
MKQRSFCPGRLSTAIAIALCCFPPFSSGQENPGTVYQFNDGFIVGSREKVDLSRFSTSAITEGTYSLDVYTNDEWKGRYDLSIARDKDGRLGVCYTKAMLAQYGIAAEKLNPQLSEQEGYCGSLKSWRNEENVKDNLVQSSLRLNISVPQIYEDQRLKNYVSPEFWDKGITALNLGWMANAWNSHTSSVGGSDNSSAYLGVNAGLSWDGWLLKHIGNLNWQQQQGKAHWNSNQTYLQRPIPQLNSIVSGGQIFTNGEFFDTIGLRGVNLSTDDNMFPDGMRSYAPEIRGVAQSNALVTVRQGSNIIYQTTVPPGPFTLQDVYPSGYGSDLEVSVKEADGSVEVFSVPYASVAQLLRPGMTRYALSAGKVDDSALRNKPMLYQATWQHGINNLLTGYTGVTGFDDYQAFLVGTGMNTGIGALSFDVTHSRLKSDAHDDSGQSYRATFNRMFTDTQTSIVLAAYRYSTKGYYNLNDALYAVDQEKNSRSNYTLWRQKNGMTFTVNQNLPDGWGGFYLSGRISDYWNRSGTEKQYQVSYNNSFGRLSWSASAQRVYTPDSSGHRRDDRISLNFSYPLWFGDNRTANLTSNTSFNNSRFASSQIGINGSLDSENNLNYGVSTTTATGGQHDVALNGSYRTPWTTLNGSYSQGEGYRQSGIGASGTMIAHSGGVVLSPESGSTMALIEAKDAAGAMLPGSPGTRVDSNGYAILPYLRPYRINAINAVEIDPKGSHDDVAFDRTVAQVVPWEGSVVKVAFGTKVQNNLTLQARQANHEPLPFAASIFSPDGKEIGVVGQGSMMFISDANAKRAIVKWSGGQCSVDLGQQTTKDSVCR

SEQ ID NO: 5664 - protein, 451 aa, Escherichia coli
APQLDKLLQKYQKVGSKIGGTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGPLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAAFHKETGAIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQ

SEQ ID NO: 5665 - protein, 451 aa, Escherichia coli
APQLDKLLQKYQKVGSKIGGTAENVGNNLGKAGTVLSALQNFTGIALSGMALDELLRKQRAGEDISQNDIAKSSIELINQLVDTVSSINSTVDSFSEQLNQLGSFLSSKPRLSSVGGKLQNLPDLGPLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAAFHKETGAIDAALTTINTVLSSVFAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQ

SEQ ID NO: 5666 - protein, 451 aa, Escherichia coli
APQLDKLLQKYQKVGSKIGRTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGSLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAAFHKETGAIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQ

SEQ ID NO: 5667 - protein, 451 aa, Escherichia coli
APQLDKLLQKYQKVGSKIGGTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGSLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAAFHKETGAIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQ

SEQ ID NO: 5668 - protein, 451 aa, Escherichia coli
APQLDKLLQKYQKVGSKIGGTAENVGNNLGKAGTVLSALQNFTGIALSGMALDELLRKQRAGEDISQNDIAKSSIELINQLVDTVSSINSTVDSFSEQLNQLGSFLSSKPRLSSVGGKLQNLPDLGPLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAAFHKETGAIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQ

SEQ ID NO: 5669 - protein, 343 aa, Escherichia coli
MKVKVLSLLVPALLVAGAANAAEIYNKDGNKLDLYGKVDGLHYFSDNDSKDGDKTYMRLGFKGETQVTDQLTGYGQWEYQIQGNEPESDNSSWTRVAFAGLKFQDVGSFDYGRNYGVVYDVTSWTDVLPEFGGDTYDSDNFMQQRGNGFATYRNTDFFGLVDGLDFAVQYQGKNGSAHGEGMTTNGRDDVFEQNGDGVGGSITYNYEGFGIGAAVSSSKRTWDQNNTGLIGTGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYNAGRQPLHP

SEQ ID NO: 5670 - protein, 364 aa, Escherichia coli
MKVKVLSLLVPALLVAGAANAAEIYNKDGNKLDLYGKVDGLHYFSDNDSKDGDKTYMRLGFKGETQVTDQLTGYGQWEYQIQGNEPESDNSSWTRVAFAGLKFQDVGSFDYGRNYGVVYDVTSWTDVLPEFGGDTYDSDNFMQQRGNGFATYRNTDFFGLVDGLDFAVQYQGKNGSAHGEGMTTNGRDDVFEQNGDGVGGSITYNYEGFGIGAAVSSSKRTWDQNNTGLIGTGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKTNLLDDNRFTRDAGINTDDIVALGLVYQF

SEQ ID NO: 5671 - protein, 370 aa, Escherichia coli
MKVKVLSLLVPALLVAGAANAAEVYNKDGNKLDLYGKVDGLHYFSDNDKVDGDKTYMRLGFKGETQVTDQLTGYGQWEYQIQGNAPESENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRDALEQNGDGVGGSITYDIGEGFSFGGAISSSKRTAEQNNSARFIGNGDRAETYTGGLKYDANNIYLAAQYTQTYNATLAGDLGWANKAQNFEVVAQYQFDFGLRPSVAYLQSKGKNLNANIAGRTYDDEDLVKYVDVGATYYFNKNMSTYVDYKINLLDDNNFTRAAGINTDDIVALGLVYQF

SEQ ID NO: 5672 - protein, 828 aa, Escherichia coli
MKQRSFCPGRLSTAIAIALCCFPPFSSGQENPGTVYQFNDGFIVGSREKVDLSRFSTSAITEGTYSLDVYTNDEWKGRYDLRIARDKDGRLGVCYTKAMLAQYGIAAEKLNPQLSEQEGYCGSLKSWRNEENVKDNLVQSSLRLNISVPQIYEDQRLKNYVSPEFWDKGITALNLGWMANAWNSHTSSVGGSDNSSAYLGVNAGLSWDGWLLKHIGNLNWQQQQGKAHWNSNQTYLQRPIPQLNSIVSGGQIFTNGEFFDTIGLRGVNLSTDDNMFPDGMRSYAPEIRGVAQSNALVTVRQGSNIIYQTTVPPGPFTLQDVYPSGYGSDLEVSVKEADGSVEVFSVPYASVAQLLRPGMTRYALSAGKVDDSALRNKPMLYQATWQHGINNLLTGYTGVTGFDDYQAFLVGTGMNTGIGALSFDVTHSRLKSDAHDDSGQSYRATFNRMFTDTQTSIVLAAYRYSTKGYYNLNDALYAVDQEKNSRSNYTLWRQKNGMTFTVNQNLPDGWGGFYLSGRISDYWNRSGTEKQYQVSYNNSFGRLSWSASAQRVYTPDSSGHRRDDRISLNFSYPLWFGDNRTANLTSNTSFNNSRFASSQIGINGSLDSENNLNYGVSTTTATGGQHDVALNGSYRTPWTTLNGSYSQGEGYRQSGIGASGTMIAHSGGVVLSPESGSTMALIEAKDAAGAMLPGSPGTRVDSNGYAILPYLRPYRINAVEIDPKGSHDDVAFDRTVAQVVPWEGSVVKVAFGTKVQNNLTLQARQANHEPLPFAASIFSPDGKEIGVVGQGSMMFISDANAKRAIVKWSGGQCSVDLGQQTTKDSVCR

SEQ ID NO: 5673 - protein, 241 aa, Escherichia coli
MYFYSEVSMKRIALFFCFIFSFAAHANNIIVNGTRFIYPGNEKEITVQLSNNADRPALAQAWLDNGDADATPDTITTPFIITPPISRVDAKSGQTLRIKLGSSAGLAKDKETLWWLNLLEIPPVVANQKNEGQNVLQLAIRSRFKFIYRPAGLGNRDAAAEKLTLTASGSSLAINNPTPFYITVSRISRDGGKALNSKTVMLAPQSSQTVALSSAVNRGETLTVNNINDYGADVAVKVAVK

SEQ ID NO: 5674 - protein, 733 aa, Escherichia coli
MMISKKYTLWALNPLLLTMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAAFLQSGYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTADLLGSYQLPVGTLSFSIENLFDRDYTTVWGQRAPLYYSPGYGPASLYDYKGRGRTFGLNYSVLF

SEQ ID NO: 5675 - protein, 119 aa, Escherichia coli
MNAVLSVQGASVPVKKKSFFSKFTRLNMLRLARAVIPAAVLMMFFPQLAMAAQGQDLMASGNTTVKATFGKDSSVVKWVVLAEVLVGAVMYMMTKNVKFLAGFAIISVFIAVGMAVVGL

SEQ ID NO: 5676 - protein, 121 aa, Escherichia coli
MDAVLSVQGVSAPVKKKSFFSKFTRLNMLRLARAVIPAAVLMMFFPQLAMAAGSSGQDLMASGNTTVKATFGKDSSVVKWVVLAEVLVGAVMYMMTKNVKFLAGFAIISVFIAVGMAVVGL

SEQ ID NO: 5677 - protein, 83 aa, Escherichia coli
MKKTLLIAASLSFFSASALATPDCVTGKVEYTKYNDDDTFTVKVGDKELFTNRWNLQSLLLSAQITGMTVTIKTNACHNGGGF

SEQ ID NO: 5678 - protein, 65 aa, Escherichia coli
MKKMFMAVLFALASVNAMAADCAKGKIEFSKYNEDDTFTVKVDGKEYWTSRWNLQPLLQSAQLTG

SEQ ID NO: 5679 - protein, 84 aa, Escherichia coli
MKKTLLIAASLSFFSASALATPDCVTGKVEYTKYNDDDTFTVKVGDKELFTNRWNLQSLLLSAQITGMTVTIKTNACHNGGGFR

SEQ ID NO: 5680 - protein, 567 aa, Escherichia coli
MKIKLRITIILISALCIFNGLLTPGAYAATANGYVANKENLRSFFETVSSYAGKPTIVSKLAMKKQISGNFDLTEPYALIERLSAQMGLIWYDDGKAIYIYDSSEMRNALINLRKVSTNEFNNFLKKSGLYNSRYEIKGGGNGTFYVSGPPVYVDLVVNAAKLMEQNSDGIEIGRNKVGIIHLVNTFVNDRTYELRGEKIVIPGMAKVLSTLLNNNIKQSTGVNVLSEISSRQQLKNVSRMPPFPGAEEDDDLQVEKIISTAGAPETDDIQIIAYPDTNSLLVKGTVSQVDFIEKLVATLDIPKRHIELSLWIIDIDKTDLEQLGADWSGTIKIGSSLSASFNNSGSISTLDGTQFIATIQALAQKRRAAVVARPVVLTQENIPAIFDNNRTFYTKLVGERTAELDEVTYGTMISVLPRFAARNQIELLLNIEDGNEINSDKTNVDDLPQVGRTFISTIARVPQGKSLLIGGYTRDTNTYESRKIPILGSIPFIGKLFGYEGTNANNIVRVFLIEPREIDERMMNNANEAAVDARAIPQQMALNNEINDEVLQKWIKSDLNREVVGG

SEQ ID NO: 5681 - protein, 227 aa, Escherichia coli
MDNNITNRTKFFSIHIGATRVIYDMASSGATLAITNKHEFPILVQSDVLSEDKEMSTHFIITPPLFRLDPLQSTRLRIVRTGGNFPIDRESMQWICVKGIPPKEDSKWGGTDAENKDEKMTLNVQLSVNSCIKMFIRPSNVKGHPEDVAGKVKWQITGNKLKGINPTPFYINLAELRVGKKEITDPHYIEPFSSYEYQIPTNGAKKVEWKIITDYGGVGKNFEEFLD

SEQ ID NO: 5682 - protein, 65 aa, Escherichia coli
MKKMFMAVLFALASVNAMAADCAKGKIEFSKYNEDDTFTVKVAGKEYWTSRWNLQPLLQSAQLTG

SEQ ID NO: 5683 - protein, 65 aa, Escherichia coli
MKKMFMAVLFALVSVNAMAADCAKGKIEFSKYNEDDTFTVKVDGKEYWTSRWNLQPLLQSAQLTG

SEQ ID NO: 5684 - protein, 65 aa, Escherichia coli
MKKMFMAVLFALVSVNAMAADCAKGKIEFSKYNENDTFTVKVAGKEYWTSRWNLQPLLQSAQLTG

SEQ ID NO: 5685 - protein, 65 aa, Escherichia coli
MKKMFMAVLFALVSVNAMAADCAKGKIEFSKYNEDDTFTVKVAGKEYWTSRWNLQPLLQSAQLTG

SEQ ID NO: 5686 - protein, 77 aa, Escherichia coli
MKKTLLIAASLSFFSASALATPDCVTGKVEYTKYNDDDTFTVKVGDKELFTNRWNLQSLLLSAQITGMTVTIKTNAC

SEQ ID NO: 5687 - protein, 44 aa, Escherichia coli
EYWTSRWNLQPLLQSAQLTGMTVTIKSSTCESGSGFAEVQFNND

SEQ ID NO: 5688 - protein, 835 aa, Escherichia coli
MKNNTSFAINGITYALLFSLAGAPTYAVDFNTDVLDAADRQNIDFSRFSQAGYIMPGQYQMEIMVNDQGISPSAFPVTFLEQPASVADGKKMLPQPCLTAEMVSRMGLTEASQKKVTYWNNGQCADLSQLPGVEIRPNLAEGMLYINMPQAWLEYSDASWLPPSRWDNGIPGLLFDYNLNGTVNKPHKGKQSQSLSYNGTAGANFGAWRLRADYQGNLNHTTGSGQGTDSQFTWSRFYMYRAIPRWRANLTLGENYINSEVFSSWRYTGASLESDDRMLPPKLRGYAPQVSGIADTNARVVISQQGRILYDSTVPAGPFTIQDLDSSVRGRLDVEVIEQDGRKKTFQVDTAYVPYLTRPGQIRYKLVSGRSRNYEHTTEGPVFAAGEASWGISNKWSLYGGGIVAGDYNALAVGLGRDLNEFGTVSADMTQSVARIPGEETKKGKSWRLSYSKRFDDVNADITFVGYRFSERNYMTMDQYLNARYRNDFTGREKELYTATFNKSFEDWNTSVNLQYSHQTYWDRRASDYYTLSVNRYFDAFGFKNVSLGLSASRSKYQKRDNDSAFVRLSVPWGTGTASYSGSMSNDRYTNTVGYSDTLNKGLSSYNLNAGVSSGGGQPSQSQMSAYYNHSSPLASLSANFSAVENGYTSFGMSASGGATITAKGAALHAGGMNGGTRLLVDTDGVGGVPVDGGRVATNRWGVGVVTDVSSYYRNTTSVDLNRLPEDMEATRSVVESVLTEGAIGYREFEVLKGSRLFAVLRLADNSYPPFGASVTNAKGRELGMVADSGLAWLSGVSPDETLSVDWDGRTQCVVDIPAKLDPAQQLLLHCRKTK

SEQ ID NO: 5689 - protein, 243 aa, Escherichia coli
MLKMKPALKKTLMAVACLSTVPAAQAAISLDRTRVIFNGGEKSMTLNIANDNKQLPYLAQAWVENEKKEKITTGPLIATPPVQRLEPDSKSMVRLTSTPDINRLPQDRESLFYFSLREIPPKSDKANVLQIALQTKIKLFYRPESIKAKPNAVWQDQLVLNKTTGGYQIENPTPYYVTVIGIGGNEKQAREGEFDAVMLAPKSTQMVKSGTYSTPYLSYINDYGGRPVLQFSCAGSRCTAVKK

SEQ ID NO: 5690 - protein, 104 aa, Escherichia coli
MAPQSITELCSEYRNTQIYTINDKILSYTESMAGKREMVIITFKSGATFQVEVPGSQHIDSQKKAIERMKDTLRITYLTETKIDKLCVWNNKTPNSIAAISMEN

SEQ ID NO: 5691 - protein, 860 aa, Escherichia coli
MRDTSSGRMKTGVTGLALAVMVACVMFRAESGIARTYSFDAAMLKGGGKGVDLTLFEEGGQLPGIYPVDIILNGSRVDSQEMAFHAERDAEGRPYLKTCLTREMLARYGVRIEEYPALFRASGEGRGASVAEEACADLTAIPQATESYQFAAQQLVLGIPQVALRPQLRGIAPEALWDDGIPAFLLNWQANAGRSEYRGYGKRVTDSYWVSLQPGINIGPWRVRNLTTWNRSSGQSGKWESSYIRAERGLNGIKSRLTLGEDYTPSDIFDSVPFRGAMMSSDESMVPYNLREFAPVVRGIARTQARIEVRQNGYLIQSQTVAPGAFALTDLPVTGSGSDLQVTVLESDGTAQVFTVPFTTPAIALREGYLKYNVTAGQYRSSDDAVEHTSLGQVTAMYGLPWGLTVYGGLQGAEHYQSAALGLGWSLGRLGAVSLDTTHSRGQQKGHDYETGDTWRIRYNKSFELTGTSFTAASYQYSSDGYHTLPDVLDTWRDDRYAYRHTENRSRRTTLSLSQSLGQWGYVGLNGSRDEYRDRPHRDYFGASYSTSWNNISLSVNWSRNRNSGGYYGGWSRTEDSVSMWMSVPLGRWFGGTDNDISATAQMQRSTGQDTRYEAGLNGRAFDRRLYWDVREQMVPGSESHADTSRLNLTWYGTYGELTGMYSYSSTMRQLNAGMSGSMVAHSEGVTFGQRTGDTVALIAAPGVSGASVGGWPGVRTDFRGYTLAGYASPYQENVLTLDPTTFPEDAEVPQTDSRVVPTKGAVVRAGFRTRVGGRALVSLARQDGTPLPFGAVVTVEGEAGQAAGSAGVVGDRGEVYLSGLKESGKLKAQWGENSLCHADYRLPEEKGPAGIFLTRTVCM

SEQ ID NO: 5692 - protein, 247 aa, Escherichia coli
MKMRAVAVFTGMLTGVLSVTGLLSAGAYAAGGEGNMSASATETNARVFSLHLGATRVVYNPASSGETLTVINDQDYPMLVQSEVLSEDQKSPAPFVVTPPLFRLDGQQSSRLRIVRTGGEFPSDRESLQWICVKGIPPKEDDRWAEGKDGEKKADKVSLNVQLSVSSCIKLFVRPPAVKGQPDDVAGKVEWQRAGNRLKGVNPTPFYINLSALTVGGKEVKEREYIAPFSSREYPLPAGHRVRFSGR

SEQ ID NO: 5693 - protein, 860 aa, Escherichia coli
MRDTSSGRMKTGVTGLALAVMVACVMFRAESGIARTYSFDAAMLKGGGKGVDLTLFEEGGQLPGIYPVDIILNGSRVDSQEMAFHAERDAEGRPYLKTCLTREMLARYGVRIEEYPALFRVSGEGRGASVAEEACADLTAIPQATESYQFAAQQLVLGIPQVALRPQLRGIAPEALWDDGIPAFLLNWQANAGRSEYRGYGKRVTDSYWVSLQPGINIGPWRVRNLTTWNRSSGQSGKWESSYIRAERGLNGIKSRLTLGEDYTPSDIFDSVPFRGAMMSSDESMVPYNLREFAPVVRGIARTQARIEVRQNGYLIQSQTVAPGAFALTDLPVTGSGSDLQVTVLESDGTAQVFTVPFTTPAIALREGYLKYNVTAGQYRSPDDAVEHTSLGQVTVMYGLPWGLTVYGGVQGAEHYQAAALGLGWSLGRLGAVSLDTTHSRGQQKGHDYETGDTWRIRYNKSFELTGTSFTAASYQYSSDGYHTLPDVLDTWRDDRYTYRHTENRSRRTTLSLSQSLGQWGYVGLNGSRDEYRDRPHRDYFGASYSTSWNNISLSVNWSRNRNSGGYYGGWSRTEDSVSMWMSVPLGRWFGGTDNDISATAQMQRSTGQDTRYEAGLNGRAFDRRLYWDVREQMVPGSESHADTSRLNLTWYGTYGELTGMYSYSSTMRQLNAGMSGSMVAHSEGVTFGQRTGDTVALIAAPGVSGASVGGWPGVRTDFRGYTLAGYASPYQENVLTLDPTTFPEDAEVPQTDSRVVPTKGAVVRAGFRTRVGGRALVSLARQDGTPLPFGAVVTVEGEAGQAAGSAGVVGDRGEVYLSGLKESGKLKAQWGENSLCHADYRLPEEKGPAGIFLTRTVCM

SEQ ID NO: 5694 - protein, 860 aa, Escherichia coli
MRDTSSGRMKTGVTGLALAVMVACVMFRAESGIARTYSFDAAMLKGGGKGVDLTLFEEGGQLPGIYPVDIILNGSRVDSQEMAFHAERDAEGRPYLKTCLTREMLARYGVRIEEYPALFRVSGEGRGASVAEEACADLTAIPQATESYQFAAQQLVLGIPQVALRPQLRGIAPEALWDDGIPAFLLNWQANAGRSEYRGYGKRVTDSYWVSLQPGINIGPWRVRNLTTWNRSSGQSGKWESSYIRAERGLNGIKSRLTLGEDYTPSDIFDSVPFRGAMMSSDESMVPYNLREFAPVVRGIARTQARIEVRQNGYLIQSQTVAPGAFALTDLPVTGSGSDLQVTVLESDGTAQVFTVPFTTPAIALREGYLKYNVTAGQYRSPDDAVEQTSLGQVTVMYGLPWGLTVYGGVQGAEHYQAAALGLGWSLGRLGAVSLDTTHSRGQQKGHDYETGDTWRIRYNKSFELTGTSFTAASYQYSSDGYHTLPDVLDTWRDDRYTYRHTENRSRRTTLSLSQSLGQWGYVGLNGSRDEYRDRPHRDYFGASYSTSWNNISLSVNWSRNRNSGGYYGGWSRTEDSVSMWMSVPLGRWFGGTDNDISATAQMQRSTGQDTRYEAGLNGRAFDRRLYWDVREQMVPGSESHADTSRLNLTWYGTYGELTGMYSYSSTMRQLNAGMSGSMVAHSEGVTFGQRTGDTVALIAAPGVSGASVGGWPGVRTDFRGYTLAGYASPYQENVLTLDPTTFPEDAEVPQTDSRVVPTKGAVVRAGFRTRVGGRALVSLARQDGTPLPFGAVVTVEGEAGQAAGSAGVVGDRGEVYLSGLKESGKLKAQWGENSLCHADYRLPEEKGPAGIFLTRTVCM

SEQ ID NO: 5695 - protein, 247 aa, Escherichia coli
MKMRAVAVFTGMLTGVLSVTGLLSAGAYAAGGEGNMSASATETNARVFSLHLGATRVVYNPASSGETLTVINDQDYPMLVQSEVLSEDQKSPAPFVVTPPLFRLDGQQSSRLRIVRTGGEFPSDRESLQWICVKGIPPKEGDRWAEGKDGEKKADKVTLNVQLSVSSCIKLFVRPPAVKGRPDDVAGKVEWQRAGNRLKGVNPTPFYINLSALTVGGKEVKEHEYIAPFSSREYPLPAGHRVRFSGR

SEQ ID NO: 5696 - protein, 860 aa, Escherichia coli
MRDTSSGRMRTGVTGLALAVMVACVMFRAESGIARTYSFDAAMLKGGGKGVDLTLFEEGGQLPGIYPVDIILNGSRVDSQEMTFHAERDAEGRPYLKTCLTREMLARYGVRIEEYPALFRVSGEGRGASVAEEACADLTAIPQATESYQFAAQQLVLGIPQVALRPQLRGIAPEALWDDGIPAFLLNWQANAGRSEYRGYGKRVTDSYWVSLQPGINIGPWRVRNLTTWNRSSGQSGKWESSYIRAERGLNGIKSRLTLGEDYTPSDIFDSVPFRGAMMSSDESMVPYNLREFAPVVRGIARTQARIEVRQNGYLIQSQTVAPGAFALTDLPVTGSGSDLQVTVLESDGTAQVFTVPFTTPAIALREGYLKYNVTAGQYRSPDDAVEQTSLGQVTAMYGLPWGLTVYGGVQGAEHYQAAALGLGWSLGRLGAVSLDTTHSRGQQKGHDYETGDTWRIRYNKSFELTGTSFTAASYQYSSDGYHTLPDVLDTWRDDRYTYRHTENRSRRTTLSLSQSLGQWGYVGLNGSRDEYRDRPHRDYFGASYSTSWNNISLSVNWSRNRNSGGYYGGWSRTEDSVSMWMSVPLGRWFGGTDNDISATAQMQRSTGQDTRYEAGLNGRAFDRRLYWDVREQMVPGSESHADTSRLNLTWYGTYGELTGMYSYSSTMRQLNAGMSGSMVAHSEGVTFGQRSGDTVALIAAPGVSGASVGGWPGVRTDFRGYTLAGYASPYQENVLTLDPTTFPEDAEVPQTDSRVVPTKGAVVRAGFRTRVGGRALVSLARQDGTPLPFGAVVTVEGEAGQAAGSAGVVGDRGEVYLSGLKESGKLKAQWGENSLCHADYRLPEEKGPAGIFLTRTVCM

SEQ ID NO: 5697 - protein, 512 aa, Escherichia coli
MKKISFFIFTALFCCSAQAAPSSLEKRLGKNEYFIITKSSPVRVILNDFAANYSIPVFISSSVNDDFSGEIKNEKPVKVLEKLSKLYHLTWYYDENILYIYKTNEISRSIITPTYLDIDSLLKYLSDTISVNKNSCNVRKITTFNSIEVRGVPECIKYITSLSESLDKEAQSKAKNKDVVKVFKLNYASATDITYKYRDQNVVVPGVVSILKTMASNGSLPSTGKGAVERSGNLFDNSVTISADPRLNAVVVKDREITMDIYQQLISELDIEQRQIEISVSIIDVDANDLQQLGVNWSGTLNAGQGTIAFNSSTAQANISSSVISNASNFMIRVNALQQNSKAKILSQPSIITLNNMQAILDKNVTFYTKVSGEKVASLESITSGTLLRVTPRILDDSSNSLTGKRRERVRLLLDIQDGNQSTNQSNAQDASSTLPEVQNSEMTTEATLSAGESLLLGGFIQDKESSSKDGIPLLSDIPVIGSLFSSTVKQKHSVVRLFLIKATPIKSASSE

SEQ ID NO: 5698 - protein, 1024 aa, Escherichia coli
MPTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGSAENIGDNLGKAGGILSTFQNFLGTALSSMKIDELIKKQKSGGNVSSSEMAEASIELINQLVDTAASLNNNVNSFSQQLNTLGSVLSNTKHLNGVGNKLQNLPNLDNIGAGLDTVSGILSAISASFILSNADADTRTKAAAGVELTTKVLGNVGKGISQYIIAQRAAQGLSTSAAAAGLIASAVTLAISPLSFLSIADKFKRANKIEEYSQRFKKLGYDGDSLLAAFHKETGAIDASLTTISTALASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKTDEFQKQVFDPLKGNIDLSDSKSSTLLKFVTPLLTPGEEIRERRQSGKYEYITELLVKGVDKWTVKGVQDKGAVYDYSNLIQHASVGNNQYREIRIESHLGDGDDKAFLSAGSANIYAGKGHDVVYYDKTDTGYLTIDGTKATEAGNYTVTRVLGGDVKVLQEVVKEQEVSVGKRTEKTQYRSYEFTHINGKNLTETDNLYSVEELIGTTRADKFFGSKFTDIFHGADGDDLIEGNDGNDRLYGDKGNDTLSGGNGDDQLYGGDGNDKLIGGAGNNYLNGGDGDDELQVQGNSLAKNVLSGGKGNDKLYGSEGADLLDGGEGNDLLKGGYGNDIYRYLSGYGHHIIDDDGGKEDKLSLADIDFRDVAFKREGNDLIMYKAEGNVLSIGHENGITFRNWFEKESGDISNHQIEQIFDKGGRIITPDSLKKALEYQQRNNKASYVYGNDALAYGSQNNLNPLINEISKIISAAGNFDVKEERTAASLLQLSGNASDFSYGRNSITLTTSA

SEQ ID NO: 5699 - protein, 998 aa, Escherichia coli
MTVNKIKNIFNNATLTTKSAFNTASSSVRSAGKKLILLIPDNYEAQGVGINELVKAADELGIEIHRTERDDTAIANQFFGAAEKVVGLTERGVAIFAPQLDKLLQKYQKVGSKIGRTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGSLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNFDDAALLAAFHKETGAIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQSGKYEYMTSLIVNGKDTWSVKGIKNHKGVYDYSKLIQFVEKNNKHYQARMISELGDKDDVVYSGAGSSEVFAGEGHDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYRQNYGHHTIADEGGKGDRLHLSDISFDDIAFKRVGNDLIMNKAINGVLSFNESNDVNGITFKNWFAKDASGADNHLVEVITDKDGREIKVDKIPHNNNERSGYIKASNIASEKNMVNITSVANDINKIISSVSGFDSGDERLASLYNLSLHQNNTHSTTLTTTV

SEQ ID NO: 5700 - protein, 367 aa, Escherichia coli
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGREALRQNGDGVGGSITYDYEGFGIGAAVSSSKRTDDQNSPLYIGNGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLVYQF

SEQ ID NO: 5701 - protein, 191 aa, Escherichia coli
MSTSYDFDFGLSLGAAYSNSDRTDNQVHKGTHNTRYGDRFDATAGGETAEAWTVGAKYDANNVYLAAMYAEPRNMTGYGDADAIANKTQNFEVVAQYQFDFGLRPSIAYLQSKGKDLGGVNSDNFDSQGNHHYTNKDLVKYVDIGMTYYFNKNMSTYVDYKINLLDNDDDFYKENGIATDDIVAVGLVYQF

SEQ ID NO: 5702 - protein, 883 aa, Escherichia coli
MTAFRAAFKAYRMHQVLLLPRFARLTIALSLATAVFPVDAEYYFNPRFLSNDLAESVDLSAFTKGREAPPGTYRVDIYLNDEFMTSRDITFITDDNNADLIPCLSTDLLVSLGIKKSALLDNKEHSAEKHVPDNSACTPLQDRLVDASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPRFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDSNEQTQFIDYFNLFYSKRGQEQISISQQLGNYGATFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSTLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 5703 - protein, 189 aa, Escherichia coli
MPARHLYFIMTNTWNRLALLIFAVLSLLVAGELQAGVVVGGTRFIFPADRESISILLTNTSQESWLINRKINRPTRWAGGEASTVPAPLLAAPPLILLKPGTTGTLRLLRTESDILPVDRETLFELSIASVPSGKVENQSVKVAMRSVFKLFWRPEGCRATRWKLINNYAGHGSRRVYNSLTQRLITLT

SEQ ID NO: 5704 - protein, 189 aa, Escherichia coli
MPARHLYFIMTNTWNRLALLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGCRATRWKLINNYAGHGSRRVYNSLTQRLITLT

SEQ ID NO: 5705 - protein, 784 aa, Escherichia coli
MKKRIPTLLATMIATALYSQQGLAADLASQCMLGVPSYDRPLVQGDTNDLPVTINANHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVSIFYSPYLQLPVGDKRRSGFLIPNAKYTTTNYFEFYLPYYWNIAPNMDATITPHYMHRRGNIMWENEFRYLSQAGAGLMELDYLPSDKVYEDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLDESVNRVMPQFKVDGKMVFERDMEMLAPGYTQTLEPRAQYLYVPYRDQSDIYNYDSSLLQSDYSGLFRDRTYGGLDRIASANQVTTGVTSRIYDDAAVERFNISVGQIYYFTESRTGDDNITWENDDKTGSLVWAGDTYWRISERWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 5706 - protein, 878 aa, Escherichia coli
MSYLNLRLYQRNTQCLHIRKHRLAGFFVRLFVACAFAVQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 5707 - protein, 878 aa, Escherichia coli
MSYLNLRLYQRNTQCLHIRKHRLAGFFVRLFVACAFAVQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLARNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 5708 - protein, 878 aa, Escherichia coli
MSYLNLRLYQRNTQCLHIRKHRLAGFFVRLFVACAFAVQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPLAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 5709 - protein, 241 aa, Escherichia coli
MSNKNVNVRKSQEITFCLLAGILMFMAMMVAGRAEAGVALGATRIIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 5710 - protein, 241 aa, Escherichia coli
MSNKNVNVRKSQEITFCLLAGILMFMAMMVAGRAEAGVALGATRIIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTLYYLTVTELNAGARVLENALVPPMGESTVKLPSDAGSNITYRTINDYGALTPKMTGVME

SEQ ID NO: 5711 - protein, 478 aa, Escherichia coli
MTRIKINARRIFSLLIPFFFFTSVHAEQTAAPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 5712 - protein, 478 aa, Escherichia coli
MTRIKINARRIFSLLIPFFFFTSVHAEQTAAPAKPVTVEAKNETFAPQHPDQYLSWKATSEQSERVDALAEDPRLVILWAGYPFSHDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 5713 - protein, 237 aa, Escherichia coli
MRKITQAISAVCLLFALNSSAVALASSPSPLNPGTNVARLAEQAPIHWVSVAQIENSLAGRPPMAVGFDIDDTVLFSSPGFWRGKKNFSPESEDYLKNPVFWEKMNNGWDEFSIPKEVARQLIDMHVRRGDAIFFVTGRSPTKTETVSKTLADNFHIPATSMNPVIFAGDKPGQNTKSQWLQDKNIRIFYGDSDNDITAARDVGARGIRILRASNSTYKPLPQAGAFGEEVIVNSEY

SEQ ID NO: 5714 - protein, 446 aa, Escherichia coli
MMITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEVNPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYNGDSKVNPNYGKAVPADFNGGSFGRGDSDEWTFGAQMEIWW

SEQ ID NO: 5715 - protein, 614 aa, Escherichia coli
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGGSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQPDNDGFLSKTLYGALEHNFTDAWSGFVRGYGYDNRTNYDAYYSPGSPLVDTRKLYSQSWDAGLRYNGELIKSQLITSYSHSKDYNYDPHYGRYDSSATLDEMKQYTVQWANNIIIGHGNVGAGVDWQKQSTAPGTAYVKDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 5716 - protein, 614 aa, Escherichia coli
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQPDNDGFLSKTLYGALEHNFTDAWSGFVRGYGYDNRTNYDAYYSPGSPLVDTRKLYSQSWDAGLRYNGELIKSQLITSYSHSKDYNYDPHYGRYDSSATLDEMKQYTVQWANNIIIGHGNVGAGVDWQKQSTAPGTAYVKDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 5717 - protein, 208 aa, Escherichia coli
MKKIWLALAGLVLAFSASAAQYEDGKQYTTLEKPVAGAPQVLEFFSFFCPHCYQFEEVLHISDNVKKKLPEGVKMTKYHVNFMGGDLGKDLTQAWAVAMALGVEDKVTVPLFEGVQKTQTIRSASDIRDVFINAGIKGEEYDAAWNSFVVKSLVAQQEKAAADVQLRGVPAMFVNGKYQLNPQGMDTSNMDVFVQQYADTVKYLSEKK

SEQ ID NO: 5718 - protein, 412 aa, Escherichia coli
MKQWIAALLLMLIPGVQAAKPQKVTLMVDDVPVAQVLQALAEQEKLNLVVSPDVSGTVSLHLTDVPWKQALQTVVKSAGLITRQEGNILSVHSIAWQNDNIARQEAEQARAQANLPLENRNITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLALELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 5719 - protein, 412 aa, Escherichia coli
MKQWIAALLLMLIPGVQAAKPQKVTLMVDDVPVAQVLQALAEQEKLNLVVSPDVSGTVSLHLTDVPWKQALQTVVKSAGLITRQEGNILSVHSIAWQNDNIARQEAEQARAQANLPLENRNITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 5720 - protein, 331 aa, Escherichia coli
MELLCPAGNLPALKAAIENGADAVYIGLKDDTNARHFAGLNFTEKKLQEAVSFVHQHRRKLHIAINTFAHPDGYARWQRAVDMAAQLGADALILADLAMLEYAAERYPHIERHVSVQASATNEEAINFYHRHFDVARVVLPRVLSIHQVKQLARVTPVPLEVFAFGSLCIMSEGRCYLSSYLTGESPNTVGACSPARFVRWQQTPQGLESRLNEVLIDRYQDGENAGYPTLCKGRYLVDGERYHALEEPTSLNTLELLPELMAANIASVKIEGRQRSPAYVSQVAKVWRQAIDRCKADPQNFVPQSAWMETLGSMSEGTQTTLGAYHRKWQ

SEQ ID NO: 5721 - protein, 678 aa, Escherichia coli
MVPSTFSRLKAARCLPVVLAALIFVGCGTHTPDQSTAYMQGTAQADSAFYLQQMQQSSDDTRINWQLLAIRALVKEGKTGLAVELFNQLPQELNDSQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTADGVASPAQASVSDLTGDQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGTPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 5722 - protein, 678 aa, Escherichia coli
MVPSTFSRLKAARCLPVVLAALIFVGCGTHTPDQSTAYMQGTAQADSAFYLQQMQQSSDDTRINWQLLAIRALVKEGKTGQAVELFNQLPQELNDSQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTADGVASPAQASVSDLTGDQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGTPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 5723 - protein, 838 aa, Escherichia coli
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYNFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSVNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 5724 - protein, 231 aa, Escherichia coli
MSKRTFAMIFTLLCSFCIGQALAGGIVLQRTRVIYDASRKEAALPVANKGAETPYLLQSWVDNIDGTSRAPFIITPPLIRLEAGDDSSLRIIKTADNLPENKESLFYINVRAIPAKKKSDDVNANELTLVFKTRIKMFYRPAHLKGRVSDAWKSLEFKRSDHSLNIYNPTEYYVVFAGLAVDKADLTSKIEYIAPGEHKQLPLPASGGKNVKWAAINDYGGSSGTETRPLQ

SEQ ID NO: 5725 - protein, 360 aa, Escherichia coli
MMKKYLALALIAPLLISCSTTKKGGTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 5726 - protein, 360 aa, Escherichia coli
MMKKYLALALIAPLLISCSTTKKGGTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPTSNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 5727 - protein, 432 aa, Escherichia coli
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 5728 - protein, 472 aa, Escherichia coli
MSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKETKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMQDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 5729 - protein, 472 aa, Escherichia coli
MSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKETKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 5730 - protein, 274 aa, Escherichia coli
MNKTAIALLALLASSVSLAATPWQKITQPVPGSAQSIGSFSNGCIVGADTLPIQSEHYQVMRTDQRRYFGHPDLVMFIQRLSSQVSNLGMGTVLIGDMGMPAGGRFNGGHASHQTGLDVDIFLQLPKTRWTSAQLLRPQALDLVSRDGKHVVSTLWKPEIFSLIKLAAQDKDVTRIFVNPAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 5731 - protein, 274 aa, Escherichia coli
MNKTAIALLALLASSVSLAATPWQKITQPVPGSAQSIGSFSNGCIVGADTLPIQSEHYQVMRTDQRRYFGHPDLVMFIQRLSSQVSNLGMGTVLIGDMGMPAGGRFNGGHASHQTGLDVDIFLQLPKTRRTSAQLLRPQALDLVSRDGKHVVSTLWKPEIFSLIKLAAQDKDVTRIFVNPAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 5732 - protein, 200 aa, Escherichia coli
MLAFCRSSLKSKKYFIILLALAAIAGLGTHAAWSSNGLPRIDNKTLGRLAQQHPVVVLFRHAERCDRSTNQCLSDKTGITVKGTQDARELGNAFSADIPDFDLYSSNTVRTIQSATWFSAGKKLTVDKRLLQCGNEIYSAIKDLQSKAPDKNIVIFTHNHCLTYIAKDKRDATFKPDYLDGLVMHVEKGKVYLDGEFVNH

SEQ ID NO: 5733 - protein, 200 aa, Escherichia coli
MLAFCRSSLKSKKYFIILLALAAIAGLGTHAAWSSNGLPRIDNKTLGRLAQQHPVVVLFRHAEHCDRSTNQCLSDKTGITVKGTQDARELGNAFSADIPDFDLYSSNTVRTIQSATWFSAGKKLTVDKRLLQCGNEIYSAIKDLQSKAPDKNIVIFTHNHCLTYIAKDKRDATFKPDYLDGLVMHVEKGKVYLDGEFVNH

SEQ ID NO: 5734 - protein, 162 aa, Escherichia coli
MKTILPAVLFAAFATTSAWAAESVQPLEKIAPYPQAEKGMKRQVIQLTPQEDESTLKVELLIGQTLEVDCNLHRLGGKLESKTLEGWGYDYYVFDKVSSPVSTMMACPDGKKEKKFVTAYLGDTGMLRYNSKLPIVVYTPDNVDVKYRVWKAEEKIDNAVVR

SEQ ID NO: 5735 - protein, 828 aa, Escherichia coli
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQDVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 5736 - protein, 659 aa, Escherichia coli
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFTANGVPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 5737 - protein, 122 aa, Escherichia coli
MEKNMKKRGAFLGLLLVSACASVFAANNETSKSVTFPKCEGLDAAGIAASVKRDYQQNRVARWADDQKIVGQADPVAWVSLQDIQGKDDKWSVPLTVRGKSADIHYQVSVDCKAGMAEYQRR

SEQ ID NO: 5738 - protein, 111 aa, Escherichia coli
MKKQIEGMTMKKVLALVVAAAMGLSSAAFAAETATTPAPTATTTKAAPAKTTHHKKQHKAAPAQKAQAAKKHHKNTKAEQKAPEQKAQAAKKHAKKHSHQQPAKPAAQPAA

SEQ ID NO: 5739 - protein, 111 aa, Escherichia coli
MKKQIEGMTMKKVLALVVAAAMGLSSAAFAAETATTPAPTATTTKAAPAKTTHHKKQHKAAPAQKAQAAKKHHKNTKAEQKAPEQKAQSAKKHAKKHSHQQPAKPAAQPAA

SEQ ID NO: 5740 - protein, 700 aa, Escherichia coli
MKIVFVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTKAEWKANPQQAPRAEQYDTRKTIKQTQAGLRYERSLSSRDDMSVMMYAGERETTQYQSIPMAPQLNPSHAGSVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGMEARYMGDIMADDENTAKAPSYTLVGLFTGYKYNYHNLTVDLFGRVDNLFDKEYVGSVIVNESNGRYYEPAPGRNYGVGVNIAWRFE

SEQ ID NO: 5741 - protein, 667 aa, Escherichia coli
MAKIAAIFQLLDKNVTVSSHRLELLSPARDAAIAREAILHGADAVYIGGPGFGARHNASNSLKDIAELVPFAHRYGAKIFVTLNTILHDDELEPAQRLITDLYQTGVDALIVQDMGILELDIPPIELHASTQCDIRTVEKAKFLSDVGFTQIVLARELNLDQIRAIHQATDATIEFFIHGALCVAYSGQCYISHAQTGRSANRGDCSQACRLPYTLKDDQGRVVSYEKHLLSMKDNDQTANLGALIDAGVRSFKIEGRYKDMSYVKNITAHYRQMLDAIIEERGDLARASSGRTEHFFVPSTEKTFHRGSTDYFVNARKGDIGAFDSPKFIGLPVGEVVKVAKDHLDVAVTEPLANGDGLNVLIKREVVGFRANTVEKTGENQYRVWPNEMPADLHKIRPHHPLNRNLDHNWQQALTKTSSERRVAVDIELGGWQEQLILTLTSEEGVSITHTLDGQFDEANNAEKAMNNLKDGLAKLGQTLYYARDVQINLPGALFVPNSLLNQFRREAADMLDAARLASYQRGSRKPVADPAPVYPQTHLSFLANVYNQKAREFYHRYGVQLIDAAYEAHEEKGEVPVMITKHCLRFAFNLCPKQAKGNIKSWKATPMQLVNGDEVLTLKFDCRPCEMHVIGKIKNHILKMPLPGSVVASVSPDELLKTLPKRKG

SEQ ID NO: 5742 - protein, 551 aa, Escherichia coli
MDRRRFIKGSMAMAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 5743 - protein, 207 aa, Escherichia coli
MPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTADDAEEMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 5744 - protein, 213 aa, Escherichia coli
MTKMSRYALITALAMFLAGCVGQREPAPVEEVKPAPEQPAEPQQPVPTVPSVPTIPQQPGPIEHEDQTAPPAPHIRHYDWNGAMQPMVSKMLGADGVTAGSVLLVDSVNNRTNGSLNAAEATETLRNALANNGKFTLVSAQQLSMAKQQLGLSPQDSLGTRSKAIGIARNVGAHYVLYSSASGNVNAPTLQMQLMLVQTGEIIWSGKGAVSQQ

SEQ ID NO: 5745 - protein, 729 aa, Escherichia coli
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 5746 - protein, 232 aa, Escherichia coli
MQKNAAHTYAISSLLVLSLTGCAWIPSTPLVQGATSAQPVPGPTPVANGSIFQSAQPINYGYQPLFEDRRPRNIGDTLTIVLQENVSASKSSSASASRDGKTNFGFDTVPRYLQGLFGNARADVEASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 5747 - protein, 232 aa, Escherichia coli
MQKNAAHTYAISSLLVLSLTGCAWIPSTPLVQGATSAQPVPGPTPVANGSIFQSAQPINYGYQPLFEDRRPRNIGDTLTIVLQENVSASKSSSANASRDGKTNFGFDTVPRYLQGLFGNARADVEASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 5748 - protein, 191 aa, Escherichia coli
MKKSLLGLTFASLMFSAGSAVAADYKIDKEGQHAFVNFRIQHLGYSWLYGTFKDFDGTFTFDEKNPAADKVNVTINTTSVDTNHAERDKHLRSADFLNTAKYPQATFTSTSVKKDGDELDITGDLTLNGVTKPVTLEAKLIGQGDDPWGGKRAGFEAEGKIKLKDFNIKTDLGPASQEVDLIISVEGVQQK

SEQ ID NO: 5749 - protein, 511 aa, Escherichia coli
MMKMRWLSAAVMLTLYTSSSWAFSIDDVAKQAQSLAGKGYEAPKSNLPSVFRDMKYADYQQIQFNHDKAYWNNLKTPFKLEFYHQGMYFDTPVKINEVTATAVKRIKYSPDYFTFGDVQHDKDTVKDLGFAGFKVLYPINSKDKNDEIVSMLGASYFRVIGAGQVYGLSARGLAIDTALPSGEEFPRFKEFWIERPKPTDKRLTIYALLDSPRATGAYKFVVMPGRDTVVDVQSKIYLRDKVGKLGVAPLTSMFLFGPNQPSPANNYRPELHDSNGLSIHAGNGEWIWRPLNNPKHLAVSSFSMENPQGFGLLQRGRDFSRFEDLDDRYDLRPSAWVTPKGEWGKGSVELVEIPTNDETNDNIVAYWTPDQLPEPGKEMNFKYTITFSRDEDKLHAPDNAWVQQTRRSTGDVKQSNLIRQPDGTIAFVVDFTGAEMKKLPEDTPVTAQTSIGDNGEIVESTVRYNPVTKGWRLVMRVKVKDAKKTTEMRAALVNADQTLSETWSYQLPANE

SEQ ID NO: 5750 - protein, 653 aa, Escherichia coli
MRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDIYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLSEYGSFYLSGSQQTYWHTDQQDRLLQFGYNTQIKDLSLGISWNYSKSRGQPDADQVFALNFSLPLNLLLSRSNDSYTSKKNYAWMTSNTSIDNEGHTTQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGISLRFGAIATLDGVQTNSGIIDDDGSLYMAGLPAKGTITVRWGEAPDQICHISYELTEQQINSAITRMDAICR

SEQ ID NO: 5751 - protein, 653 aa, Escherichia coli
MRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDIYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLSEYGSFYLSGSQQTYWHTDQQDRLLQFGYNTQIKDLSLGISWNYSKSRGQPDADQVFALNFSLPLNLLLSRSNDSYTSKKNYAWMTSNTSIDNEGHTTQNLGLTETLLDDGNLSYSVQQGYNSEGKTANGSASMDYKGVFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGISLRFGAIATLDGVQTNSGIIDDDGSLYMAGLPAKGTITVRWGEAPDQICHISYELTEQQINSAITRMDAICR

SEQ ID NO: 5752 - protein, 233 aa, Escherichia coli
MKTCITKGIVTVSLTAILLSCSSTWAAGKGGVGLAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLGEAPAKLRCTSSADMVTVSNPTPYFITLTDLKIGGKLVKNQMISPFDKYQFSLPKGAKNSSVTYRTINDYGAETPQLNCKS

SEQ ID NO: 5753 - protein, 233 aa, Escherichia coli
MKTCITKGIVTVSLTAILLSCSSTWAAGKGGVELAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLGEAPAKLRCTSSADMVTVSNPTPYFITLTDLKIGGKLVKNQMISPFDKYQFSLPKGAKNSSVTYRTINDYGAETPQLNCKS

SEQ ID NO: 5754 - protein, 362 aa, Escherichia coli
MMKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQLLGNGKKAEQWATGLKYDANNIYLAANYGETRNATPITNKFTNISGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 5755 - protein, 204 aa, Escherichia coli
MMKKIAITCALLSSLVASSVWADAASDLKSRLDKVSSFHASFTQKVTDGSGAAVQEGQGDLWVKRPNLFNWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKSQQNGAVDAAKFTFTPPQGVTVDDQRK

SEQ ID NO: 5756 - protein, 760 aa, Escherichia coli
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTATLNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTASIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 5757 - protein, 332 aa, Escherichia coli
MMKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGDEAGHE

SEQ ID NO: 5758 - protein, 430 aa, Escherichia coli
MKQALRVAFGFLILWASVLHAEVRIVIDSGVDSGRPIGVVPFQWAGPGAAPEDIGGIVAADLRNSGKFNPLDRARLPQQPGSAQEVQPAAWSALGIDAVVVGQVTPNPDGSYNVAYQLVDTGGAPGTVLAQNSYKVNKQWLRYAGHTASDEVFEKLTGIKGAFRTRIAYVVQTNGGQFPYELRVSDYDGYNQFVVHRSPQPLMSPAWSPDGSKLAYVTFESGRSALVIQTLANGAVRQVASFPRHNGAPAFSPDGSKLAFALSKTGSLNLYVMDLASGQIRQVTDGRSNNTEPTWFPDSQNLAFTSDQAGRPQVYKVNINGGAPQRITWEGSQNQDADVSSDGKFMVMVSSNGGQQHIAKQDLATGGVQVLSSTFLDETPSLAPNGTMVIYSSSQGMGSVLNLVSTDGRFKARLPATDGQVKFPAWSPYL

SEQ ID NO: 5759 - protein, 430 aa, Escherichia coli
MKQALRVAFGFLILWASVLHAEVRIVIDSGVDSGRPIGVVPFQWAGPGAAPEDIGGIVAADLRNSGKFNPLDRAHLPQQPGSAQEVQPAAWSALGIDAVVVGQVTPNPDGSYNVAYQLVDTGGAPGTVLAQNSYKVNKQWLRYAGHTASDEVFEKLTGIKGAFRTRIAYVVQTNGGQFPYELRVSDYDGYNQFVVHRSPQPLMSPAWSPDGSKLAYVTFESGRSALVIQTLANGAVRQVASFPRHNGAPAFSPDGSKLAFALSKTGSLNLYVMDLASGQIRQVTDGRSNNTEPTWFPDSQNLAFTSDQAGRPQVYKVNINGGAPQRITWEGSQNQDADVSSDGKFMVMVSSNGGQQHIAKQDLATGGVQVLSSTFLDETPSLAPNGTMVIYSSSQGMGSVLNLVSTDGRFKARLPATDGQVKFPAWSPYL

SEQ ID NO: 5760 - protein, 193 aa, Escherichia coli
MRYLATLLLSLAVLITAGCGWHLRDTTQVPSTMKVMILDSGDPNGPLSRAVRNQLRLNGVELLDKETTRKDVPSLRLGAVSISQDTASVFRNGQTAEYQMVMTVSASVLIPGRDIYPISTKVFRSFFDNPQMALAKDNEQEMIIKEMYDRAAEQLIRKLPSIRAADIRSDEEQTSTTTDTPATPARVSTTLGN

SEQ ID NO: 5761 - protein, 746 aa, Escherichia coli
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDNDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGITWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 5762 - protein, 869 aa, Escherichia coli
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGLPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 5763 - protein, 869 aa, Escherichia coli
MKIPTTTDIPQRYTWCLAGICYSSLAILPSFLSYAESYFNPAFLLENGTFVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 5764 - protein, 869 aa, Escherichia coli
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGVPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSSNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQVVTVISAVCTHPGS

SEQ ID NO: 5765 - protein, 230 aa, Escherichia coli
MMTKIKLLMLIIFYLIISASVHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 5766 - protein, 230 aa, Escherichia coli
MMTKIKLLMLIIFYLIISASVHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSLMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 5767 - protein, 351 aa, Escherichia coli
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 5768 - protein, 351 aa, Escherichia coli
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLTTYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 5769 - protein, 161 aa, Escherichia coli
MKKWLLAAGLGLALATSAQAADKIAIVNMGSLFQQVAQKTGVSNTLENEFKGRASELQRMETDLQAKMKKLQSMKAGSDRTKLEKDVMAQRQTFAQKAQAFEQDRARRSNEERGKLVTRIQTAVKSVANSQDIDLVVDANAVAYNSSDVKDITADVLKQVK

SEQ ID NO: 5770 - protein, 266 aa, Escherichia coli
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLLDQYTQLKAQYADKPKKRVFLQFGINPPFTSGKESIQNQVLEVCGGENIFKDSRVPWPQVSREQVLARSPQAIVITGGPDQIPKIKQYWGEQLKIPVIPLTSDWFERASPRIILAAQQLCSALSQVD

SEQ ID NO: 5771 - protein, 266 aa, Escherichia coli
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATNIEQIANALRQLAPWSPQPDKAEQAAQSLLDQYAQLKAQYADKPKKRVFLQFGINPPFTSGKESIQNQVLEVCGGENIFKDSRVPWPQVSREQVLARSPQAIVITGGPDQIPKIKQYWGEQLKIPVIPLTSDWFERASPRIILAAQQLCNALSQVD

SEQ ID NO: 5772 - protein, 266 aa, Escherichia coli
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLLDQYAQLKAQYADKPKKRVFLQFGINPPFTSGKESIQNQVLEVCGGENIFKDSRVPWPQVSREQVLARSPQAIVITGGPDQIPKIKQYWGEQLKIPVIPLTSDWFERASPRIILAAQQLCNALSQVD

SEQ ID NO: 5773 - protein, 747 aa, Escherichia coli
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLECAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLDLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 5774 - protein, 747 aa, Escherichia coli
MARSKTAQPKHSLRKIAVVVATAVSGMSVYAQAAVELKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLDLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 5775 - protein, 747 aa, Escherichia coli
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLDLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 5776 - protein, 364 aa, Escherichia coli
MKVKVLSLLVPALLVAGAANAAEIYNKDGNKLDLYGKVDGLHYFSDNDSKDGDKTYMRLGFKGETQVTDQLTGYGQWEYQIQGNEPESDNSSWTRVAFAGLKFQDVGSFDYGRNYGVVYDVTSWTDVLPEFGGDTYDSDNFMQQRGNGFATYRNTDFFGLVDGLDFAVQYQGKNGSAHGEGMTTNGRDDVFEQNGDGVGGSITYNYEGFGIGAAVSSSKRTWDQNNTGLIGTGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNQFTRAAGINTDDIVALGLVYQF

SEQ ID NO: 5777 - protein, 367 aa, Escherichia coli
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRDALRQNGDGVGGSITYDYEGFGIGAAVSSSKRTDAQNTAAYIGNGDRAETYTGGLKYDANNIYLAAQYTQTYNATRVGSLGWANKAQNFEAVAQYQFDFGLRPSVAYLQSKGKNLGVINGRNYDDEDILKYVDVGATYYFNKNMSTYVDYKINLLDDNQFTRDAGINTDNIVALGLVYQF

SEQ ID NO: 5778 - protein, 363 aa, Escherichia coli
MKVKVLSLLVPALLVAGAANAAEIYNKDGNKLDLYGKVDGLHYFSDNDSKDGDKTYMRLGFKGETQVTDQLTGYGQWEYQIQGNEPESDNSSWTRVAFAGLKFQDVGSFDYGRNYGVVYDVTSWTDVLPEFGGDTYDSDNFMQQRGNGFATYRNTDFFGLVDGLDFAVQYQGKNGSSWRRYDPNGRDDVFEQNGDGVGGSITYNYEGFGIGAAVSSSKRTWDQNNTGLIGTGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNRFTRDAGINTDDIVALGLVYQF

SEQ ID NO: 5779 - protein, 360 aa, Escherichia coli
MKVKVLSLLVPALLVAGAANAAEIYNKDGNKLDLYGKVDGLHYFSDNDSKDGDKTYMRLGFKGETQVTDQLTGYGQWEYQIQGNEPESDNSSWTRVAFAGLKFQDVGSFDYGRNYGVVYDVTSWTDVLPEFGGDTYDSDNFMQQRGNGFATYRNTDFFGLVDGLDFAVQYQGKNGSAHGEGMTTNGRDDVFEQNGDGVGGSITYNYEGFGIGAAVSSSKRTWDQNNTGLIGTGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNQSGINTDDIVALGLVYQF

SEQ ID NO: 5780 - protein, 365 aa, Escherichia coli
MKVKVLSLLVPALLVAGAANAAEIYNKDGNKLDLYGKVDGLHYFSDNDSKDGDKTYMRLGFKGETQVTDQLTGYGQWEYQIQGNEPESDNSSWTRVAFAGLKFQDVGSFDYGRNYGVVYDVTSWTDVLPEFGGDTYDSDNFMQQRGNGFATYRNTDFFGLVDGLDFAVQYQGKNGSAHGEGMTTNGRNDVFEQNGDGVGGSITYNYEGFGIGAAVSSSKRTDAQNNTADYIGTGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNQFTRDAGINTDNIVALGLVYQF

SEQ ID NO: 5781 - protein, 373 aa, Escherichia coli
MKVKVLSLLVPALLVAGAANAAEVYNKDGNKLDLYGKVDGLHYFSDNKSEDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVDGEGMTNNGRGALRQNGDGVGGSITYDYEGFGIGAAVSSSKRTDDQNFGLNGYGERYLGNGDRAETYTGGLKYDANNIYLAAQYTQTYNATRVGSLGWANKAQNFEAVAQYQFDFGLRPSVAYLQSKGKNLGVINGRNYDDEDILKYVDVGATYYFNKNMSTYVDYKINLLDDNRFTRDAGINTDDIVALGLVYQF

SEQ ID NO: 5782 - protein, 367 aa, Escherichia coli
MKVKVLSLLVPALLVAGAANAAEVYNKDGNKLDLYGKVDGLHYFSDNDKVDGDKTYMRLGFKGETQVTDQLTGYGQWEYQIQGNAPESENNSWTRVAFAGLKFQDVGSFDYGRNYGVVYDVTSWTDVLPEFGGDTYDSDNFMQQRGNGFATYRNTDFFGLVDGLNFAVQYQGKNGSVSGEGMTNNGRDALEQNGDGVGGSITYDYEGFGIGAAVSSSKRTDAQNTAAYIGNGDRAETYTGGLKYDANNIYLAAQYTQTYNATRVGSQGWANKAQNFEAVAQYQFDFGLRPSVAYLQSKGKNLGTIGTRNYDDEDILKYVDVGATYYFNKNMSTYVDYKINLLDDNQFTRDAGINTDNIVALGLVYQF

SEQ ID NO: 5783 - protein, 375 aa, Escherichia coli
MKVKVLSLLVPALLVAGAANAAEVYNKDGNKLDLYGEVDGLHYFSDDKSVDGDQTYMRLGFKGETQVTDQLTGYGQWEYQIQGNAPESENNSWTRVAFAGLKFQDIGSIDYGRNYGVVYDVTSWTDVLPEFGGDTYDSDNFMQQRGNGFATYRNTDFFGLVDGLNFAVQYQGQNGSVSGENDPDFTGHGITNNGRKALRQNGDGVGGSITYDYEGFGIGGAISSSKRTWDQNNTGLIGTGDRAETYTGGLKYDANNIYLAAQYTQTYNATRVGSLGWANKAQNFEAVAQYQFDFGLRPSVAYLQSKGKNLGVIKGRNYDDEDILKYVDVGATYYFNKNMSTYVDYKINLLDDNRFTRDAGINTDDIVALGLVYQF

SEQ ID NO: 5784 - protein, 367 aa, Escherichia coli
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGGAISSSKRTDDQNSPLYIGNGDRAETYTGGLKYDANNIYLAAQYTQTYNATRVGSLGWANKAQNFEAVAQYQFDFGLRPSVAYLQSKGKNLGTIAGRNYDDEDILKYVDVGATYYFNKNMSTYVDYKINLLDDNQFTRDAGINTDNIVALGLVYQF

SEQ ID NO: 5785 - protein, 367 aa, Escherichia coli
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGGAISSSKRTDDQNSPLYIGNGDRAETYTGGLKYDANNIYLAAQYTQTYNATRVGSLGWANKAQNFEAVAQYQFDFGLRPSVAYLQSKGKNLGVINGRNYDDEDILKYVDVGATYYFNKNMSTYVDYKINLLDDNRFTRDAGINTDDIVALGLVYQF

SEQ ID NO: 5786 - protein, 367 aa, Escherichia coli
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVNGEGMTNNGRDALRQNGDGVGGSITYDYEGFGIGAAVSSSKRTDAQNTAAYIGNGDRAETYTGGLKYDANNIYLAAQYTQTYNATRVGSLGWANKAQNFEAVAQYQFDFGLRPSVAYLQSKGKNLGTIAGRNYDDEDILKYVDVGATYYFNKNMSTYVDYKINLLDDNQFTRDAGINTDNIVALGLVYQF

SEQ ID NO: 5787 - protein, 368 aa, Escherichia coli
MKVKVLSLLVPALLVAGAANAAEVYNKDGNKLDLYGKVDGLHYFSDNKSEDGDQTYVRLGFKGETQVTDQLTGYGQWEYQIQGNTSEDNKENSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRDALRQNGDGVGGSITYDYEGFGIGAAVSSSKRTDAQNTAAYIGNGDRAETYTGGLKYDANNIYLAAQYTQTYNATRVGSLGWANKAQNFEAVAQYQFDFGLRPSVAYLQSKGKNLGVINGRNYDDEDILKYVDVGATYYFNKNMSTYVDYKINLLDDNRFTRDAGINTDDIVALGLVYQF

SEQ ID NO: 5788 - protein, 374 aa, Escherichia coli
MKVKVLSLLVPALLVAGAANAAEVYNKDGNKLDLYGKVDGLHYFSDNKSEDGDQTYVRLGFKGETQVTDQLTGYGQWEYQIQGNTSEDNKENSWTRVAFAGLKFQDVGSFDYGRNYGVVYDVTSWTDVLPEFGGDTYGSDNFMQQRGNGYATYRNTDFFGLVDGLNFAVQYQGKNGSVSGEGMTNNGRGALRQNGDGVGGSITYDYEGFGIGAAVSSSKRTDDQNFGLNGYGERYLGNGDRAETYTGGLKYDANNIYLAAQYTQTYNATRVGSLGWANKAQNFEAVAQYQFDFGLRPSVAYLQSKGKNLGVINGRNYDDEDILKYVDVGATYYFNKNMSTYVDYKINLLDDNQFTRDAGINTDNIVALGLVYQF

SEQ ID NO: 5789 - protein, 367 aa, Escherichia coli
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGNPSGEGFTSGVTNNGRDALRQNGDGVGGSITYDYEGFGIGGAISSSKRTDAQNTAAYIGNGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNQFTRDAGINTDNIVALGLVYQF

SEQ ID NO: 5790 - protein, 367 aa, Escherichia coli
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQLGNGFATYRNTDFFGLVDGLNFAVQYQGKNGNPSGEGFTSGVTNNGRDALRQNGDGVGGSITYDYEGFGIGGAISSSKRTDAQNTAAYIGNGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNQFTRDAGINTDNIVALGLVYQF

SEQ ID NO: 5791 - protein, 367 aa, Escherichia coli
MKVKVLSLMVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGNPSGEGFTSGVTNNGRDALRQNGDGVGGSITYDYEGFGIGGAISSSKRTDAQNTAAYIGNGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNQFTRDAGINTDNIVALGLVYQF

SEQ ID NO: 5792 - protein, 367 aa, Escherichia coli
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGNPSGEGFTSGVTNNGRDALRQNGDGVGGSITYDYEGFGIGGAISSSKRTDAQNTAAYIGNGDRAETYTGGLKYDANNIYLAAQYPQTYNATRVGSLGWANKAQNFEAVAQYQFDFGLRPSLAYLQSKGKNLGRGYDDEDILKYVDVGATYYFNKNMSTYVDYKINLLDDNQFTRDAGINTDNIVALGLVYQF

SEQ ID NO: 5793 - protein, 336 aa, Escherichia coli
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGNPSGEGFTSGVTNNGRDALRQNGDGVGGSITYDYEGFGIGGAISSSKRTDAQYTQTYNATRVGSLGWANKAQNFEAVAQYQFDFGLRPSLAYLQSKGKNLGRGYDDEDILKYVDVGATYYFNKNMSTYVDYKINLLDDNQFTRDAGINTDNIVALGLVYQF

SEQ ID NO: 5794 - protein, 376 aa, Escherichia coli
MKVKVLSLLVPALLVAGAANAAEVYNKDGNKLDLYGKVDGLHYFSDNKSEDGDQTYVRLGFKGETQVTDQLTGYGQWEYQIQGNTSEDNKENSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGAAVSSSKRTDDQNGSYTSNGVVRNYIGTGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLVYQF

SEQ ID NO: 5795 - protein, 375 aa, Escherichia coli
MKVKVLSLLVPALLVAGAANAAEVYNKDGNKLDLYGKVDGLHYFSDNKSEDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVDGEGMTNNGRGALRQNGDGVGGSITYDYEGFGIGAAVSSSKRTDDQNFGLNGYGERYLGNGDRAETYTGGLKYDANNIYLAAQYTQTYNATRVGSLGWANKAQNFEAVAQYQFDFGLRPSVAYLQSKGKNLGVINGRNYDDEDILKYVDVDVGATYYFNKNMSTYVDYKINLLDDNRFTRDAGINTDDIVALGLVYQF

SEQ ID NO: 5796 - protein, 367 aa, Escherichia coli
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRDALRQNGDGVGGSITYDYEGFGIGAAVSSSKRTDAQNTAAYIGNGDRAETYTGGLKYDANNIYLAAQYTQTYNATRVGSLGWANKAQNFEAVAQYQFDFGLRPSVAYLQSKGKNLGTIAGRNYDDEDILKYVDVGATYYFNKNMSTYVDYKINLLDDNQFTRDAGINTDNIVALGLVYQF

SEQ ID NO: 5797 - protein, 523 aa, Escherichia coli
MPMILVKKNPRGKVIRELSSEEETAVKTVCGLKKPATMAQHNLANDLLREMREYDAWLQCDCIPGDSPAMNFAALKNNTGTLYLSSFNHEHAPECPMYRQLSGNEEETSFGASRHPVSTRINYRNFLPPDDSNSVIRLQTRSAYHNGERSSVRKKRPRLGRLLLSLIEDAGLNKLDSLANPRIRTNYRECLDAIRQVTLQQEYIRGRSLSEIIHFRPGMSERSQERLMETLENSERHWPARRKHMFFQIFMAQHICRDAVEIHWANGNIQVFRPVRGISINGEAQGGIRPPYWVILAFCRSADGRIICSEGYAHALYQLTCPVHFAVQYQGKNGSAHGEGMTTNGRDDVFEQNGDGVGGSITYNYEGFGIGAAVSSSKRTWDQNNTGLIGTGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNRFTRDAGINTDDIVALGLVYQF

SEQ ID NO: 5798 - protein, 860 aa, Escherichia coli
MRDTSSGRMRTGVTGLALAVMVACVMFRAESGIARTYSFDAAMLKGGGKGVDLTLFEEGGQLPGIYPVDIILNGSRVDSQEMAFHAERDAEGRPYLKTCLTREMLARYGVRIEEYPALFRASGEGRGASVAEEACADLTAIPQATESYQFAAQQLVLGIPQVALRPQLRGIAPEALWDDGIPAFLLNWQANAGRSEYRGYGKRVTDSYWVSLQPGINIGPWRVRNLTTWNRSSGQSGKWESSYIRAERGLNGIKSRLTLGEDYTPSDIFDSVPFRGAMMSSDESMVPYNLREFAPVVRGIARTQARIEVRQNGYLIQSQTVAPGAFALTDLPVTGSGSDLQVTVLESDGTAQVFTVPFTTPAIALREGYLKYNVTAGQYRSSDDAVEHTSLGQVTAMYGLPWGLTVYGGLQGAEHYQSAALGLGWSLGRLGAVSLDTTHSRGQQKGHDYETGDTWRIRYNKSFELTGTSFTAASYQYSSDGYHTLPDVLDTWRDDRYAYRHTENRSRRTTLSLSQSLGQWGYVGLNGSRDEYRDRPHRDYFGASYSTSWNNISLSVNWSRNRNSGGYYGGWSRTEDSVSMWMSVPLGRWFGGADNDISTTAQMQRSTGQDTRYEAGLNGRAFDRRLYWDVREQMVPGSESHADTSRLNLTWYGTYGELTGMYSYSSTMRQLNAGMSGSMVAHSEGVTFGQRTGDTVALIAAPGVSGASVGGWPGVRTDFRGYTLAGYASPYQENVLTLDPTTFPEDAEVPQTDSRVVPTKGAVVRAGFRTRVGGRALVSLARQDGTPLPFGAVVTVEGEAGQAAGSAGVVGDRGEVYLSGLKESGKLKAQWGENSLCHADYRLPEEKGPAGIFLTRTVCM

SEQ ID NO: 5799 - protein, 120 aa, Escherichia coli
MNTVLSVQGASAPVKKKSFFSKFTRLNMLRLARAVIPAAVLMMFFPQLAMAAQGQDLMASGNTTVKATFGKDSSVVKWVVLAEVLVGAVMYMMTKNVKFLAGFAIISVFIAVGMAVVGLK

SEQ ID NO: 5800 - protein, 89 aa, Escherichia coli
MKKMFMAVLFALVSVNAMAADCAKGKIEFSKYNEDDTFTVKVDGKEYWTSRWNLQPLLQSAQLTGMTVTIKSSTCESGSGFAEVQFHND

SEQ ID NO: 5801 - protein, 753 aa, Escherichia coli
MNVIKLAIGSGILLLSCGAYSQSISEKTNSDKKGAAEFSPLSVSVGKTTSEQEALEKTGATSSRTTDKNLQSLDATVRSMPGTYTQIDPGQGAISVNIRGMSGFGRVNTMVDGITQSFYGTSTSGTTTHGSTNNMAGVLIDPNLLVAVDVTRGDSSGSEGINALAGSANMRTIGVDDVIFNGNTYGLRSRFSVGSNGLGRSGMIALGGKSDAFTDTGSIGVMAAVSGSSVYSNFSNGSGINSKEFGYDKYMKQNPKSQLYKMDIRPDEFNSFELSARTYENKFTRRDITSDDYYIKYHYTPFSELIDFNVTASTSRGNQKYRDGSLYTFYKTSAQNRSDALDINNTSRFTVADNDLEFMLGSKLMRTRYDRTIHSAAGDPKANQESIENNPFAPSGQQDISALYTGLKVTRGIWEADFNLNYTRNRITGYKPACDSRVICVPQGSYDIDDKEGGFNPSVQLSAQVTPWLQPFIGYSKSMRAPNIQEMFFSNSGGASMNPFLKPERAETWQAGFNIDTRDLLVEQDALRFKALAYRSRIQNYIYSESYLVCSGGRKCSLPEVIGNGWEGISDEYSDNMYIYVNSASDVIAKGFELEMDYDAGFAFGRLSFSQQQTDQPTSIASTHFGAGDITELPRKYMTLDTGVRFFDNALTLGTIIKYTGKARRLSPDFEQDEHTGAIIKQDLPQIPTIIDLYGTYEYNRNLTLKLSVQNLMNRDYSEALNKLNMMPGLGDETHPANSARGRTWIFGGDIRF

SEQ ID NO: 5802 - protein, 628 aa, Escherichia coli
MAKDTITVVATGNQNTVFETPSMVSVVTNDTPWSQNAVTSAGMLKGVAGLSQTGAGRTNGQTFNLRGYDKSGVLVLVDGIRQLSDMAKSSGTYLDPALVKRIEVVRGPNSSLYGSGGLGGVVDFRTADAADFLPPGETNGLSLWGNIASGDHSTGSGLTWFGKTGKTDALLSVIMRKRGNIYQSDGERAPNKEKPAALFAKGSVGITDSNKAGASLRLYRNNTTEPGNPTQTHGDSGLRDRKTVQNDVQFWYQYAPVDNSLINVKSTLYLSDITIKTNGHNKTAEWRNNRTSGVNVVNRSHTLIFPGAHQLSYGAEYYRQQQKPEGSATLYPEGNIDFTSLYFQDEMTMKSYPVNIIVGSRYDRYKSFNPRAGELKAERLSPRAAISVSPTDWLMMYGSISSAFRAPTMAEMYRDDVHFYRKGKPNYWVPNLNLKPENNITREIGAGIQLDGLLTGNDRLQLKGGYFGTDARNYIATRVDMKRMRSYSYNVSRARIWGWDMQGNYQSDYFDWMLSYNRTESMDASSREWLGSGNPDTLISDISIPVGHGGVSAGWRAELSAAATHVKKGDPHQAGYAVHSFSLSYKPVSVKGFEASVTLDNAFNKLAMNGKGVPLSGRTVSLYTRYQW

SEQ ID NO: 5803 - protein, 119 aa, Escherichia coli
MNTVLSVQGASAPVEKKSFFSKFTCLNMLRLVRAVIPVAVLMMLFPELAMAAGKGDLMAKGQETVKATFGKNSSIVKWIVLAEVLVGAVMYMMTKNIKFLVGFAILSVFIAVGMSVAGF

SEQ ID NO: 5804 - protein, 373 aa, Escherichia coli
MKVKVLSLLVPALLVAGAANAAEVYNKDGNKLDLYGKVDGLHYFSDNKSEDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQCGNGFATYRNTDFFGLVDGLNFAVQYQGKNGSVDGEGMTNNGRGALRQNGDGVGGSITYDYEGFGIGAAVSSSKRTDDQNFGLNGYGERYLGNGDRAETYTGGLKYDANNIYLAAQYTQTYNATRVGSLGWANKAQNFEAVAQYQFDFGLRPSVAYLQSKGKNLGVINGRNYDDEDILKYVDVGATYYFNKNMSTYVDYKINLLDDNRFTRDAGINTDDIVALGLVYQF

SEQ ID NO: 5805 - protein, 367 aa, Escherichia coli
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQLGNGFATYRNTDFFGLVDGLNFAVQYQGKNGSVSGEGMTNNGRDALRQNGDGVGGSITYDYEGFGIGAAVSSSKRTDAQNTAAYIGNGDRAETYTGGLKYDANNIYLAAQYTQTYNATRVGSLGWANKAQNFEAVAQYQFDFGLRPSVAYLQSKGKNLGTIAGRNYDDEDILKYVDVGATYYFNKNMSTYVDYKINLLDDNQFTRDAGINTDNIVALGLVYQF

SEQ ID NO: 5806 - protein, 357 aa, Escherichia coli
MMKRNILAVIVPALLVAGTANAAEIYNKDGNKVDLYGKAVGLHYFSKDNGVNSYGGNGDKTYARLGFKGETQINSDLTGYGQWEYNFQGNNSEGADAQKGNKTRLAFAGLKFADAGSIDYGRNYGVVYDALGYTDMLPEFGGDTAYSDDFFVGRVGGVATYRNSNFFGLVDGLNFAVQYLGKNERAGIPERSNGDGVGGSISYEFEGFGIVGAYGAADRTDAQEAEFRGQGKKAEQWATGLKYDANNIYLAANYGETRNATPIKGGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 5807 - protein, 357 aa, Escherichia coli
MMKRNILAVIVPALLVAGTANAAEIYNKDGNKVDLYGKAVGLHYFSKDNGVNSYGGNGDKTYARLGFKGETQINSDLTGYGQWEYNFQGNNSEGADAQKGNKTRLAFAGLKFADAGSIDYGRNYGVVYDALGYTDMLPEFGGDTAYSDDFFVGRVGGVATYRNSNFFGLVDGLNFAVQYLGKNERAGIPERSNGDGVGGSISYEFEGFGIVGAYGAADRTDAQEAEFRGQGKKAEQWATGLKYDANNIYLAANYGETRNATPIEGGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 5808 - protein, 362 aa, Escherichia coli
MMKRNILAVIVPALLVAGTANAAEIYNKDGNKVDLYGKAVGLHYFSKGNGEDSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEESPLGKGKKAEQWATGLKYDANNIYLAANYGETRNATPITNKFTNTSGFANKTQDVLLVAQYQFDFGLRPSIAYTKSKAKDVDGIGDVDLVNYFEVGATYYFNKNMSTYVDYIINQIDSDNKLGVGSDDTVAVGIVYQF

SEQ ID NO: 5809 - protein, 362 aa, Escherichia coli
MMKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGNGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 5810 - protein, 375 aa, Escherichia coli
MMKRNILAVIVPALLVAGTANAAEIYNKDGNKVDLYGKAVGLHYFSKGNGEDSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDMLPEFGGDTAYSDDFFVGRVGGVATYRNSNFFGLVDGLNFAVQYLGKNERDTARRSNGDGVGGSISYEYEGFGIVGAYGAADRTNLQEESPLGKGKKAEQWATGLKYDANNIYLAANYGETRNATPITNKFTNTSGFANKTQDVLLVAQYQFDFGLRPSIAYTKSKAKDVDGIGDVDLVNYFEVGATYYFNKNMSTYVDYIINQIDSDNKLGVGSDDTVAVGIVYQF

SEQ ID NO: 5811 - protein, 353 aa, Escherichia coli
MMKRNILAVIVPALLVAGTANAAEIYNKDGNKVDLYGKAVGLHYFSKDNGVNSYDETYARLGFKGETQINSDLTGYGQWEYNFQGNNSEGADAQKDNKTRLAFAGLKFADAGSIDYGRNYGVVYDALGYTDMLPEFGGDTAYSDDFFVGRVGGVATYRNSNFFGLVDGLNFAVQYLGKNERAGIPERSNGDGVGGSISYEFEGFGIVGAYGAADRTDAQEAEFRGQGKKAEQWATGLKYDANNIYLAANYGETRNATPIEGGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 5812 - protein, 362 aa, Escherichia coli
MMKRNILAVIVPALLVAGTANAAEIYNKDGNKVDLYGTAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGNGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 5813 - protein, 362 aa, Escherichia coli
MMKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGNGKKAEQWATGLKYDANNIYLAANYGETRNATPITNKFTNISGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 5814 - protein, 187 aa, Escherichia coli
RGALRQNGDGVGGSITYDYEGFGIGAAVSSSKRTDAQNGTYVVDNVTHNYIGTGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLVY

SEQ ID NO: 5815 - protein, 175 aa, Escherichia coli
RGALRQNGDGVGGSITYDYEGFGIGGAISSSKRTDDQNSPLYIGNGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNQFTRDAGINTDNIVALGLVY

SEQ ID NO: 5816 - protein, 240 aa, Escherichia coli
SNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESAVKLPSDAGSNITYRTINDYGALTPKMTGVME

SEQ ID NO: 5817 - protein, 240 aa, Escherichia coli
SNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 5818 - protein, 240 aa, Escherichia coli
SNKNVNVRKSQEITFCLLAGILMFMAMVVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESAVKLPSDAGSNITYRTINDYGALTPKMTGVME

SEQ ID NO: 5819 - protein, 240 aa, Escherichia coli
SNKNVNVRKSQEITFCLLAGILMFMAMVVAGRAEAGVALGATRVIYPAGQKQVQLAVTNNDENSTYLIQSWVENADGVKDGRFIVTPPLFAMKGKRENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 5820 - protein, 240 aa, Escherichia coli
SNKNVNVRKSQEITFCLLAGILMFMAMMVAGRAEAGVALGATRVIYPAGQKQVQLAVTNNDENSTYLIQSWVENADGVKDGRFIVTPPLFAMKGKRENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 5821 - protein, 240 aa, Escherichia coli
SNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLVIISRIKLYYRPAKLALPPDQAAEKLRFRRSANSLTLINPTPYYLTVTELNAGTRILENALVPPMGESTVKLPSDAGSNITYRTINDYGALTPKMTGVME

SEQ ID NO: 5822 - protein, 240 aa, Escherichia coli
SNKNVNVRKSQEITFCLLAGILMFMAMMVAGRAEAGVALGATRVIYPAGQKQVQLAVTNNDENSTYLIQSWVENADGVKDGRFIVTPPLFAMKGKRENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 5823 - protein, 240 aa, Escherichia coli
SNKNVNVRKSQEITFCLLAGILIFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 5824 - protein, 240 aa, Escherichia coli
SNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNHLPQDWESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 5825 - protein, 240 aa, Escherichia coli
SNKNVNVRKSQEITFCLLAGILIFMAMMVAGRAEAGVALGATRVIYPAGQKQVQLAVTNNDENSTYLIQSWVENADGVKDGRFIVTPPLFAMKGKRENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 5826 - protein, 240 aa, Escherichia coli
SNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQVAEKLRFRRSANSLTLINPTPYYLTVTELNAGTRVLENALVPPMGESTVKLPSDAGSNITYRTINDYGALTPKMTGVME

SEQ ID NO: 5827 - protein, 240 aa, Escherichia coli
SNKNVNVRKSQEITFCLLAGILMFMAMVVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 5828 - protein, 240 aa, Escherichia coli
SNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQVAEKLRFRHSANSLTLINPTPYYLTVTELNAGTRVLENALVPPMGESTVKLPSDAGSNITYRTINDYGALTPKMTGVME

SEQ ID NO: 5829 - protein, 240 aa, Escherichia coli
SNKNVNVRKSQEITFCLLAGILIFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 5830 - protein, 240 aa, Escherichia coli
SNKNVNVRKSQEITFCLLAGILMFMAMVVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPFYLTVTELNAGTRVLENALVPPMGESAVKLPSDAGSNITYRTINDYGALTPKMTGVME

SEQ ID NO: 5831 - protein, 240 aa, Escherichia coli
SNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALLPDQAAEKLRFRRSANSLTLINPTPYYLTVTELNAGTRVLENALVPPMGESTVKLPSDAGSNITYRTINDYGALTPKMTGVME

SEQ ID NO: 5832 - protein, 240 aa, Escherichia coli
SNKNVNVRKSQEITFCLLAGILMFMAMMVAGRAEAGVALGATRVIYPAGQKQVQLAVTNNDENSTYLIQSWVENADDVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 5833 - protein, 240 aa, Escherichia coli
SNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 5834 - protein, 240 aa, Escherichia coli
SNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINSTPYYLTVTELNAGTRVLENALVPPMGESTVKLPSDAGSNITYRTINDYGALTPKMTGVME

SEQ ID NO: 5835 - protein, 240 aa, Escherichia coli
SNKNVNVRKSQEITFCLLAGILMFMAMMVAGRAEAGVALGATRVIYPAGQKQVQLAVTNNDENSTYLIQSWVENTDGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 5836 - protein, 240 aa, Escherichia coli
SNKNVNVRKSQEITFCLLAGILMFMAMMVAGRAEAGVALGATRIIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 5837 - protein, 240 aa, Escherichia coli
SNKNVNVRKSQEITFCLLAGILMFMAMMVAGRAEAGVALGATRIIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTLYYLTVTELNAGARVLENALVPPMGESTVKLPSDAGSNITYRTINDYGALTPKMTGVME

SEQ ID NO: 5838 - protein, 240 aa, Escherichia coli
SNKNVNVRKSQEIIFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 5839 - protein, 240 aa, Escherichia coli
SNKNVNVRKSQEITFCLLAGILMFMAMMVAGRAEAGVALGATRVIYPAGQKQVQLAVTNNDENSTYLIQSWVENADGVKDGRFIVTPPLFAMKGKRENILRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 5840 - protein, 823 aa, Escherichia coli
MFTVQFFIDCRNILIILLITICICNSVMARRGKRGHLLTNCTACLSGSKVFAVAGCVVLRTTMPDSCNSWQKCRNKTMNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDIDLDDVMLHSEVNLPLDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 5841 - protein, 233 aa, Escherichia coli
MKRIALFFCFIFSFAAHANNIIVNGTRFIYPGNEKEITVQLSNTADRPALAQAWLDNGNADATPDTITTPFIITPPISRVDAKSGQTLRIKLGSNAGLAKDKETLWWLNLLEIPPVEASQKNEGQNILQLAIRSRFKFIYRPAGLGNRDAAAEKLALSANGSSLSVSNPTPFYITVSRISRNGGKALNSKTVMFAPQSSQTIALSSAVSKGETLTVNNINDYGADVAVKVTVK

SEQ ID NO: 5842 - protein, 828 aa, Escherichia coli
MKQRSICPGRLSTAIAVALCCFPPFSSGQENPGTIYQFNDGFIVGSREKVDLSRFSTSAISEGVYSLDVYTNGEWKGRYDLKITAGKDGKMGVCYTKAMLMQYGISPDKLNPQLSEKEGFCGRLQEWRHEDNVKDTLIQSSLRLDIAVPQIYEDQRLKNFVSPQFWDKGVAALNLGWMANAWNSHISSANGSDNSSAYLGVNAGLSWDGWLLKHIGNLNWQQQQGKAHWNSNQTYLQRPIPQINSIVSGGQIFTNGEFFDTIGLRGVNLATDDNMFPDGMRSYAPEIRGVAQSNALVTVRQGSNIIYQTTVPPGPFTLQDVYPSGYGSDLEVSVKEGDGSVEVFSVPYASVAQLLRPGMTRYALSAGKVDDSSLRNKPMLYQGTWQHGLNNLFTGYTGVTGFDDYQAFLLGTGMNTGIGALSFDVTHSRLKSDTLDEHGQSYRATFNRMFTETQTSIVLAAYRYSTNGYYNLNDALYAVDQEKNYNSNYTVWRQKNGMTFTVNQNLPDGWGGFYLSGRVADYWNRSGTEKQYQFSYNNMYGRLSWSVSAQRVYTPDSSGHRRDDRVSLNFSYPLWFGENRTANLTSNTAFNNSRFASSQIGVNGSLDSENNLNYGVSTTTATGGQHDVALNGSYRTPWTTLNGSYSQGEGYRQSGVGASGTLIAHQHGVVFSPETGTTMALIEAKDAAGAMLPGSPGTRIDSNGYAILPYLRPYRINSVEIDPKGSNDDVAFGSTVAQVVPWEGSVVKVSFDTTLQNNITLRARQANGLPLPFAATIFGPSGKEIGVVGQGSMMFISDASAPKATVKWSGGQCSVELSQEKTKETLCR

SEQ ID NO: 5843 - protein, 695 aa, Escherichia coli
MRITTLASVAIPCLGFSVSSMAAEDVMIVTASGYEKKLTSAAASVSVISQEDLRSSQYHDLGEALRSVEGVDVESGTGKTGGLEISIRGMPASYTLILIDGVRQGGSRDVTPNGFSAMNTGFMPPLAAIERIEIIRGPMSTLYGSDAMGGVVNIITKKNADKWHSSVNAGLNLQESNKWGNSSQFNFWSSGPLVDDSLSLQVRGSTQQRQGSSVTSLSGTSATRIPYPTESQNYNAGARLDWKATDKDMFWLDMDTARQRYDNRDGQLGSLTGGYDRTLRYERNKISAGYDHAFTFGTWKSSLNWNETENKGRQLVRSVLKRDKWGLAGQPRELKESNFILNSLLLAPVGESHLVTVGGEYQNSSMKDGVVLTSTGETFRQKSWSAFVEDEWHITDAVALTVGSRYEHHEVFGGHLSPRAYMVWDVADEWTLKGGVTTGYKAPGMGQLHKGISGVSGQGRTNLLGNPDLKPEESVSYEAGVYYDNHAGLNANITGFMTEFSNKIVSYSIDDNTRSYTNSGKARTQGVEFAGTLPLWSEDVTLSLNYTWTQSEQRDGDNKGAPLSYTPEHMVNAKLNWQITEDVSSWLGARYRGKTPRFTQNYSSLSAVQKKVYDEKGEYLKAWTVLDAGMSWKVTDALTLNAAVNNVLNKDYSDVSLYRAGSGTLYAGDYFQTGASTTGYVIPERNYWMSLSYQF

SEQ ID NO: 5844 - protein, 177 aa, Escherichia coli
ASSSVRSAGKKLILLIPDNYEAQGVGINELVKAADELGTEIHRTERDDTAIANQFFGTAEKVVGLTERGVAIFAPQLDKLLQKYQKVGSKIGGTAENVGNNLGKAGTVLSALQNFTGIALSGMALDELLRKQREGEDISQNDIAKSSIELINQLVDTVSSINSTVDSFSEQLNQLGS

SEQ ID NO: 5845 - protein, 128 aa, Escherichia coli
MNIKQRNHMNTVLSVQGASAPVKKKSFFSKFTRLNMLRLARAVIPAAVLMMFFPQLAMAAQGQDLMASGNTTVKATFGKDSSVVKWVVLAEVLVGAVMYMMTKNVKFLAGFAIISVFIAVGMAVVGLK

SEQ ID NO: 5846 - protein, 342 aa, Escherichia coli
MSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQH

SEQ ID NO: 5847 - protein, 359 aa, Escherichia coli
MKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 5848 - protein, 679 aa, Escherichia coli
MSIWRKKTTGLKTKKRLLPLMLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPILPAQNQALPPEVRAFLNAGRTR

SEQ ID NO: 5849 - protein, 713 aa, Escherichia coli
MAMFTPSFSGLKGRALFSLLFAAPMIHATDSVTTKDGETITVTADANTATEATDGYQPLSTSTATLTDMPMLDIPQVVNTVSDQVLENQNATTLDEALYNVSNVVQTNTLGGTQDAFVRRGFGTNRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESVGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 5850 - protein, 222 aa, Escherichia coli
MSKLGISSLFKTILLTAALAVSFTASAFTEGTDYMVLEKPIPNADKTLIKVFSYACPFCYKYDKAVTGPVSEKVKDIVAFTPFHLETKGEYGKQASEVFAVLINKDKAAGISLFDANSQFKKAKFAYYAAYHDKKERWSDGKDPAAFIKTGLDAAGMSQADFEAALKEPAVQETLEKWKASYDVAKIQGVPAYVVNGKYLIYTKSIKSIDAMADLIRELASK

SEQ ID NO: 5851 - protein, 840 aa, Escherichia coli
MNNKNTFSRDKLSHAIKNALSGVVCSLLFVLPVHAVEFNVDMIDAEDRENIDISRFEKKGYIPPGRYLVRVQINKNMLPQTLILEWVKADNESGSLLCLTKENLTNFGLNTEFIESLQNIAGSECLDLSQRQELTTRLDKATMILSLSVPQAWLKYQATNWTPPEFWDTGITGFILDYNVYASQYAPHHGDSTQNVSSYGTLGFNLGAWRLRSDYQYNQNFADGRSVNRDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGQLDVTVEEEDGRTSTFQVGSASIPYLTRKGQVRYKTSLGKPTSVGHNDINNPFFWTAEASWGWLNNVSLYGGGMFTADDYQAITTGIGFNLNQFGSLSFDVTGADASLQQQNSGNLRGYSYRFNYAKHFESTGSQITFAGYRFSDKDYVSMSEYLSSRNGDESIDNEKESYVISLNQYFETLELNSYLNVTRNTYWDSASNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTATRHGVALHDYSYGDNARMMVDTDGISGIEINSNRTVTNGLGIAVIPSLSNYTTSMLRVNNNDLPEGVDVENSVIRTTLTQGAIGYAKLNATTGYQIVGVIRQENGRFPPLGVNVTDKATGKDVGLVAEDGFVYLSGIQENSILHLTWGDNTCEVTPPNQSNISESAIILPCKTVK

SEQ ID NO: 5852 - protein, 249 aa, Escherichia coli
MNIMKLPLITTGMICFLGICNFAQATVSPDRTRIIFNASNKSATVRLTNQSKIDPYLAQSWIEDASGKKTRDYISTLPPMERIEPDEQVQIRLMALASLNNLPQDRETLFYYNVREIPPRAKEQNVMQIAMQSRLKLFWRPKAIELKEGEMVPLQKVTITRTAAGLTLNNPTPYHITVGYIGTNGKTLMPGADSIMVAPFASATQHLNNLPSTFQLGFVADYGGLEMFKVVCNSVQSLCQSTPAKKGKI

SEQ ID NO: 5853 - protein, 678 aa, Escherichia coli
MVPSTFSRLKAARCLPVVLAALIFAGCGTHTPDQSTAYMQGTAQADSAFYLQQMQQSSDDTRINWQLLAIRALVKEGKTGQAVELFNQLPQELNDTQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNFGTQPVAAQVAAAPAADVAEQSQPQTVDDVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRETTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 5854 - protein, 784 aa, Escherichia coli
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYKDEHPNDDSSRRWLFYWKHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLGWYNSRNTTRLAESANRVMPQFKVDGRMVFERDMEMLAPGYTQTLEPRAQYLYVPYRDQSKIYNYDSSLLQSDYSGLFRDRTYGGLDRIASANQVTTGVTSRIYDDAAVERFNISVGQIYYFTESRTGDDNITWENDDKTGSLVWAGDTYWRISDRWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 5855 - protein, 170 aa, Escherichia coli
MSGILTRWRQFGKRYFWPHLLLGMVAASLGLPALSNAAEPNAPAKATTRNHEPSAKVNFGQLALLEANTRRPNSNYSVDYWHQHAIRTVIRHLSFAMAPQTLPVAEESLPLQAQHLALLDTLSALLTQEGTPSEKGYRIDYAHFTPQAKFSTPVWISQAQGIRAGPQRLS

SEQ ID NO: 5856 - protein, 862 aa, Escherichia coli
MTIKSTNHLTHIATFCALLYSNSALCAELVEYDHTFLMGKDASNIDLSRYTEGNPTLPGIYDVSVYVNDQPIMSQSIAFAVIEGKKNAQACITQKNLLQFHISSPDKNSEKAILLKRDEDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQELEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAIMNIVRSDGKNIPFAADIYDEQNNIIGNVGQGGQAFVRGIGQEGNIRITWIEEGKPVSCFAHYQQNTTSEKIAQSIILNGLRCQIQ

SEQ ID NO: 5857 - protein, 246 aa, Escherichia coli
MFFNTKHTAALCLASCMAFSSSAIADIVISGTRVVYKSEQKSVNVRLENKGNNPLLVQSWLDTGDDNAEPGSITVPFTATPPVSRIDAKRGQTIKLMYTASSALPKDRESVFWFNVLEVPPKPDAAKAANQSLLQLAFRTRIKLFYRPEGLSGISSDAPLALKWSWATSEGKAALRVDNPTPYYVSFSSGDLEANGKRYPLDMTMIAPFSNDVIKVNGMSGRTSSAKVHFFAINDFGGSIEGNANL

SEQ ID NO: 5858 - protein, 650 aa, Escherichia coli
MKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNSRKPSSTSAMDNVAITADEQTNSLVITADQSVQEKLATVIARLDIRRAQVLVEAIIVEVQDGNGLNLGVQWANKNVGAQQFTNTGLPVFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQLRIDGKSKALVGSEDLPVLNENTFNSHAPAPSSR

SEQ ID NO: 5859 - protein, 900 aa, Escherichia coli
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEITQYGNPGSCSVKPDNNGGAVTPVDPTPETPETPVTPTPDNNEPSTPADSSNDYSLQAWSGQEGSEIYHVIFNGNVYQNAWWVGSEDCPRGTSVENSNNPWRLVRTATAAEMSQYGNPTTCEIDNGGVIIANGFQASKAYSANSIVDYNDAHYKTSVDQDAWGFVPGGDNPWKKYEPAKAWSASTVYVKGDRVVVDGQAYEALFWTQSDNPALVANQNATGSNSRPWKPLGKTQSYSNEELNNAPQFNPETLYASDTLIRFNGENYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHAQLKGLYGNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 5860 - protein, 386 aa, Escherichia coli
MVDDVPVAQVLQVLAEQEKLNLVVSPDVSGTVSLHLTDVPWKQALQTVVKSAGLITRQEGNILSVHSVAWQNDNIARQEAEQTRAQANLPLENRNITLQYADAGELAKAGEKLLSAKGSMTVDKRTNRLLLRDNKTALSTLEQWVSQMDLPVGQVELSAHIVTINEKSLRELGVKWTLADAQQAGGVGQVTTLGSDLSVATATTHIGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 5861 - protein, 249 aa, Escherichia coli
MIKVVIVLFSLLFSTAQAGLVIGGTRFAYPENQSSISVELKNTSNRDMLVKVAVSPDDARQLTGTVESLPSYSETVFIATPPLFVLKPDKNTKIRINRVGGSLPTDRESLFILNVAALPTLENSHSVKTDNQLQIAVRNRMKIFYRPSNLSEDPNMSYQKLRWARKNEIVTVYNPGPRYVTLYNLHVDGKVIDGGMVAPFSHRQQSWCKSQGVCEIAWQTLDIYNNVLPILKVKLNPSQLDVTGFAFSQ

SEQ ID NO: 5862 - protein, 250 aa, Escherichia coli
MKCIIGNKKWVCGFRDELKVSQNIIRSGILFLLSILFINNASAGGFGLGVTRLIYPAESKQITLSVQNSGDNTSYLIQSWVDDSKTEKKSQDFVITPPLFMLPTRKEASLRIMFLGKTNLPTDRETLYWMNVKAIPPTDEKNTQKNTLQLALQNKIKLFYRPENLPVQPGKARNMLRFKYEGKQLKVINPSPYYLTLTGIKVQGSKLPNMFVPPKSDITVSSPVTLAGEITYQTINDFGATTERQKGIMQ

SEQ ID NO: 5863 - protein, 351 aa, Escherichia coli
MKKSTLALVVMGIVASVSVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMMPISGGFANKTQNFEAVAQYQFDFGLRPSLGYVLSKGKDIEGIGDEDLVNYVDVGATYYFNKNMSAFVDYKINQLDSDNKLNINNDDIVAVGMTYQF

SEQ ID NO: 5864 - protein, 660 aa, Escherichia coli
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQKQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 5865 - protein, 843 aa, Escherichia coli
MHWMHLPLDHYRAHFSFSLLALTIASALPAYGGKFNPKFLENVQGIDQHVDLSVYDSPVGQQIPGKYRVFVFVNEEKMASRTLDFSTASEAQRKASGESLMPCLSRVQLEEMGVRIDSFPALKILPPEACVAFDEIIPQATSRFDFNTQTLHLTFPQAAMMMTARGTVDPSRWDEGIPALLLDYSFSGSNGRNEGSGSSPDSTSDSYYLNLRSGLNVGPWRLRNNSIWNRTDGKNQWDNVGTSLNRAIIPLKSQITLGDTATPGEIFDSVQMRGTLLASDDEMLPDSQRGFAPVVRGIAKSNAEVSIEQNGYVIYRTFVQPGAFEINDLYATSGSGDLTVIIKESDGSEQRFIQPFSAVAIFQREGYLKYSLAAGEYRAGNYDSGKPRFGQFTAMYGLPWGMTAYGGALLSADYNALALGLGKNFGTIGAVSVDVTQAKSQLRNNEKDEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSIAYTWTRSPEWDEDDRLWSFSLSIPLGGAWGSYRMTTDQNGKTSQQASVSGTLLEDRNLNYNVQQGYTSNGVGNSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNVELQEAFQKVVPTRGAIVRSRFDTRVGYRVLMSLKRANGNAVPFGATAALSDESKPASSIVGEEGQLYISGMPEEGELQVSWGHEQAQRCRVPFRLPEKKDNSGIVMVNAVCDK

SEQ ID NO: 5866 - protein, 228 aa, Escherichia coli
MKRISLAVLALLMTAQQCFAGGVALSTTRVIYDGGKKEASLTVENHNKNEEFLIQSWIDDVNGNKKTPFIITPPLFKLDPDKNNVLRIVNIEDTLPKDRESVYWINVKAIPAKSAENENKNVLQIAVRTRLKLFYRPKGLPGSNLEAMKQLRFQRQNNQIVVNNDSAYNLTFNQMSINGQKIERAGMVLAKGTLNINLPAGTGNANEVKYSIINDFGVAGEMLTKSIN

SEQ ID NO: 5867 - protein, 749 aa, Escherichia coli
MNKKIHSLALLVNLGIYGVALPVLAEETSDNAVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKAAQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQSLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 5868 - protein, 193 aa, Escherichia coli
MRYLATLLLSLAVLITAGCGWHLRDTTQVPSTMKVMILDSGDPNGPLSRAVRNQLRLNGVELLDKETTRKDVPSLRLGKVSIAKDTASVFRNGQTAEYQMIMTVNATVLIPGRDIYPISAKVFRSFFDNPQMALAKDNEQDMIVKEMYDRAAEQLIRKLPSIRAADIRSDEEQTSTTTDTLATPARVSTTLGN

SEQ ID NO: 5869 - protein, 208 aa, Escherichia coli
MKKIWLALAGLVLAFSASAAQYEDGKQYTTLEKPVAGAPQVLEFFSFFCPHCYQFEEVLHISDNVKKKLPEGVKMTKYHVNFMGGDLGKELTQAWAVAMALGVEDKVTVPLFEGVQKTQTIRSASDIRDVFINAGIKGEEYDAAWNSFVVKSLVAQQEKAAADVQLRGVPAMFVNGKYQLNPQGMDTSNMDVFVQQYADTVKYLSEKK

SEQ ID NO: 5870 - protein, 332 aa, Escherichia coli
MMKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPNKPYHGQIGFVSPTAEFTPKTVETPDLRTDLVYRLRIVVTDADDALRQGMPVTVQFGDEAGHE

SEQ ID NO: 5871 - protein, 760 aa, Escherichia coli
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAMRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSITDTATMRFEHDINDNTTIRNTTRWSRVKQDYLMTAIMGGASNITQPTSDVNSWTWSRTANTKDVSNKILTNQTNLTSTFYTGAIGHDLSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 5872 - protein, 614 aa, Escherichia coli
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDHPGTEISAGWGSNSYQNYDVSTQQQLGDKTRVTLLGDYAHTHGYDVVAYGNTGTQAQPDNDGFLSKTLYGALEHNFTDAWSGFVRGYGYDNRTNYDAYYSPGLPLVDTRKLYSQSWDAGLRYNGELIKSQLITSYSHSKDYNYDPHYGRYDSSATLDEMKQYTVQWANNIIIGHGNIGAGVDWQKQSTAPGTAYVEDGYDQRNTGIYLTGLQQVGDFTFEGAGRSDDNSQFGRHGTWQTSAGWEFIEGYRFIASYGTSYKAPNLGQLYGSYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 5873 - protein, 446 aa, Escherichia coli
MMITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYTGSSSTNPYYGKAVSADFNGGSFGRGDSDEWTFGAQMEIWW

SEQ ID NO: 5874 - protein, 362 aa, Escherichia coli
MMKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEESSLGKGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 5875 - protein, 237 aa, Escherichia coli
MRKITQALSAVCLLFALNSSAVALASSPSPLNPGTNVARLAEQAPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPATNMNPVIFAGDKPGQNTKSQWLQDKNIRIFYGDSDNDITAARDVGARGVRILRASNSTYKPLPQAGAFGEEVIVNSEY

SEQ ID NO: 5876 - protein, 478 aa, Escherichia coli
MTRIKINARRIFSSLIPFFFFTSVHAEQTAAPATPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 5877 - protein, 191 aa, Escherichia coli
MKKSLLGLTFASLMFSAGSAVAADYKIDKEGQHAFVNFRIQHLGYSWLYGTFKDFDGTFTFDEKNPAADKVNVTINTTSVDTNHAERDKHLRSADFLNTAKYPQATFTSTSVKKDGDKLDITGDLTLNGVTKPVTLEAKLIGQGDDPWGGKRAGFEAEGKIKLKDFNIKTDLGPASQEVDLIISVEGVQQK

SEQ ID NO: 5878 - protein, 729 aa, Escherichia coli
MLSTQFNRDNQHQAIIKPSLLAGCIALALLPSAAFAAPVTEETVIVEGSATAPDDGENDYNVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQNDTTHMKSLYAATRVTLADPLHLILGARYTNWRVDTLTYSMEKNHTTPYAGLVFDINDNWSTYASYTSIFQPQNDRDSSGKYLTPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 5879 - protein, 360 aa, Escherichia coli
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTDGQVAYGKSKFNASGKNAEVWAAGLKYDANNIYLATTYSETQNMTVFGNNHIANKAQNFEAVAQYQFDFGLRPSVAYLQSKGKDLGVHGDRDLVKYVDVGATYYFNKNMSTFVDYKINLIDDSKFTKTAGIDTDDIVAVGLVYQF

SEQ ID NO: 5880 - protein, 656 aa, Escherichia coli
MRLKKRYLCTVLSLAFTQQSVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEANLGYRQGWSRSQDNAYDMHASFAASSDLGYLQISGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFPHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 5881 - protein, 565 aa, Escherichia coli
MKSPAPSRPQKMALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPKPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILSRASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPLKQKEAEPTP

SEQ ID NO: 5882 - protein, 207 aa, Escherichia coli
MPLPDFRFIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTSDDAEEMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 5883 - protein, 368 aa, Escherichia coli
MNKTITALAILMASFAANASVLPETPVPFKSGTGVIDNDTVYIGLGSAGTAWYKLDTQAKDKRWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAYYFDKKAEDYFFNKFLLSFDPSTQQWSYAGESPWYGTAGAAVVNKGDKTWLINGEAKPGLRTDAVFELDFTGNNLKWNKLAPVASPDGVAGGFAGMSNDSLIFAGGAGFKGSRENYQNGKNYAHEGLKKSYSADIHLWHNGKWDKSGELSQGRAYGVSLPWNNSLLIIGGEAAGGKAVTDSVLISVKDNKVTVQN

SEQ ID NO: 5884 - protein, 878 aa, Escherichia coli
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAQLDVGQQRLNLTIPQAFMSNRARGYIPPELWDPGINAGLLNYNFSGNSVQNRIGGNSHYAYLNLQSGLNIGAWRLRDNTTWSYNSSDSSSGRKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 5885 - protein, 551 aa, Escherichia coli
MDRRRFIKGSMAMAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKNQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 5886 - protein, 700 aa, Escherichia coli
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPLTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYIPEDGWYAGTEARYMGDIMADDENTAKAPSYTLVGLFTGYKYNYHNFTVDLFGRVDNLFDKEYVGSVIVNESNGRYYEPAPGRNYGVGINIAWRFE

SEQ ID NO: 5887 - protein, 883 aa, Escherichia coli
MTAFRAAFKAYRMHQVLILPRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDNKEHSAEKHVPDNSACTPLQDRLADASSEFNVGQQHLSLSVPQIYVGRMARGYVSPDLWEEGINAGLLNYSFNSNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFHNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDFKLPVVSPGTLLNQQTAICR

SEQ ID NO: 5888 - protein, 239 aa, Escherichia coli
MHQMQTTRTPYSVSFMATVLLLLLFACHSTIANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTHLAMAPEEAPAMLRFRRSGSKLTLINPTPYFITVTNMKAGNSNLPNTMVPPKGEVSVDIPHAVTGDISFQTINDYGALTPRIKATMQ

SEQ ID NO: 5889 - protein, 111 aa, Escherichia coli
MKKQIEGMTMKKVLALVVAAAMGLSSAAFAAETATTPAPTATTTKAAPAKTTHHKKQHKAAPAQKAQAAKKHHKNAKAEQKAPEQKAQAAKKHAKKHSHQQPAKPAAQPAA

SEQ ID NO: 5890 - protein, 118 aa, Escherichia coli
MKKRGAFLGLLLVSACASVFAANNETSKSVTFPKCEGLDAAGIAASVKRDYQQNRVARWADDQKIVGQAYPVAWVSLQDIQGKDDKWSVPLTVRGKSADIHYQVSVDCKAGMAEYQRR

SEQ ID NO: 5891 - protein, 360 aa, Escherichia coli
MKKLTVAISAVAASVLMAMSAQAAEIYNKDSNKLDLYGKVNAKHYFSSNDADDGDTTYVRLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNDQVIYGNNSLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVGLVYQF

SEQ ID NO: 5892 - protein, 826 aa, Escherichia coli
MLRMTPLASAIVALLIGIEAYAAEETFDTHFMIGGMKDQQVSNIRLEDNQPLPGQYDIDIYVNKQWRGKYEIIVKDNPQETCLSREMIKRLGINTDSFASGKQCLTFKQLIQGGSYTWDIGVFRLDFSVPQAWEEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGHQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRHDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESRNYICQ

SEQ ID NO: 5893 - protein, 224 aa, Escherichia coli
MKGLLALLISSMVLPAHAGIVIYGTRIIYPAEHKEVMVQLMNQGNRSSLMQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKVTFKKLLVNRSGNGLVIKNDSANWVTISDVKANNVKVNYETIMIAPLESQSVNVKSNNANNWHLTIIDDHGNYISDKI

SEQ ID NO: 5894 - protein, 663 aa, Escherichia coli
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 5895 - protein, 828 aa, Escherichia coli
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPLSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 5896 - protein, 162 aa, Escherichia coli
MKTILPAVLFAAFATTSAWAAESVQPLEKIAPYPQAEKGMKRQVIQLTPQEDESTLKVELLIGQTLEVDCNLHRLGGKLESKTLEGWGYDYYVFDKVSSPVSTMMACPDGKKEKKFVTAYLGDAGMLRYNSKLPIVVYTPDNVDVKYRVWKAEEKIDNAVVR

SEQ ID NO: 5897 - protein, 375 aa, Escherichia coli
MKVKVLSLLVPALLVAGAANAAEVYNKDGNKLDLYGKVDGLHYFSDNKSEDGDQTYMRLGFKGETQVTDQLTGYGQWEYQIQGNAPESENNSWTRVAFAGLKFQDIGSFDYGRNYGVVYDVTSWTDVLPEFGGDTYGSDNFMQQRGNGFATYRNTDFFGLVDGLNFAVQYQGQNGSVSGENDPDFTGHGITNNGRKALRQNGDGVGGSITYDYEGFGVGAAVSSSKRTWDQNNTGLIGTGDRAETYTGGLKYDANNIYLAAQYTQTYNATRVGSLGWANKAQNFEAVAQYQFDFGLRPSVAYLQSKGKNLGVVAGRNYDDEDILKYVDVGATYYFNKNMSTYVDYKINLLDDNQFTRAAGINTDDIVALGLVYQF

SEQ ID NO: 5898 - protein, 200 aa, Escherichia coli
MLAFCRSSLKSKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRFLQCGNEIYSAIKDLQRKAPDKNIVIFTHNHCLTYIAKDKRDATFKPDYLDGLVMHVEKGKVYLDGEFVNH

SEQ ID NO: 5899 - protein, 274 aa, Escherichia coli
MNKTAIALLALLASSASLAATPWQKITQPVPGSAQSIGSFSNGCIVGADTLPIQSEHYQVMRTDQRRYFGHPDLVMFIQRLSRQVSNLGMGTVLIGDMGMPAGGRFNGGHASHQTGLDVDIFLQLPKTRWTSAQLLRPQALDLVSRDGKHVVPALWKPEIFSLIKLAAQDKDVTRIFVNPAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 5900 - protein, 250 aa, Escherichia coli
MSYKLSCPMLVSTALMALLTTASLTAHASVTPDRTRLVFNESDKSISVTLRNNNEKLPYLAQSWLEDEKGNKITSPLAVLPPVQRIDAMMNGQVKIQALPDIHTLPSDRESLFYYNVREIPPKSGKANTLQIALQTRIKLFWRPKALEKIDMRRPWQFKVTLTRSGQDYTVNNPTPYHVIISDASTQKKGLTAAGFKPLVMPPKTSQPLKAKLASAPVLTYINDYGARMPLIFRCEGNTCKVDEDQSSKG

SEQ ID NO: 5901 - protein, 884 aa, Escherichia coli
MCMPNHSNFRLRGIACYIALAISGGSVNAWADDSIQFDPRFLELKGDTKIDLGKFSKKGYVDAGKYNLRVFINKQPLSDEYDINWYVSENDPTKNYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKHWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASVPFLTRQGQVRYKVMMGRPEDWNHKTEGGFFSGGEASWGVADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSVDGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNAGEHMMVFWEGSAQCEIVLPKPLPADLFSGLLLPCEQKGTAAPDSSAPEIKPVIQDQTRQVTPTEAPTSISATQ

SEQ ID NO: 5902 - protein, 518 aa, Escherichia coli
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKDTKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHTPSLLFSRKGSEEKQN

SEQ ID NO: 5903 - protein, 79 aa, Escherichia coli
MKKMFMAVLFALVSVNAMAADCAKGKIEFSKYNGDNTFTVKVDGKEYWTNRWNLQPLLQSAQLTGMTVTIKSNTCESGS

SEQ ID NO: 5904 - protein, 89 aa, Escherichia coli
MKKMFMAVLFALVSVNAMAADCAKGKIEFSKYNGDNTFTIKVDGKEYWTNRWNLQPLLQSAQLTGMTVTIKSNTCDSGSGFAEVQFNND

SEQ ID NO: 5905 - protein, 89 aa, Escherichia coli
MKKMFMAVLFALVSVNAMAADCAKGKIEFSKYNENDTFTVKVAGKEYWTNRWNLQPLLQSAQLTGMTVTIKSNTCASGSGFAEVQFNND

SEQ ID NO: 5906 - protein, 367 aa, Escherichia coli
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRDALRQNGDGVGGSITYDYEGFGIGGAISSSKRTDAQNTAAYIGNGDRAETYTGGLKYDANNIYLAAQYTQTYNATRVGSLGWANKAQNFEAVAQYQFDFGLRPSVAYLQSKGKNLGTIGTRNYDDEDILKYVDVGATYYFNKNMSTYVDYKINLLDDNQFTRDAGINTDNIVALGLVYQF

SEQ ID NO: 5907 - protein, 190 aa, Escherichia coli
NNGRGALRQNGDGVGGSITYDYEGFGIGAAVSSSKRTDDQNGSYTSNGVVRNYIGTGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLVY

SEQ ID NO: 5908 - protein, 862 aa, Escherichia coli
MHRNKSSSGLSLYCVKTKITAVALSVMAACTLLYTGNTEARTYSFDASMLKGGGKGVDLTLFEEGAQLPGIYPVDIILNGSRVDSRDMAFRTEKDAEGKTYLKTCLTREMLARYGVMTEEYPELFHGDDGKEAEACAELSVIPQATETYQFASQQLLLSIPQVALRPPLRGIAPEALWDDGIPAFLLNWQANTSRSEYRGYGKSVTDNYWVTLEPGINLGPWRVRNLTTWNRSSGQPGQWESAYIRAERGINSLRSRLTLGEDYTPSDIFDSVPFRGVMLGADESMVPYNQREFAPVVRGIARTQARIEVRQNGYLIDSRTVAPGAFALTDLPLTGSGGDLQVTVQESDGTAQVFTVPYTTPAIALREGYMKYSIAGGEYRSSDDAVEHSPLGQMSVMYGLPWGLTAFGGAQMSSHYQSAALGLGWSMGRLGAVSVDGIHSRGQQKGRDTETGETWRLRYNKSFELTNTDLTAARYQYTSSGFHTLSDVLSTFRNDNFRAYSYSGDRSRRTTLRLNQSLGSLGYMSFYGSRDEFRHNRQKQDSFGMSYGTSWKNISWYVNWSRNYSTNAYYQRGHIEDSINLWMNIPLGQWIGGRDNDINVTTQTQRTTGQNTWYETGLNGRAFDRRLYWDVSERIAPGSENNVDSSRLNLRWFGTYGELAGMYSYSSYIRQMSAGISGGMVLHNEGITLGQKGEDTVALVVAPGVNGASVGSLPGVRTDTRGYTLVNHVSPYQENLITLDPTTFPENVEVSQTDTRVVPTKGAVVRAKFITRVGGRALITLSRSDGSRLPFGAVVTEEGKKGQMPGGAGVVGDNGEVYLSGLDETGQLKVQWGRNSSCRANYRLPEEKEATGIFLVRTVCM

SEQ ID NO: 5909 - protein, 64 aa, Escherichia coli
MKKMFMAVLFALVSVNAMAADCAKGKIEFSKYNEDDTFTVKVDGKEYWTSRWNLQPLLQSAQLT

SEQ ID NO: 5910 - protein, 64 aa, Escherichia coli
MKKMFMAVLFALVSVNAMAADCAKGKIEFSKYNENDTFTVKVAGKEYWTNRWNLQPLLQSAQLT

SEQ ID NO: 5911 - protein, 64 aa, Escherichia coli
MKKIFVAALFAFVSVNAMAADCAKGKIEFSKYNENDTFTVKVAGKEYWTNRWNLQPLLQSAQLT

SEQ ID NO: 5912 - protein, 64 aa, Escherichia coli
MKKMFIAVLFALVSVNAMAADCAKGKIEFSKYNEDNTFTVKVSGREYWTNRWNLQPLLQSAQLT

SEQ ID NO: 5913 - protein, 255 aa, Escherichia coli
MKIRHLAALVGILAGLPASGVMAAGNQESTKTTSKVFSLHLGATRVIYNLDSSGASLTVMNDLDYPMLVQSEVLAENQKDPAPFVVTPPLFRLDALQSSRLRIVRTGGVFPGDRESLQWLCVKGIPPKHDDRWAEEKGADKKKADKATLQVNLSVSSCVKLFVRPPAVKGPPEDAGGKVEWTKSGNKLKGNNPTPFYINISELSVGGKEVKEHRYISPYSSYEYEIPSGASGKVNWTVITDYGGKSKPFESELKS

SEQ ID NO: 5914 - protein, 862 aa, Escherichia coli
MHRNKSSSGLSLYCVKTKITAVALSVMAACTLLYTGNTEARTYSFDASMLKGGGKGVDLTLFEEGAQLPGIYPVDIILNGSRVDSRDMAFRTEKDAEGKTYLKTCRTREMLARYGVMTEEYPELFHGDDGKEAEACAELSVIPQATETYQFASQQLLLSIPQVALRPPLRGIAPEALWDDGIPAFLLNWQANTSRSEYRGYGKSVTDNYWVTLEPGINLGPWRVRNLTTWNRSSGQPGQWESAYIRAERGINSLRSRLTLGEDYTPSDIFDSVPFRGVMLGADESMVPYNQREFAPVVRGIARTQARIEVRQNGYLIDSRTVAPGAFALTDLPLTGSGGDLQVTVQESDGTAQVFTVPYTTPAIALREGYMKYSIAGGEYRSSDDAVEHSPLGQMSVMYGLPWGLTAFGGAQMSSHYQSAALGLGWSMGRLGAVSVDGIHSRGQQKGRDTETGETWRLRYNKSFELTNTDLTAARYQYTSSGFHTLSDVLSTFRNDNFRAYSYSGDRSRRTTLRLNQSLGSLGYMSFYGSRDEFRHNRQKQDSFGMSYGTSWKNISWYVNWSRNYSTNAYYQRGHIEDSINLWMNIPLGQWIGGRDNDINVTTQTQRTTGQNTWYETGLNGRAFDRRLYWDVSERIAPGSENNVDSSRLNLRWFGTYGELAGMYSYSSYIRQMSAGISEGMVLHNEGITLGQKGEDTVALVVAPGVNGASVGSLPGVRTDTRGYTLVNHVSPYQENLITLDPTTFPENMEVSQTDTRVVPTKGAVVRAKFITRVGGRALITLSRSDGSRLPFGAVVTEEGKKGQMPGGAGVVGDNGEVYLSGLDETGQLKVQWGRNSSCRANYRLPEEKEATGIFLVRTVCM

SEQ ID NO: 5915 - protein, 120 aa, Escherichia coli
MNTVLSVQGASAPVENKSFFSKFTRLNMLRLVRAVIPVAVLMMLFPELAMAAGKGTDLMAKGQETVKATFGKDSSIVKWVVLAEVLVGAVMYMMTKNVKFLVGFAILSVFIAVGMSVAGF

SEQ ID NO: 5916 - protein, 46 aa, Escherichia coli
MKKMFMAVLFALVSVNAMAADCAKGKIEFSKYNENDTFTVKVAGKE

SEQ ID NO: 5917 - protein, 120 aa, Escherichia coli
MDAFLSVQGASAPVKKKSFFSKFTRLNMLRLARAVIPAAVLMMFFPQLAMAAQGQDLMASGNTTVKATFGKDSSVVKWVVLAEVLVGAVMYMMTKNVKFLAGFAIISVFIAVGMAVVGLK

SEQ ID NO: 5918 - protein, 843 aa, Escherichia coli
MVKVCFFVIIAFSLFHTRNSDGKTYSFDASLLKRRGEGVDLTLFENGGQLPGIYPVDIFLNGTIVGSEDIFFHAEHSNGKPYLKACLSEELLMRYGVKTEKYPKLFLSHYGKKDERQCADLSVIPQATEEFLFEAQKLVLSIPQVAIRSPLRGVASDLIWEDGISTFLLNWQVEAGHSEFQHYEKTTSDNFWVSLEPGINIGPWRIRNLTTLNKSSGQVGKWESSYIRAERGLNNIKSRLTLGEDYTPADIFASVPFRGVMLGTDENMIPYDQRGFAPVIRGIARTQARIEIRQNGYLIQSQTVAAGPFALTDLPITGSGGEFQVTIFESDGAIQSFNVPFTTPAIALREGYLKYNISAGQYRSSDESVEKAYLWQATAMYGLPRALTVFGGVQTAEHYQAAALGVGLSLGNMGAASLDTIYSRGQQKGYDFDTGNSWRIRYDKSFELTDTSFSAASYQYSNEGYHELSDILDTYRSGANFVFNDTDRKRRRITININQSLGPWGFIGLSGGRDEYKGGDRQDYIGASYSMSWKDISFSVNWTRNRNVGDYFSNRTFNEDTVGMWMSIPLKHWLGKNDNDVNATAQIQHSTRQNTRYEMGLNGRAFDQKLYWDIREQIVPGSKYDADTSRLNMRWSGSYGELVGMYSYNSHTRQMNAGMSGSIAMHSEGITFGQRFGDTMALIAAPGVRGASVGGWPGVSTDSRGYALVSYITPYQENIITLDPTTFPENAEVLQTDTRVVPTKGAVVRAKFKTRVGNRAVVRLARADGTPLPFGTVVTLEGKTEVSNSTGVVDDKGMVYLSGLSEAGKLKAQWGMNSHCYANYRLPVKKGPAGLYLTSAVCI

SEQ ID NO: 5919 - protein, 300 aa, Escherichia coli
MTKSVSTSKKASIRCSINSYYQCMIFFYLTINWRTIYSILEMHMTTLRKYMKIRTALLVSSLPLCFFVSANAKTFENEGNKTQMFSLHLGATRVIYNIFSSGETLTIINDYDYPMLVQSEVLLEDQKTPAPFIITPPLFRLDALQSSRLRIVRTGGDFPKDRETLQWICVKGIPPKSDEKWAESNKNSLNNVTLNVQVSLSTCIKMFVRPSSVKGHPEDVAGEVKWQRVNNKLKGVNPTPFYINLSELRVGGEEISEHHYIAPFSSFEYPIPVSKSSKVQWKIVTDYGGVSEFFETDINL

SEQ ID NO: 5920 - protein, 1023 aa, Escherichia coli
MTTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNILGGGAENIGDNLGKAGGILSTFQNFLGTALSSMKIDELIKKQKSGGNVSSSELAKASIELINQLVDTVASLNNVNSFSQQLNTLGSVLSNTKHLNGVGNKLQNLPNLDNIGAGLDTVSGILSAISASFILSNADADTRTKAAAGVELTTKVLGNVGKGISQYIIAQRAAQGLSTSAAAAGLIASAVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGAVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGKNLTETDNLYSVEELIGTTRADKFFGSKFTDIFHGADGDDLIEGNDGNDRLYGDKGNDTLSGGNGDDQLYGGDGNDKLIGVAGNNYLNGGDGDDEFQVQGNSLAKNVLFGGKGNDKLYGSEGADLLDGGEGDDLLKGGYGNDIYRYLSGYGHHIIDDDGGKEDKLSLADIDFRDVAFKREGNDLIMYKGEGNVLSIGHKNGITFRNWFEKESGDISNHEIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 5921 - protein, 121 aa, Escherichia coli
MDAVLSVQGASAPVKKKSFFSKFTRLNMLRLARAVIPAAVLMMFFPQLAMAASSSGQDLMASGNTTVKATFGKDSSIVKWVVLAEVLVGAVMYMMTKNVKFLAGFAIISVFIAVGMAVVGL

SEQ ID NO: 5922 - protein, 375 aa, Escherichia coli
MKVKVLSLLVPALLVAGAANAAEVYNKDGNKLDLYGKVDGLHYFSDDKSVDGDQTYMRLGFKGETQVTDQLTGYGQWEYQIQGNAPESENNSWTRVAFAGLKFQDIGSFDYGRNYGVVYDVTSWTDVLPEFGGDTYGSDNFMQQRGNGFATYRNTDFFGLVDGLNFAVQYQGQNGSVSGENDPDFTGHGITNNGRKALRQNGDGVGGSITYDYEGFGVGAAVSSSKRTWDQNNTGLIGTGDRAETYTGGLKYDANNIYLAAQYTQTYNATRVGSLGWANKAQNFEAVAQYQFDFGLRPSVAYLQSKGKNLGVVAGRNYDDEDILKYVDVGATYYFNKNMSTYVDYKINLLDDNQFTRAAGINTDDIVALGLVYQF

SEQ ID NO: 5923 - protein, 374 aa, Escherichia coli
MKVKVLSLLVPALLVAGAANAAEVYNKDGNKLDLYGKVDGLHYFSDNKSEDGDQTYVRLGFKGETQVTDQLTGYGQWEYQIQGNTSEDNKENSWTRVAFAGLKFQDVGSFDYGRNYGVVYDVTSWTDVLPEFGGDTYGSDNFMQQRGNGYATYRNTDFFGLVDGLNFAVQYQGKNGSVSGEGMTNNGRGALRQNGDGVGGSITYDYEGFGIGAAVSSSKRTDDQNFGLNGYGERYLGNGDRAETYTGGLKYDANNIYLAAQYTQTYNATRVGSLGWANKAQNFEAVAQYQFDFGLRPSVAYLQSKGKNLGVVAGRNYDDEDILKYVDVGATYYFNKNMSTYVDYKINLLDDNQFTRDAGINTDDIVALGLVYQF

SEQ ID NO: 5924 - protein, 79 aa, Escherichia coli
MFFPQLALAAQGAGQDLMQSGNSTVKATFGKDSSVVKWVVLAEVLVGAVMYMMTKNVKFLAGFAIISVFIAVGMAVVGL

SEQ ID NO: 5925 - protein, 265 aa, Escherichia coli
MKMRAVAVFTGMLTGVLSVTGLLSAGAYAAGGEGNMSASATETNARVFSLHLGATRVVYNPASSGETLTVINDQDYPMLVQSEVLSEDQKSPAPFVVTPPLFRLDGQQSSRLRIVRTGGEFPSDRESLQWICVKGIPPKEDDRWAEGKDGEKKADKVSLNVQLSVSSCIKLFVRPPAVKGRPDDVAGKVEWQRAGNRLKGVNPTPFYINLSTLTVGGKEVKEREYIAPFSSREYPLPAGASGKVQWKVITDYGGTSKQFEAELKG

SEQ ID NO: 5926 - protein, 121 aa, Escherichia coli
MNFKKSIALLFIALNIASLPTYAGVSKTFKDKCASTTAKLVQSVQLVNISSDVNKDSKGIYISSSAGKTWFIPGGQYYPDNYLSNEMRKIAMAAVLSNVRVNLCASEAYTPNHVWAIELAP

SEQ ID NO: 5927 - protein, 259 aa, Escherichia coli
MIKHVLLFFVFISFSVSANDFFRADSRTPDEIRRAGGLLPRGQQEAYERGTPININLYDHARGTVTGNTRYNDGYVSTTTTLRQAHLIGQNLLGSYNEYYIYVVAPAPNLFDVNGVLGRYSPYPSENEFAALGGIPLSQIIGWYRVSFGVIEGGMQRNRHYRRDLFQGLSVAPNHDGYHLAGFPDGFAAWRELPWSAFAPEQCEQDYMVRNLDACDSYTNILSQNDLVAFKRFMRIRSSLMILQSIEDDLQDNENKDEL

SEQ ID NO: 5928 - protein, 259 aa, Escherichia coli
MIKHLLLFFVFISFSVSANDFFRADTRTPSEIRQAGGLLPRGQQEAYERGTPININLYDHARGTVTGNTRYNDGYVSTTTTLRQAHLIGQNLLGSYNEYYIYVVAPAPNLFDVNGVLGRYSPYPSENEFAALGGIPLSQIIGWYRVSFGVIEGGMQRNRHYRRDLFQGLSVAPNHDGYHLAGFPDGFAAWRELPWSAFAPAACEHDYMVRILDACDSYTNRISKNDLFAFKRFMRIRSSLMILQSIEDDLQYNENKNEL

SEQ ID NO: 5929 - protein, 122 aa, Escherichia coli
MNFKKSIALLFVVLNITSLPTYADVSKNFKDNCGSTTAKIVQSVRLVKLASDTNKDSKGIYITDSTGKTRFIPGGQYYPENYLSNEMRKIAMAAVLSNVRVNICASEAYTPNHVWAIELAAE

SEQ ID NO: 5930 - protein, 259 aa, Escherichia coli
MIKHVLLFFVFISFSVSANDFFRADSRTPDEIRRAGGLLPRGQQEAYERGTPININLYEHARGTVTGNTRYNDGYVSTTTTLRQAHLIGQNILGSYNEYYIYVVAPAPNLFDVNGVLGRYSPYPSENEFAALGGIPLSQIIGWYRVSFGAIEGGMQRNRHYRGDLFQGLSVAPNHDGYHLAGFPEGFAAWRELPWSAFAPEQCEQDYMVRNLDACDSYTNILSQNDLVAFKRFMRIRSSLMILQSIEDDLQNNENKDEL

SEQ ID NO: 5931 - protein, 122 aa, Escherichia coli
MNFKKSIALLFIALNIASLPTYAGVSKTFKDKCASTTAKLVQSVQLVKLASDTNKDSKGIYITDSTGKTRFIPGGQYYPENYLSNEMRKIAMAAVLSNVRVNICASEAYTPNHVWAIELAAE

SEQ ID NO: 5932 - protein, 259 aa, Escherichia coli
MIKHLLLFFVFISFSVSANDFFRADTRTPSEIRQAGGLLPRGQQEAYERGTPININLYDHARGTVTGNTRYNDGYVSTTTTLRQAHLIGQNLLGSYNEYYIYVVAPAPNLFDVNGVLGRYSPYPSENEFAALGGIPLSQIIGWYRVSFGVIEGGMQRNRHYRRDLFQGLSVAPNHDGYHLAGFPDGFAAWRELPWSAFAPAACEHDYMVRILDACDSYTNRISKNDLFAFKRFMRIRSSLMILQSIEDDLQYNENKDEL

SEQ ID NO: 5933 - protein, 121 aa, Escherichia coli
MNFKKLIALLFIVLNIASLPTYAGVSKTFKDNCASTTAKLVQSVQLVNISSDVNKDSKGIYISSSAGKTWFIPGGQYYPDNYLSNEMRKIAMAAVLSNVRVNLCASEAYTPNHVWAIELAP

SEQ ID NO: 5934 - protein, 259 aa, Escherichia coli
MIKHVLLFFVFISFSVSANDFFRADSRTPDEIRRAGGLLPRGQQEAYERGTPININLYDHARGTVTGNTRYNDGYVSTTTTLRQAHLIGQNLLGSYNEYYIYVVAPAPNLFDVNGVLGRYSPYPSENEFAALGGIPLSQIIGWYRVSFGVIEGGMQRNRHYRRDLFQGLSVAPNHDGYHLAGFPDGFAAWRELPWSAFAPAACEHDYMVRILDACDSYTNRISQNDLVAFKRFMRIRSSLMILQSIEDDLQDNENKDEL

SEQ ID NO: 5935 - protein, 240 aa, Escherichia coli
MKHILLFIFTVLLSLPSYGSVVIMGTRVIYPAEQKSINVRLNNGDSTPSLIQAWLDTGDPSSPPDSVRVPFIITPPVFRMEPLSGQTMRIMYTGEKLPADRESLFWLNVLDIPAKPSFAGKSEKAQGYNYLQFAVRSRIKFFFRPDGLPFSPDDAYKKVTWQLTGGDTLQASNPTPYFITFSTVSVGQGAQKVSSTQGGMAAPFSSVTFRLKQKVSPSGKVEWTVVNDNGGYQKGESVVK

SEQ ID NO: 5936 - protein, 821 aa, Escherichia coli
MLSVPLWAAEDAEFDPSFLSRTPGSSVIDVRRFMHGNPVSSGNYYSDIYLNGEWKGNAELSFRDMSSSQEESVLCVTPELLSILDVSPEAVAREPDTGNGRCMPFSAVVPDAKIRFDLSLLRLNVEIPQAMLVSRPRGYISPSQWQTGVPAAFVSYDVNHWRYRTPDMENNQSYLGLRAGFNAGGWAFRHRGTESWSDSHAEGYRSIETNLQHDIAMLRAQLTLGDFTTTGELMDSNSLRGIRLASDDRMLPGSLRGYAPVVRGMAGSNARVTVRQNGNIIYETTVPAGPFSISDLYPSGYGGDLTVTVTESDGQTRSFIVPFASVAQLVRPGFSRWQVAAGRYRYGNRTFSDTVFQGTLQYGLTNDITLNTGMSTAPHYLSGLGGVAFNTPLGLLPRILRWPERLSRVLTRHIAYSLHAGYSARIPETSTNVTLAAYRYSSRDFWSLRDAILTRNRDVINDSSVRSATGYRPRNQLQLTVNQSLGEGWGNLYLTGATYHYWGHTGTFNEYQAGYNNVWKKMSYQIGFSQTRRSGDYHHDNRFFFSFSLPLSDTGRTLLSTTVNVSDKNSNSIQSSISGVSGDDNQLSYGVSLNTQENGPTGYAVNGSYRSPVATLQATAGNDSRHNRQISAGISGAIVAHPFGVTASNDLGDTFTVIHADGAGGAVINNAPGNRLDPWGNGIVPYVTPYEKNYISIDPTALAADVELSATEREIIPRANSTTMVTFTTKTGKAMLFDVKMPDGTPPPMAAEALTADGKSAGYIAQGGRLFVRDLDAEKGMLRIVWGSGQNDSCVIHYSASGENARGNAVPENHHVVCMRQ

SEQ ID NO: 5937 - protein, 585 aa, Escherichia coli
MLNEEQYYQFFLSVLDVYGFAVVDMHNGILKVVRSKDAKTSAVPVASDVSPGTGDEVVTRVVPVSNVAARDLAPLLRQLNDNAGAGSVVHYEPSNVLLMTGRAAVMKRLMEIVERVDKVGNRSVATVPLTYASATDVARLVTELTKETDKTAIPAWMTAKLVADERTNSVLVSGEPISQQRIISIIKQLDRQEDVQGNTKVIYLKYAKAKDLVEVLTGISSSIENDSKKSPSTEALRKGVTIKSHEQTNALILTGAPDVIRDLENVISQLDIRRPQVLVEAIIAEIQDADGLNLGIQWVNKHAGVAQFTSTGLPITTMVQTRQNEILDSDQSNALSMFNGIAAGFYQGNWAMLLTALSTSSKNDILATPSIVTLDNMEATFNVGQEVPVLSGSQTTSGDNIFNTVERKTVGIKLRVKPQINEGDSVLLEIEQEVSGVADTAVATTTDLGATFNTRTVTNAMLVGNGETVVVGGLLDKSIRGSESKVPLLGDIPVLGHLFRAKSEQTAKRNLMLFIRPTIIRERDGFRHASAEKYQSFNQEQVQSRGKETTALTLNEEQLRLSPDQDDTAFRKVKAAIAAFYAQEM

SEQ ID NO: 5938 - protein, 1300 aa, Escherichia coli
MNKIYSLKYSHITGGLIAVSELSGRVSSRATGKKKHKRILALCFLGLLQSSYSFASQMDISNFYIRDYMDFAQNKGIFQAGATNIEIVKKDGSTLKLPEVPFPDFSPVANKGSTTSIGGAYSITATHNTKNHHSVATQNWGNSTYKQTDWNTSHPDFAVSRLDKFVVETRGATEGADISLSKQQALERYGVNYKGEKKLIAFRAGSGVVSVKKNGRITPFNEVSYKPEMLNGSFVHIDDWSGWLILTNNQFDEFNNIASQGDSGSALFVYDNQKKKWVVAGTVWGIYNYANGKNHAAYSKWNQTTIDNLKNKYSYNVDMSGAQVATIENGKLTGTGSDTTDIKNKDLIFTGGGDILLKSSFDNGAGGLVFNDKKTYRVNGDDFTFKGAGVDTRNGSTVEWNIRYDNKDNLHKIGDGTLDVRKTQNTNLKTGEGLVILGAEKTFNNIYITSGDGTVRLNAENALSGGEYNGIFFAKNGGTLDLNGYNQSFNKIAATDSGAVITNTSTKKSILSLNNTADYIYHGNINGNLDVLQHHETKKENRRLILDGGVDTTNDISLRNTQLSMQGHATEHAIYRDGAFSCSLPAPMRFLCGSDYVAGMQNTEADAVKQNGNAYKTNNAVSDLSQPDWETGTFRFGTLHLENSDFSVGRNANVIGDIQASKSNITIGDTTAYIDLHAGKNITGDGFGFRQNIVRGNSQGETLFTGGITAEDSTIVIKDKAKALFSNYVYLLNTKATIENGADVTTQSGMFSTSDISISGNLSMTGNPDKDNKFEPSIYLNDASYLLTDDSARLVAKNKASVVGDIHSTKSASIMFGHDESDLSQLSDRTSKGLALGLLGGFDVSYRGSVNAPSASATMNNTWWQLTGDSALKTLKSTNSMVYFTDSANNKKFHTLTVDELATSNSAYAMRTNLSESDKLEVKKHLSGENNILLVDFLQKPTPEKQLNIELVSAPKDTNENVFKASKQTIGFSDVTPVITTRETDDKITWSLTGYNTVANKEATRNAAALFSVDYKAFLNEVNNLNKRMGDLRDINGEAGAWARIMSGTGSASGGFSDNYTHVQVGVDKKHELDGLDLFTGFTVTHTDSSASADVFSGKTKSVGAGLYASAMVDSGAYIDLIGKYVHHDNEYTATFAGLGTRDYSTHSWYAGAEAGYRYHVTEDAWIEPQAELVYGSVSGKQFAWKDQGMHLSMKDKDYNPLIGRTGVDVGKSFSGKDWKVTARAGLGYQFDLLANGETVLRDASGEKRIKGEKDSRMLMSVGLNAEIRDNVRFGLEFEKSAFGKYNVDNAVNANFRYSF

SEQ ID NO: 5939 - protein, 512 aa, Escherichia coli
MKKISFFIFTALFCCSAQAAPSSLEKRLGKNEYFIITKSSPVRAILNDFAANYSIPVFISSSVNDDFSGEIKNEKPVKVLEKLSKLYHLTWYYDENILYIYKTNEISRSIITPTYLDIDSLLKYLSDTISVNKNSCNVRKITTFNSIEVRGVPECIKYITSLSESLDKEAQSKAKNKDVVKVFKLNYASATDITYKYRDQNVVVPGVVSILKTMASNGSLPSTGKGAVERSGNLFDNSVTISADPRLNAVVVKDREITMDIYQQLISELDIEQRQIEISVSIIDVDANDLQQLGVNWSGTLNAGQGTIAFNSSTAQVNISSSVISNASNFMIRVNALQQNSKAKILSQPSIITLNNMQAILDKNVTFYTKVSGEKVASLRSITSGTLLRVTPRILDDSSNSLTGKRRERVRLLLDIQDGNQSTNQSNAQDASSTLPEVQNSEMTTEATLSAGESLLLGGFIQDKESSSKDGIPLLSDIPVIGSLFSSTVKQKHSVVRLFLIKATPIKSASSE

SEQ ID NO: 5940 - protein, 258 aa, Escherichia coli
MSKRNAVTTFFTNRVTKALGITLALMMTCQSAVASLAADQTRYIFRGDKDALTITVTNNDKERTFGGQAWVDNIVEKDTRPTFVVTPSFFKVKPNGQQTMRIIMASDHLPEDKESVYWLNLQDIPPALEGSGIAVALRTKLKLFYRPKALLEGRKGAEEGLSLQSRPDGRIMLVNTTPYIFAIGSLLDGNGKKIATDNETAQKLLMFMPGDEVQVKGNVVKVDSLNDYGELQTWTINKKKPTTPEAAKTEKADSTEQK

SEQ ID NO: 5941 - protein, 258 aa, Escherichia coli
MKNITFIFFILLASPLYANGDKLYRADSRPPDEIKRSGGLMPRGHNEYFDRGTQMNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNSSRTITDDTCNEETQNLSTIYLRKYQSKVKRQIFSDYQSEVDIYNRIRDEL

SEQ ID NO: 5942 - protein, 181 aa, Escherichia coli
GSSLNDLVRTADELGIEVQYDEKNGTAITKQVFGTAEKLIGLTERGVAIFAPQLDKLLQKYQKAGNKLGGSAENIGDNLGKAGSVLSTFQNFLGAALSSMKIDELIKKQKSGNNVSSSELAKASIELINQLVDTAASINNNVNSFSQQLNKLGSVLSNTKHLNGVGNKLQNLPNLDNIGAG

SEQ ID NO: 5943 - protein, 181 aa, Escherichia coli
GSSLNDLVRTADELGIEVQYDEKNGTAITKQVFGTAEKLIGLTERGVAIFAPQLDKLLQKYQKAGNKLGGSAENIGDNLGKAGSVLSTFQNFLGTALSSMKIDELIKKQKSGNNVSSSELAKASIELINQLVDTAASINNNVNSFSQQLNKLGSVLSNTKHLNGVGNKLQNLPNLDNIGAG

SEQ ID NO: 5944 - protein, 181 aa, Escherichia coli
GSSLNDLVRTADELGIEVQYDEKNGTAITKQVFGTAEKLIGLTERGVTIFAPQLDKLLQKYQKAGNKLGGSAENIGDNLGKAGSVLSTFQNFLGTALSSMKIDELIKKQKSGSNVSSSELAKASIELINQLVDTAASINNNVNSFSQQLNKLGSVLSNTKHLNGVGNKLQNLPNLDNIGAG

SEQ ID NO: 5945 - protein, 236 aa, Escherichia coli
MLSVYNRTQKFKAEARKKIAKYHELRKQRGMSLLEVIIVLGIIGTIAAGVVILAQRAFDSRAVTDLVTNTNTVRVRMKDAYQRDGKYPDFVDPLSLTANTIKTDTSGIPAAQLVQLGKITPDEVRNNISGDFIAIGGALTSNGAQVKKGFAIELNGLSQEQCRSILGQVGNNWEYVAIGTSASGSYAMTATGVDMSVAASTTVLRSLGNNGQTTLTADKILSTCTAQVNSITLGSR

SEQ ID NO: 5946 - protein, 998 aa, Escherichia coli
MTVNKIKNIFNNATSTTKSAFNTASSSVRSAGKKLILLIPDNYEAQGVGINELVKAADELGIEIHRTERDDTAIANQFFGTAEKVVGLTERGVAIFAPQLDKLLQKYQKVGSKIGGTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGPLGDGLDVVSGILSAVSASFILGNSDAHTGTKAAAGIELTTQVLGNVGKAVSQYILAQRMAQGLSTTAASAGLITSAVMLAISPLSFLAIADKFERAKQLESYSERFKKFNYEGDALLAAFHKESGAIDAALTTINTVLSSVSAGVSAASSASLIGAPISMLVSALTGTISGILEASKQAMFEHVADKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFVTPTFTPGEEVRERKQSGKYEYMTSLIVNGKDTWSVKGIKNHKGVYDYSNLIQFVEKDNKHYQARIISELGDKDDIVYSGAGSSEVFAGEGHDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYRQNYGHHTIADEGGKGDRLHLSDISFDDIAFKKVGNDLIMNKAINGALSFNESNDVNGITFKNWFAKDASGEDNHLVEVITDKDGREIKADKISHNNNEQSGYIKASNIASEKNMVNITSVANDINKIISSVSGFDSGDERLASLYNLSLHQNNTHSTTLTTTV

SEQ ID NO: 5947 - protein, 230 aa, Escherichia coli
MNKLTKGALVTLLSLSFCGQSMAAFVLNGTRFIFEEGKKNLSFEVTNNADKTYGGQVWIDNTNRGNGVYMVPQPPFFKVGAKQKQVIRIMNTDSNLPKDRESLFWLNVQEVPPKPKVKDGEGSVLAIAMNTRVKLIYRPASLKGGRKDAEKQLRLEQRGNETWLKNPTPYYMAIVNIKRDGKDIPLGDSVMKGIAQLRPFSNVSLGKNVSGKISVDAVNDWGGVQSYEIH

SEQ ID NO: 5948 - protein, 512 aa, Escherichia coli
MKKISFFIFTALFCCSAQAAPSSLEKRLGKSEYFIITKSSPVRAILNDFAANYSIPVFISSSVNDDFSGEIKNEKPVKVLEKLSKLYHLTWYYDENILYIYKTNEISRSIITPTYLDIDSLLKYLSDTISVNKNSCNVRKITTFNSIEVRGVPECIKYITSLSESLDKEAQSKAKNKDVVKVFKLNYASATDITYKYRDQNVVVPGVVSILKTMASNGSLPSTGKGAVERSGNLFDNSVTISADPRLNAVVVKDREITMDIYQQLISELDIEQRQIEISVSIIDVDANDLQQLGVNWSGTLNAGQGTIAFNSSTAQANISSSVISNASNFMIRVNALQQNSKAKILSQPSIITLNNMQAILDKNVTFYTKVSGEKVASLESITSGTLLRVTPRILDDSSNSLTGKRRERVRLLLDIQDGNQSTNQSNAQDASSTLPEVQNSEMTTEATLSAGESLLLGGFIQDKESSSKDGIPLLSDIPVIGSLFSSTVKQKHSVVRLFLIKATPIKSASSE

SEQ ID NO: 5949 - protein, 656 aa, Escherichia coli
MRLKKRYLCTVLSIAFTQQSVAVQESDTLTVWSSPVSSTTTTVFDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQNNAYDMHASFAASSDLGYLQVSGSQLKQDFLGLPHGVNNDIAGKHGKMTNSSADDKRGIVKLGFTPRENDEYTLTYIKQDGEKDNPPYSGNSGQKSRYWQWPEYDKESFYYQGTTQLNDRFTLKSRLYHDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 5950 - protein, 669 aa, Escherichia coli
MIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPNLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 5951 - protein, 1377 aa, Escherichia coli
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTKMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 5952 - protein, 72 aa, Escherichia coli
MKKLMLAIFISVLSFPSFSQSTESLDSSKEKITLETKKCDVVKNNSEKKSENMNNTFYCCELCCNPACAGCY

SEQ ID NO: 5953 - protein, 18 aa, Escherichia coli
NTFYCCELCCYPACAGCN

SEQ ID NO: 5954 - protein, 49 aa, Escherichia coli
MKKAKAIFLFILIVSGFLLVACQANYIRDVQGGTVAPSSSSELTGIAVQ

SEQ ID NO: 5955 - protein, 185 aa, Escherichia coli
MIKSVIAGAVAMAVVSFGVNNAAPTIPQGQGKVTFNGTVVDAPCSISQKSADQSIDFGQLSKSFLEAGGVSKPMDLDIELVNCDITAFKGGNGAKKGTVKLAFTGPIVNGHSDELDTNGGTGTAIVVQGAGKNVVFDGSEGDANTLKDGENVLHYTAVVKKSSAVGAAVTEGAFSAVANFNLTYQ

SEQ ID NO: 5956 - protein, 626 aa, Escherichia coli
MSDPVRITNPGAESLGYDSDGHEIMAVDIYVNPPRVDVFHGTPPAWSSFGNKTIWGGNEWVDDSPTRSDIEKRDKEITAYKNTLSAQQKENENKRTEAGKRLSAAIAAREKDENTLKTLRAGNADAADITRQEFRLLQAELREYGFRTEIAGYDALRLHTESRMLFADADSLRISPREARSLIEQAEKRQKDAQNADKKAADMLAEYERRKGILDTRLSELEKNGGAALAVLDAQQARLLGQQTRNDRAISEARNKLSSVTESLKTARNALTRAEQQLTQQKNTPDGKTIVSPEKFPGRSSTNHSIVVSGDPRFAGTIKITTSAVIDNRANLNYLLTHSGLDYKRNILNDRNPVVTEDVEGDKKIYNAEVAEWDKLRQRLLDARNKITSAESAINSARNNVSARTNEQKHANDALNALLKEKENIRSQLADINQKIAEEKRKRDEINMVKDAIKLTSDFYRTIYDEFGKQASELAKELASVSQGKQIKSVDDALNAFDKFRNNLNKKYNIQDRMAISKALEAINQVHMAENFKLFSKAFGFTGKVIERYDVAVELQKAVKTDNWRPFFVKLESLAAGRAASAVTAWAFSVMLGTPVGILGFAIIMAAVSALVNDKFIEQVNKLIGI

SEQ ID NO: 5957 - protein, 45 aa, Escherichia coli
MRKRFFVGIFAINLLVGCQANYIRDVQGGTIAPSSSSKLTGIAVQ

SEQ ID NO: 5958 - protein, 258 aa, Escherichia coli
MKNITFIFFILLASPLYANGDRLYRADSRPPDEIKRSGGLMPRGHNEYFDRGTQMNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNSSRTITGDTCNEETQNLSTIYLREYQSKVKRQIFSDYQSEVDIYNRIRDEL

SEQ ID NO: 5959 - protein, 846 aa, Escherichia coli
MKNRNRMIVNCVTASLMYYWSLPALAEQSSSEIKIVRDEYGMPHIYANDTWHLFYGYGYVVAQDRLFQMEMARRSTQGTVAEVLGKDFVKFDKDIRRNYWPDAIRAQIAALSPEDMSILQGYADGMNAWIDKVNTNPETLLPKQFNTFGFTPKRWEPFDVAMIFVGTMANRFSDSTSEIDNLALLTALKDKYGVSQGMAVFNQLKWLVNPSAPTTIAVQESNYPLKFNQQNSQTAALLPRYDLPAPMLDRPAKGADGALLALTAGKNRETIAAQFAQGGANGLAGYPTTSNMWVIGKSKAQDAKAIMVNGPQFGWYAPAYTYGIGLHGAGYDVTGNTPFAYPGLVFGHNGVISWGSTAGFGDDVDIFAERLSAEKPGYYLHNGKWVKMLSREETITVKNGQAETFTVWRTVHGNILQTDQTTQTAYAKSRAWDGKEVASLLAWTHQMKAKNWQEWTQQAAKQALTINWYYADVNGNIGYVHTGAYPDRQSGHDPRLPVPGTGKWDWKGLLPFEMNPKVYNPQSGYIANWNNSPQKDYPASDLFAFLWGGADRVTEIDRLLEQKPRLTADQAWDVIRQTSRQDLNLRLFLPTLQAATSGLTQSDPRRQLVETLTRWDGINLLNDDGKTWQQPGSAILNVWLTSMLKRTVVAAVPMPFDKWYSASGYETTQDGPTGSLNISVGAKILYEAVQGDKSPIPQAVDLFAGKPQQEVVLAALEDTWETLSKRYGNNVSNWKTPAMALTFRANNFFGVPQAAAEETRHQAEYQNRGTENDMIVFSPTTSDRPVLAWDVVAPGQSGFIAPDGTVDKHYEDQLKMYENFGRKSLWLTKQDVEAHKESQEVLHVQR

SEQ ID NO: 5960 - protein, 47 aa, Escherichia coli
MKKITGIILLLLAVIILSACQANYIRDVQGGTVSPSSTAEVTGLATQ

SEQ ID NO: 5961 - protein, 812 aa, Escherichia coli
MKKYVTTKSVQPVAFRLTTLSLVMSAVLGSASVIAGEKLDMSFIQGGGGVNPEVWAALNGSYAPGRYLVDLSLNGKEAGKQILDVTPQDSNELCLTEAWLTKAGVYVSADYFREGYDATRQCYVLTKAPSVKVDFDVSTQSLALSIPQKGLVKMPENVDWDYGTSAFRVNYNANANTGRNNTSAFGSADLKANIGHWVVSSSATASGGDSGDNSTTINMFTATRAIRALSADLAVGKTSTGDSLLGSTGTYGVSLSRNNSMKPGNLGYTPVFSGIANGPSRVTLTQNGRLLHSEMVPAGPFSITDVPLYTSGDVTMKITGEDGRDEVQNFPLSVMAGQLSPGQHEFSVAAGLPDDDSDLKGGVFAASYGYGLDGLTLRAGGVFNQDWQGASAGVVAGLGYLGAVSADGAYATAKYRDGSHSGNKVQLSWSKQLETTNTGLRVSWSRQSEEYEGMSSFDPTELWSQSNHGRRTKDEWNAGISQPVGGLFSLSVSGWQRSYYPASMTGSYRYSDDNGKETGITGSLSTQIKGVSLNLGWSGSRNSRGENNWSASASVSVPFTLFDRRYSSSASVSTSKGGGTGFSTGVSGSLNDRFSYGLGGGRDGDGGTSSYLNASYSGDRAYLNGVLNHSQSGGTSGSVSVSGSVLAVPAAKDIMFSRTTGDTVAVVNVKDTPGVKVTSGDGQTDSDGNLVVPLNSYDWNTVTIDTGTLPLSTELTNTSQKVVPTDKAVVWMPFDALKVKRYLLQVKQRDGEFVPGGTWARDSKNTPLGFVANNGVLMINTVDAPGDITLGQCRIPAARLQDTEKLQEITCE

SEQ ID NO: 5962 - protein, 836 aa, Escherichia coli
MKDRIPFAVNNITCVILLSLFCNAASAVEFNTDVLDAADKKNIDFTRFSEAGYVLPGQYLLDVIVNGQSISPASLQISFVEPALSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 5963 - protein, 195 aa, Escherichia coli
MRLRFSVPLFFFGCVFVHGVFAGPFPPPGMSLPEYWGEEHVWWDGRAAFHGEVVRPACTLAMEDAWQIIDMGETPVRDLQNGFSGPERKFSLRLRNCEFNSQGGNLFSDSRIRVTFDGVRGETPDKFNLSGQAKGINLQIADVRGNIARAGKVMPAIPLTGNEEALDYTLRIVRNGKKLEAGNYFAVLGFRVDYE

SEQ ID NO: 5964 - protein, 72 aa, Escherichia coli
MKKSILFIFLSVLSFSPFAQDAKPVESSKEKITLESKKCNIAKKSNKSGPESMNSSNYCCELCCNPACTGCY

SEQ ID NO: 5965 - protein, 173 aa, Escherichia coli
MKKIRGLCLPVMLGAVLMSQHVHAVDNLTFRGKLIIPACTVSNTTVDWQDVEIQTLSQNGNHEKEFTVNMRCPYNLGTMKVTITATNTYNNAILVQNTSNTSSDGLLVYLYNSNAGNIGTAITLGTPFTPGKITGNNADKTISLHAKLGYKGNMQNLIAGPFSATATLVASYS

SEQ ID NO: 5966 - protein, 167 aa, Escherichia coli
MIRLSLFISLLLTSVAVLADVQINIRGNVYIPPCTINNGQNIVVDFGNINPEHVDNSRGEVTKTISISCPYKSGSLWIKVTGNTMGGGQNNVLATNITHFGIALYQGKGMSTPLILGNGSGNGYGVTAGLDTARSTFTFTSVPFRNGSGILNGGDFQTTASMSMIYN

SEQ ID NO: 5967 - protein, 1024 aa, Escherichia coli
  MOD_RES (517)..(517): Any amino acid
MTTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNILGGGAENIGDNLGKAGGILSTFQNFLGTALSSMKIDELIKKQKSGGNVSSSELAKASIELINQLVDTVASLNNNVNSFSQQLNTLGSVLSNTKHLNGVGNKLQNLPNLDNIGAGLDTVSGILSAISASFILSNADADTRTKAAAGVELTTKVLGNVGKGISQYIIAQRAAQGLSTSAAAAGLIASAVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKXDEFQKQVFDPLKGNIDLSDSKSSTLLKFVTPLLTPGEEIRERRQSGKYEYITELLVKGVDKWTVKGVQDKGAVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGKNLTETDNLYSVEELIGTTRADKFFGSKFTDIFHGADGDDLIEGNDGNDRLYGDKGNDTLSGGNGDDQLYGGDGNDKLIGVAGNNYLNGGDGDDEFQVQGNSLAKNVLFGGKGNDKLYGSEGADLLDGGEGDDLLKGGYGNDIYRYLSGYGHHIIDDDGGKEDKLSLADIDFRDVAFKREGNDLIMYKGEGNVLSIGHKNGITFRNWFEKESGDISNHEIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 5968 - protein, 52 aa, Escherichia coli
MCGKILLILFFIMTLSACQVNHIRDVKGGTVAPSSSSRLTGLKLSKRSKDPL

SEQ ID NO: 5969 - protein, 1023 aa, Escherichia coli
MPTITAAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGSAENIGDNLGKAGSVLSTFQNFLGTALSSMKIDELIKKQKSGGNVSSSELAKASIELINQLVDTAASLNNVNSFSQQLNKLGSVLSNTKHLNGVGNKLQNLPNLDNIGAGLDTVSGILSAISASFILSNADADTGTKAAAGVELTTKVLGNVGKGISQYIIAQRAAQGLSTSAAAAGLIASVVTLAISPLSFLSIADKFKRANKIEEYSQRFKKLGYDGDSLLAAFHKETGAIDASLTRISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGSVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGKNLTETDNLYSVEELIGTTRADKFFGSKFADIFHGADGDDHIEGNDGNDRLYGDKGNDTLSGGNGDDQLYGGDGNDKLIGGAGNNYLNGGDGDDELQVQGNSLAKNVLSGGKGNDKLYGSEGADLLDGGEGNDLLKGGYGNDIYRYLSGYGHHIIDDDGGKDDKLSLADIDFRDVAFRREGNDLIMYKAEGNVLSIGHKNGITFKNWFEKESGDISNHQIEQIFDKDGRVITPDSLKKALEYQQSNNKASYVYGNDALAYGSQGNLNPLINEISKIISAAGNFDVKEERAAASLLQLSGNASDFSYGRNSITLTASA

SEQ ID NO: 5970 - protein, 128 aa, Escherichia coli [sequence omitted]

SEQ ID NO: 5971 - protein, 124 aa, Escherichia coli; identical to SEQ ID NO: 5621

SEQ ID NO: 5972 - protein, 538 aa, Escherichia coli
MPIGNLGHNPNVRALIPPAPPLPSQTDGAGGARNQLINSNGPMGSRLLFTPIRNSVADAADSRASDIPGLPTNPLRFAASEVSLHGALEVLHDKGGLDTLNSAIGSSLFRVETRDDGSHVAIGQKNGLETTVVLSEQEFSSLQSLDPEGKNKFVFTGGRGGAGHAMVTVASDIAEARQRIIDKLEPKDTKETKEPGDPNSGEGKIIEIHTSTSTSSLRADPKLWLSLGTIAAGLIGMAATGIAQAVALTPEPDDPITTDPDAAANTAEAAAKDQLTKEAFQNPDNQKVNIDENGNAIPSGELKDDVVAQIAEQAKAAGEQARQEAIESNSQAQQKYDEQHAKREQEMSLSSGVGYGISGALILGGGIGAGVTAALHRKNQPAEQTITTRTVVDNQPTNNASAQGNTDTSGPEESPASRRNSNASLASNGSDTSSTGTVENPYADVGMPRNDSLARISEEPIYDEVAADPNYSVIQHFSGNSPVTGRLVGTPGQGIQSTYALLASSGGLRLGMGGLTGGGESAVSTANAAPTPGPARFV

SEQ ID NO: 5973 - protein, 538 aa, Escherichia coli; identical to SEQ ID NO: 5972

SEQ ID NO: 5974 - protein, 558 aa, Escherichia coli
MPIGNLGHNPNVNNSIPPAPPLPSQTDGAGGRGQLINSTGPLGSRALFTPVRNSMADSGDNRASDVPGLPVNPMRLAASEITLNDGFEVLHDHGPLDTLNRQIGSSVFRVETQEDGKHIAVGQRNGVETSVVLSDQEYARLQSIDPEGKDKFVFTGGRGGAGHAMVTVASDITEARQRILELLEPKGTGESKGAGESKGVGELRESNSGAENTTETQTSTSTSSLRSDPKLWLALGTVATGLIGLAATGIVQALALTPEPDSPTTTDPDAAASATETATRDQLTKEAFQNPDNQKVNIDELGNAIPSGVLKDDVVANIEEQAKAAGEEAKQQAIENNAQAQKKYDEQQAKRQEELKVSSGAGYGLSGALILGGGIGVAVTAALHRKNQPVEQTTTTTTTTTTTSARTVENKPANNTPAQGNVDTPGSEDTMESRRSSMASTSSTFFDTSSIGTVQNPYADVKTSLHDSQVPTSNSNTSVQNMGNTDSVVYSTIQHPPRDTTDNGARLLGNPSAGIQSTYARLALSGGLRHDMGGLTGGSNSAVNTSNNPPAPGSHRFV

SEQ ID NO: 5975 - protein, 47 aa, Escherichia coli
MKKITGIILLLLAVIILAACQANYIRDVQGGTVSPSSTAEVTGLATQ

SEQ ID NO: 5976 - protein, 120 aa, Escherichia coli; identical to SEQ ID NO: 5799

SEQ ID NO: 5977 - protein, 783 aa, Escherichia coli
MNRKKHQILKILLLCLISSKSSASEKELNLQFIRHKFGQNTEDIELFFNSSTVLPGNYTVDVKLNDEVIGRAKLEVSQDDKESYCLKDEWLSDLGIIINRDFYNKYFNIKRECYEIGKEKNSITTFDNNSQIFSLYMPQAAYIKKGNTEHKWSYGDPGFNLNYDAYLSKNDEDSSIYGNLEGNVNIDKWVLYGRGYKYEHDKFTTDDVTLSRAIKSLEGDLIIGDTYTNTSLMDNISFYGVQLRSNNAMTPERRGDYSPIISGIAKSNARVTVKQNGVVLHSELVSPGPFHINNVRGIRSGELVMTVTEEDGSEQQTRIPVTFIANLLSPGNYNYDFGIGNKEATWEPDNIFAYGSFDYGLNLLTLNASLLFEQHYSNAGIGAVGSIGSLGAVSVSGNISRAKNQLETDQGYSTSANYSKNVGANGNLQIIGYKFSSEGYTQYANFDYRAPRKDKKEKERYEVTLTQQFPASNVFLSVTGWKKFYWNDNSVTGANVSYTQNFGTVNASVNGSYSRGDGAKSDYMLGFNINIPFRHNDRQFYSNSGVTYNRNSGIGFNAGFSEDVTKNFNYNVNAAASKDNESVSLSTNYTSSMFRTSASVSKNRNSTNASAQIGGAIIGVKDGGVMLTSMSSNSVAIVQMEGLAGYAFTNGVESDWRGRIAYPMTTYMDNDIQISTDKLPSNIELTDNVETIVPTNRAIKLQKIKYKNMSRHVLKVYDKNGFVIPMGTAVKNSNGEIISFVNNNGISLLNIDKNDERVFFGSCTISTSGLKDNLSEIQEVNCE

SEQ ID NO: 5978 - protein, 47 aa, Escherichia coli
MKKITWIILLLLAAIILAACQANYIHDVQGGTVSPSSSAELTGLATQ

SEQ ID NO: 5979 - protein, 47 aa, Escherichia coli
MKKITGIILLLLAVIILAACQANYIRDVQGGTVSPSSTAELTGVETQ

SEQ ID NO: 5980 - protein, 335 aa, Escherichia coli
MKKWFPAFLFLSLSGGNDALAGWHNVMFYAFNDYLTTNAGNVKVIDQPQLYIPWNTGSATATYYSCSGPEFASGVYFQEYLAWMVVPKHVYTNEGFNIFLDVQSKYGWSMENENDKDFYFFVNGYEWDTWTNNGARICFYPGNMKQLNNKFNDLVFRVLLPVDLPKGHYNFPVRYIRGIQHHYYDLWQDHYKMPYDQIKQLPATNTLMLSFDNVGGCQPSTQVLNIDHGSIVIDRANGNIASQTLSIYCDVPVSVKISLLRNTPPIYNNNKFSVGLGNGWDSIISLDGVEQSEEILRWYTAGSKTVKIESRLYGEEGKRKPGELSGSMTMVLSFP

SEQ ID NO: 5981 - protein, 259 aa, Escherichia coli
MIKHVLLFFVFISFSVSANDFFRADSRTPDEIRRAGGLLPRGQQEAYERGTPININLYEHARGTVTGNTRYNDGYVSTTVTLRQAHLIGQNILGSYNEYYIYVVAPAPNLFDVNGVLGRYSPYPSENEFAALGGIPLSQIIGWYRVSFGAIEGGMQRNRDYRGDLFRGLTVAPNEDGYQLAGFPSNFPAWREMPWSTFAPEQCVPNNKEFKGGVCISATNVLSKYDLMNFKKLLKRRLALTFFMSEDDFIGVHGERDEL

SEQ ID NO: 5982 - protein, 123 aa, Escherichia coli
MSSKKIIGAFVLMTGILSGQVYAGVSEHFRNICNQTTADIVAGVQLKKYIADVNTNTRGIYVVSNTGGVWYIPGGRDYPDNFLSGEIRKTAMAAILSDTKVNLCAKTSSSPNHIWAMELDRES

SEQ ID NO: 5983 - protein, 21 aa, Escherichia coli
MDAVLSVQGASAPVKKKSFFS

SEQ ID NO: 5984 - protein, 245 aa, Escherichia coli
MKHNVKLMAMTAVLSSVLVLSGCGAMSTAIKKRNLEVKTQMSETIWLEPSSQKTVYLQIKNTSDKDMSGLQAKVTKAVQDKGYTITSSPDSAHYWIQANVLKADKMDLRTAQGFLSQGYEGAIAGAALGAGITGYNSSSAGATLGVGLAAGLVGMAADAMVEDINYTMVTDIQISEKTTASVQTDNVAALKQGTSGYKVQTSTQTGNQHKYQTRIVSSANKVNLKFEEAKPVLEDQLAKSVANIL

SEQ ID NO: 5985 - protein, 119 aa, Escherichia coli
MNTVLSVQGASAPVEKKSFFSKFTRLNMLRLVRAVIPVAVLMMLFPELAMAAGKGDLMAKGNDTVKATFGKDSSIVKWVVLAEVLVGAVMYMMTKNVKFLVGFAIISVFIAVGMSVVGL

SEQ ID NO: 5986 - protein, 119 aa, Escherichia coli
MNAVLSVQGASAPVKKKSFFSKFTRLNMLRLARAVIPAAVLMMFFPQLAMAAQGQDLMASGNTTVKATFGKDSSVVKWVVLAEVLVGAVMYMMTKNVKFLAGFAIISVFIAVGMAVVGL

SEQ ID NO: 5987 - protein, 119 aa, Escherichia coli
MNAVLSVQGASAPVKKKSFFSKFTRLNMLRLARAVIPAAVLMMFFPQLAMAAQGQDLMASGNTTVKATFGKDSSVVKWVVLAEVLVGAVMYMMTKNVKFLAGFAIISVFIAVVMAVVGL

SEQ ID NO: 5988 - protein, 732 aa, Escherichia coli
MMISKKYTLWALNPLLLTMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNMHHIEVIFGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTDGHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAAFLQSGYDINNLFTLNGGVRYQYTENKIDDFIGYAQQRQIGAGKATSADAFWRLSRLRHFLFNAGLLMHITEPQQAWLNFSQGLELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTVDLLGSYQLPVGTLSFSIENLFDRDYTTVWGQRAPLYYSPGYGPASLYDYKGRGRTFGLNYSVLF

SEQ ID NO: 5989 - protein, 47 aa, Escherichia coli
MKKITGIILLLLAAIILAACQANYIRDVQGGTVSPSSSAELTGLATQ

SEQ ID NO: 5990 - protein, 243 aa, Escherichia coli
MKTKKLMMVALVSSTLALSGCGAMSTAIKKRNLEVKTQMSETIWLEPASERTVFLQIKNTSDKDMSGLQGKIADAVKAKGYQVVTSPDKAYYWIQANVLKADKMDLRESQGWLNRGYEGAAVGAALGAGITGYNSSSAGATLGVGLAAGLVGMAADAMVEDVNYTMITDVQIAERTKATVTTDNVAALRQGTSGAKIQTSTETGNQHKYQTRVVSNANKVNLKFEEAKPVLEDQLAKSIANIL

SEQ ID NO: 5991 - protein, 239 aa, Escherichia coli
MIRKKILMAAIPLFVISGADAAVSLDRTRAVFDGSEKSMTLDISNDNKQLPYLAQAWIENENQEKIITGPVIATPPVQRLEPGAKSMVRLSTTPDISKLPQDRESLFYFNLREIPPRSEKANVLQIALQTKIKLFYRPAAIKTRPNEVWQDQLILNKVSGGYRIENPTPYYVTVIGLGGSEKQAEEGEFETVMLSPRSEQTVKSANYNTPYLSYINDYGGRPVLSFICNGSRCSVKKEK

SEQ ID NO: 5992 - protein, 241 aa, Escherichia coli
MTPIKLIFAALSLFPCSNIYANNITTQKFEAILGATRVIYHLDGNGESLRVKNPQISPILIQSKVMDEGSKDNADFIVTPPLFRLDAKRETDIRIVMVNGLYPKDRESLKTLCVRGIPPKQGDLWANNEKEFVGMKLNVSINTCIKLILRPHNLPKLDINSEGQIEWGIRDGNLVAKNKTPYYFTIVNASFNGKALKTPGTLGPYEQKLYTLPSKISVSGLVKWEIIGDLGESSETKKFNI

SEQ ID NO: 5993 - protein, 937 aa, Escherichia coli
  MOD_RES (754)..(754): Any amino acid
MYFDAGESEDFCIQYSVLQDIGVTVSGNQDECANLDDELNLRTRFDFYSKRMDIFVSPKFVPRKKNGLAPIKLWDEGENALFTSYNFSEDYYHFKGDARDSYSQYANIQPRLNIGPWRIRTQAIWNKNNNTKGEWSNNYLYAERGLGNIKSRLYIGDGYFPLKNFNSFKFKGGVLKTDENMYPYSEKTYSPIVKGSAKTQAKVEFFQDGVKIYSSIVPPGDFSISDYILSGSNSDLYVKVIEENGSIQEFIVPFTYPAVAVREGFTYYEIAMGETQQSNDYFTQLSFTRGLPYDFTVLTSLEYSGFYRSLEIGLGKMLGNLGALSLIYGQSNFSKSDNSKNKKWDIRYNKNIPDLNTYLSFSAVSQTRGGYSSLRDALDYEIGEYTFNSKNSYTASINHSLGELGSLNFSGTWRNYWENKNQTRSYNLSYSTQIFNGKAYLSGSLIRSELMNFNNKISDTILNIGVNIPFGLSRGIQSVSYNTSSVKGGRSTHQLGISGSEFDNKLYWHVNQGYSDNYSNTSMYGYYKAKYAQVNAGYSVSERYNHAYGGIEGGILVYDGGIILGRNLGDTMSIIEAPGAENTKIRGWGSIETDWRGRAFIGYLSPYQNNDISLDPSSLPLDSSLDITTNSVIPTTGAIVKTTYNVKKGKKVMLTLKKSNGDAVPFGAIVTVMDGDQNTSIVGDNGQLYLGSSMDTGRLKVIWGNGEDKKCVVDYIVGDNKNIAGIYIGSAEHVFSSMLLYGKKISFLSASVWXVIGVVKAFLTTLQSNNEWRTHSEKNDFSIDFDVGVGRSFAAVGPTKDMSLGANLTSEPTLAIDFTPIENIYVGANYGKDIGTLVFTTNDLTDITLMSSRSVVDGRQTGFFTFMDSSATYKISTKLGSSNDVNIQEITQGAKITPVSGEKTLPKKFTLKLHAHRSSSTVPDTYTVGLNVTSNVI

SEQ ID NO: 5994 - protein, 757 aa, Escherichia coli
  MOD_RES (574)..(574): Any amino acid
MYPYSEKTYSPIVKGSAKTQAKVEFFQDGVKIYSSIVPPGDFSISDYILSGSNSDLYVKVIEENGSIQEFIVPFTYPAVAVREGFTYYEIAMGETQQSNDYFTQLSFTRGLPYDFTVLTSLEYSGFYRSLEIGLGKMLGNLGALSLIYGQSNFSKSDNSKNKKWDIRYNKNIPDLNTYLSFSAVSQTRGGYSSLRDALDYEIGEYTFNSKNSYTASINHSLGELGSLNFSGTWRNYWENKNQTRSYNLSYSTQIFNGKAYLSGSLIRSELMNFNNKISDTILNIGVNIPFGLSRGIQSVSYNTSSVKGGRSTHQLGISGSEFDNKLYWHVNQGYSDNYSNTSMYGYYKAKYAQVNAGYSVSERYNHAYGGIEGGILVYDGGIILGRNLGDTMSIIEAPGAENTKIRGWGSIETDWRGRAFIGYLSPYQNNDISLDPSSLPLDSSLDITTNSVIPTTGAIVKTTYNVKKGKKVMLTLKKSNGDAVPFGAIVTVMDGDQNTSIVGDNGQLYLGSSMDTGRLKVIWGNGEDKKCVVDYIVGDNKNIAGIYIGSAEHVFSSMLLYGKKISFLSASVWXVIGVVKAFLTTLQSNNEWRTHSEKNDFSIDFDVGVGRSFAAVGPTKDMSLGANLTSEPTLAIDFTPIENIYVGANYGKDIGTLVFTTNDLTDITLMSSRSVVDGRQTGFFTFMDSSATYKISTKLGSSNDVNIQEITQGAKITPVSGEKTLPKKFTLKLHAHRSSSTVPDTYTVGLNVTSNVI

SEQ ID NO: 5995 - protein, 621 aa, Escherichia coli
  MOD_RES (438)..(438): Any amino acid
MLGNLGALSLIYGQSNFSKSDNSKNKKWDIRYNKNIPDLNTYLSFSAVSQTRGGYSSLRDALDYEIGEYTFNSKNSYTASINHSLGELGSLNFSGTWRNYWENKNQTRSYNLSYSTQIFNGKAYLSGSLIRSELMNFNNKISDTILNIGVNIPFGLSRGIQSVSYNTSSVKGGRSTHQLGISGSEFDNKLYWHVNQGYSDNYSNTSMYGYYKAKYAQVNAGYSVSERYNHAYGGIEGGILVYDGGIILGRNLGDTMSIIEAPGAENTKIRGWGSIETDWRGRAFIGYLSPYQNNDISLDPSSLPLDSSLDITTNSVIPTTGAIVKTTYNVKKGKKVMLTLKKSNGDAVPFGAIVTVMDGDQNTSIVGDNGQLYLGSSMDTGRLKVIWGNGEDKKCVVDYIVGDNKNIAGIYIGSAEHVFSSMLLYGKKISFLSASVWXVIGVVKAFLTTLQSNNEWRTHSEKNDFSIDFDVGVGRSFAAVGPTKDMSLGANLTSEPTLAIDFTPIENIYVGANYGKDIGTLVFTTNDLTDITLMSSRSVVDGRQTGFFTFMDSSATYKISTKLGSSNDVNIQEITQGAKITPVSGEKTLPKKFTLKLHAHRSSSTVPDTYTVGLNVTSNVI

SEQ ID NO: 5996 - protein, 487 aa, Escherichia coli
  MOD_RES (304)..(304): Any amino acid
MNFNNKISDTILNIGVNIPFGLSRGIQSVSYNTSSVKGGRSTHQLGISGSEFDNKLYWHVNQGYSDNYSNTSMYGYYKAKYAQVNAGYSVSERYNHAYGGIEGGILVYDGGIILGRNLGDTMSIIEAPGAENTKIRGWGSIETDWRGRAFIGYLSPYQNNDISLDPSSLPLDSSLDITTNSVIPTTGAIVKTTYNVKKGKKVMLTLKKSNGDAVPFGAIVTVMDGDQNTSIVGDNGQLYLGSSMDTGRLKVIWGNGEDKKCVVDYIVGDNKNIAGIYIGSAEHVFSSMLLYGKKISFLSASVWXVIGVVKAFLTTLQSNNEWRTHSEKNDFSIDFDVGVGRSFAAVGPTKDMSLGANLTSEPTLAIDFTPIENIYVGANYGKDIGTLVFTTNDLTDITLMSSRSVVDGRQTGFFTFMDSSATYKISTKLGSSNDVNIQEITQGAKITPVSGEKTLPKKFTLKLHAHRSSSTVPDTYTVGLNVTSNVI

SEQ ID NO: 5997 - protein, 366 aa, Escherichia coli
  MOD_RES (183)..(183): Any amino acid
MSIIEAPGAENTKIRGWGSIETDWRGRAFIGYLSPYQNNDISLDPSSLPLDSSLDITTNSVIPTTGAIVKTTYNVKKGKKVMLTLKKSNGDAVPFGAIVTVMDGDQNTSIVGDNGQLYLGSSMDTGRLKVIWGNGEDKKCVVDYIVGDNKNIAGIYIGSAEHVFSSMLLYGKKISFLSASVWXVIGVVKAFLTTLQSNNEWRTHSEKNDFSIDFDVGVGRSFAAVGPTKDMSLGANLTSEPTLAIDFTPIENIYVGANYGKDIGTLVFTTNDLTDITLMSSRSVVDGRQTGFFTFMDSSATYKISTKLGSSNDVNIQEITQGAKITPVSGEKTLPKKFTLKLHAHRSSSTVPDTYTVGLNVTSNVI

SEQ ID NO: 5998 - protein, 193 aa, Escherichia coli
MVVNKTTAVLYLIALSLSGFIHTFLRAEERGIYDDVFTADALRHYRINERGGRTGSLTCSGALLSSPCTLVSNEVPLSLRPENHSAAAGAPLMLRLAGCGDGGALQPGKRGVAMTVSGSLVTGPGSGSALLPDRKLSGCDHLVIHDGDTFLLCRPDRRQEEMLAAWRKRATQEGEYSDARSNPAMLRLSIKYE

SEQ ID NO: 5999 - protein, 103 aa, Escherichia coli
MRTLTLNELDSVSGGASGRDIAMAIGTLSGQFVAGGIGAAAGGVAGGAIYDYASTHKPNPAMSPSGLGGTIKQKPEGIPSEAWNYAAGRLCNWSPNNLSDVCL

SEQ ID NO: 6000 - protein, 71 aa, Escherichia coli
MKKNIAFLLASMFVFSIATNAYASTQSNKKDLCEHYRQIAKESCKKGFLGVRDGTAGACFGAQIMVAAKGC

SEQ ID NO: 6001 - protein, 258 aa, Escherichia coli
MSKRNAVTTFFTNRVTKALGMTLALMMTCQSAMASLAVDQTRYIFRGDKDALTITVTNNDKERTFGGQAWVDNIVEKDTRPTFVVTPSFFKVKPNGQQTLRIIMASDHLPKDKESVYWLNLQDIPPALEGSGIAVALRTKLKLFYRPKALLEGRKGAEEGISLQSRPDGRTMLVNTTPYIFAIGSLLDGNGKKIATDNGTTQKLLMFMPGDEVQVKGNVVKVDSLNDYGELQTWTINKKKPAAPEAAKAEKADTAEQK

SEQ ID NO: 6002 - protein, 228 aa, Escherichia coli
MNKFISIIALCVFSSYANAAFTLNSTRYIYNEGQQSVSVNIHNESEHKYGGQVWIDNIDKNGEVVFFSPSPMVFKLNPKQKQIVRIVNINDNLPKDRESIFWLNVQEIPPAPKGDGGSLSLAINNRVKLIYRPIALKNGRDEAENNIKLINSGTDSCLENTTPYYFAISDVKINGKSIDLNSDAKNKMGVFSPFSKVCLGNVNTSGNITVTAFNDYGVATSYTVQRSK

SEQ ID NO: 6003 - protein, 869 aa, Escherichia coli
MKHKKKNRLVVAISVALIPYIGVTGDIPDSFRDLWGEQDEFYEVKLYGQTLGIHRIKTTPTHIKFYSPESILDKINLKKEKEKELSVFFTNSFSRNGNMSCQGNTTIQYNCNYIKTKSVDVIVDDVDNVVNLFIGNEFLDSEAHNDEYHQLSRNVKKAFIQSQTINLSDSGKYKRLSISGNSALGITDTSYAVLNWWMNYNKSNGYSNNEKTINSLYFRHDLDKRYYYQFGRMDRTDLSQSISGSFNFNLLPLPDIDGIRTGTTQSYIKNTDKFIASPVTVMLTNFSRVEAFRNDQLLGVWYLDSGVNELDTARLPYGSYDLKLKIFENTQLVREEIIPFNKGRSSIGDMQWDIFVQGGNIVNDNDRYIEKQNNHKSSINTGLRLPITKNISVQQGVSVIDNKSYYEGSLKWNSGILSGSLNSEFSFLWGDNAKGNYQSISYTDGFSLSFYHNDKRVDNCGRNYNAGWSGCYESYSASLSIPLLGWTSTLGYSDTYSESVYKSHILSEYGFYNQNIYKGRTQRWQLTSSTSLKWMDYNFMPAIGIYNSEQRQLTDKGGYISVTITRASRENSLNTGYSYNYSRGNYSSNELFVDGYMTSTNNGDYHEAGMRFNKNRHNAEGRLSGRINNRFGDLNGSFSMNKNRNTNSTNHSLTGGYNSSFALTSDGFYWGGSTAGLTKLAGGIIKVKSNDTKKNLVKVTGTLYGDYSLGSNDNAFIPVPALTPASLIIEDNNYGDNNISILAPTNNDMFMLPGNVYPVEIETKVSVSYIGRGFDPNGTPLSGAHVLNEPHVILDEDGGFSFEYTGNEKTLFLLKGRTIYTCQLGKNKVHKGIVFVGDVICDINSTSSLPDEFVKNPRVQDLLAKNDKG

SEQ ID NO: 6004 - protein, 243 aa, Escherichia coli
MKMKKLMMVALVSSTLALSGCGAMSTAIKKRNLEVKTQMSETIWLEPASERTVFLQIKNTSDKDMSGLQGKIADAVKAKGYQVVTSPDKAYYWIQANVLKADKMDLRESQGWLNRGYEGAAVGAALGAGITGYNSNSAGATLGVGLAAGLVGMAADAMVEDVNYTMITDVQIAERTKATVTTDNVAALRQGTSGAKIQTSTETGNQHKYQTRVVSNANKVNLKFEEAKPVLEDQLAKSIANIL

SEQ ID NO: 6005 - protein, 124 aa, Escherichia coli
MNKVKCYVLFTALLSSLYAHGAPQTITELCSEYRNTQIYTINDKILSYTESMAGKREMVIITFKSGETFQVEVPGSQHIDSQKKAIERMKDTLRITYLTETKIDKLCVWNNKTPNSIAAISMKN

SEQ ID NO: 6006 - protein, 115 aa, Escherichia coli
LQIALQTKIKLFYRPAAIKTRPNEVWQDQLILNKVSGGYRIENPTPYYVTVIGLGGSEKQAEEGEFETVMLSPRSEQTVNRNYNTPYLSYINDYGGRPVLSFICNGSRCSVKKEK

SEQ ID NO: 6007 - protein, 161 aa, Escherichia coli
GANAAPQGQGKVTFNGTVVDAPCGIDAQSADQSIEFGQVSKVLLNNGGSSTPKNFDIKLTDCDVTNYKKAGKAGTVSLTFSGVQAGTDMLQTVGTTGTAILVKDPHGKAVKFDGATATGVSSLVDGDNTIHFTALVKKDTSGNDVAEGAFSAVANFNLIYQ

SEQ ID NO: 6008 - protein, 195 aa, Escherichia coli
MRLRFSVPLFFFGCVFVHGVFAGPFPPPGMSLPEYWGEEHVWWDGRATFHGEVVRPACTLAMEDAWQIIDMGETPVRDLQNGFSGPERKFSLRLRNCEFNSQGGNLFSDSRIRVTFDGVRGETPDKFNLSGQAKGINLQIADARGNIARAGKVMPAIPLTGNEEALDYTLRIVRNGKKLEAGNYFAVLGFRVDYE

SEQ ID NO: 6009 - protein, 173 aa, Escherichia coli
MKKIRGLCLPVMLGAVLMSQHVHAADNLTFKGKLIIPACTVQNAEVNWGDIEIQNLVQSGGNQKDFTVDMNCPYSLGTMKVTITSNGQTGNSILVPNTSTASGDGLLIYLYNSNNSGIGNAVTLGSQVTPGKITGTAPARKITLYAKLGYKGNMQSLQAGTFSATATLVASYS

SEQ ID NO: 6010 - protein, 167 aa, Escherichia coli
MIRLSLFISLLLTSVAVLADVQINIRGNVYIPPCTINNGQNIVVDFGNINPEHVDNSRGEVTKNISISCPYKSGSLWIKVTGNTMGVGQNNVLATNITHFGIALYQGKGMSTPLTLGNGSGNGYRVTAGLDTARSTFTFTSVPFRNGSGILNGGDFRTTASMSMIYN

SEQ ID NO: 6011 - protein, 335 aa, Escherichia coli
MKKWLPAFLFLSLSGCNDALAANQSTMFYSFNDNIYRPQLSVKVTDIVQFIVDINSASSTATLSYVACNGFTWTHGLYWSEYFAWLVVPKHVSYNGYNIYLELQSRGSFSLDAEDNDNYYLTKGFAWDEANTSGQTCFNIGEKRSLAWSFGGVTLNARLPVDLPKGDYTFPVKFLRGIQRNNYDYIGGRYKIPSSLMKTFPFNGTLNFSIKNTGGCRPSAQSLEINHGDLSINSANNHYAAQTLSVSCDVPTNIRFFLLSNTNPAYSHGQQFSVGLGHGWDSIISINGVDTGETTMRWYRAGTQNLTTGSRLYGESSKIQPGVLSGSATLLMILP

SEQ ID NO: 6012 - protein, 193 aa, Escherichia coli
MVVNKTTAVLYLIALSLSGFIHTFLRAEERGIYDDVFTADELHHYRINERGGRTGSLAVSGALLSSPCTLVSNEVPLSLRPENHSASRGAPLMLRLAGCGDGGALQPGKRGVAMTVSGSLVTGPGSGSALLPDRKLSGCDHLVIHDGDTFLLCRPDRRQEEMLAAWRKRATQEGEYSDARSNPAMLRLSIKYE

SEQ ID NO: 6013 - protein, 558 aa, Escherichia coli
MKLFKSILLIAACHAAQASATIDINADPNLTGAAPLTGILNGQKSDTQNMSGFDNTPPPAPPVVMSRMFGAQLFNGTSADSGATVGFNPDYILNPGDSIQVRLWGAFTFDGALQVDPKGNIFLPNVGPVKIAGVSNSQLNALVTSKVKEVYQSNVNVYASLLQAQPVKVYVTGFVRNPGLYGGVTSDSLLNYLIKAGGVDPERGSYVDIVVKRGNRVRSNVNLYDFLLNGKLGLSQFADGDTIIVGPRQHTFSVQGDVFNSYDFEFRESSIPVTEALSWARPKPGATHITIMRKQGLQKRSEYYPISSAPGRMLQNGDTLIVSTDRYAGTIQVRVEGAHSGEHAMVLPYGSTMRAVLEKVRPNSMSQMNAVQLYRPSVAQRQKEMLNLSLQKLEEASLSAQSSTKEEASLRMQEAQLISRFVAKARTVVPKGEVILNESNIDSVLLEDGDVINIPEKTSLVMVHGEVLFPNAVSWQKGMTTEDYIEKCGGLTQKSGNARIIVIRQNGARVNAEDVDSLKPGDEIMVLPKYESKNIEVTRGISTILYQLAVGAKVILSL

SEQ ID NO: 6014 - protein, 263 aa, Escherichia coli
MAKVISFFISLFLISFPLYANDYFRADSRTPDEVRRSGGLIPRGQDEAYERGTPININLYDHARGTATGNTRYNDGYVSTTTTLRQAHFLGQNMLGGYNEYYIYVVAAAPNLFDVNGVLGRYSPYPSENEYAALGGIPLSQIIGWYRVSFGAIEGGMHRNRDYRRDLFRGLSAAPNEDGYRIAGFPDGFPAWEEVPWREFAPNSCLPNNKASSDTTCASLTNKLSQHDLADFKKYIKRKFTLMTLLSINNDGFFSNNGGKDEL

SEQ ID NO: 6015 - protein, 122 aa, Escherichia coli
MSFKKIIKAFVIMAALVSVQAHAGASQFFKDNCNRTTASLVEGVELTKYISDINNNTDGMYVVSSTGGVWRISRAKDYPDNVMTAEMRKIAMAAVLSGMRVNMCASPASSPNVIWAIELEAE

SEQ ID NO: 6016 - protein, 835 aa, Escherichia coli
MNKYPPLLTMLIIGIGSNAVAGDYFDPSLLATDIGNNDKLDLSLFSHPGGGVKGEREVSVYINDFFYKNVTLDFENGISGALEPIFPSGFFDNILASPYRSIKEKELISTADFLSLVPYGMVRFDQAIARVDISIPQAYLGRDAQMKSAPESWNQGVPALLIDYRLSGSKNKYNYGSSQNFYANAFLGFNLMGWRLRTTTNYMSYNSKDLYNKGERQGSFNFYNTYLEKDIGYLRSTLRLGELSTRGMILESFNFKGGKIYSNDEMLNDRLRSYTPTVRGIASSQAVVTIKQGGVVILQKNVPPGPFEINDFSLSGYSGDLYVNIKEADGSEHSFIQPFSTLPEMKREGVSGYEISLGHYNNSGATQYYNESPFLYASWSRGYRNGMTLYSETIQSRKYQLLGVGSTLSLGDFGAVSGDASLSRANKYDKIHSGQSYGLKYSKNKVDTGTTVTLATYRYSTKDFYSFNDFVSKNDSVQYVWDNRLKNRITLSLNQSLDDYGSLSLIASQQNYWTSDYVSRSFSLSHSFGWNDIFFSTSFSLDQKEGDNALRNNNKVFGFYSSIPLSKLIGKNESTYSTLSYNVTKINNQVRNTATLAGKVPGSMAQYRFSSGWANTEQSSNKALSVNWDGDLLDGSLGYTSSGKNRITDYSLSGSAILYPWRLAIGSDSVINGAAVVETEFISGIKVRQGGETSLLGTAIVTSMQPYTENRIDLDTQNIPDDLFISNASKKIVPEKGAVVPVKYNLFKGKQIVFSLKRYDGTPLPFGSVVSLVGSDSEITGIIDDAGRVYLAGIPSKGILHGAWGYNKSCEVSFNLNGKPSNNSNEIIEYEGVCK

SEQ ID NO: 6017 - protein, 252 aa, Escherichia coli
MKIRRIVSTIAIALSVFTFAHAQSFENVENNAKVFSLHLGATRMIYKPNSSGETLAVINEHNYPILVQANVLSEDQKNIAPFIITPPLFRLDALQSSRLRIVKTEGAFPIDRESLQWICVKAIPPKYEDKWAKEEVSGKKSDKATMNIQVSVSSCIKLFVRPADVKGQPDDVAGKIKWQKVGNKLKGVNPTPFYMDIAELRVGEKEITETHYIAPFSSYEYPMPVNGGGDVRWKVVTDYGGISKTFETGLNI

SEQ ID NO: 6018 - protein, 842 aa, Escherichia coli
MKTSSFIIVILLCFRIENVIAHTFSFDASLLNHGSGGIDLTLLEKGGQLPGIYPVDIILNGSRIDSRDIFFYTKKNRHGEYYLKPCLTRDILINYGVKTEEYPNLFRQNSEKNRDSSDCADLSVIPQATEDYHFIKQQLILGIPQVAIRPPLTGIAHETMWDDGISAFLLNWQVEGSHWEYRSNTRNSSDNFWASLEPGINLGSWRIRNLTTWNKSSGQSGKWESSYIRVERGLNNIKSRLTFGDDYTPSDIFDSVPFRGGMLGSDENMVPYNQREFAPVVRGIARTQARIEVRQNGYLIQSRIVSPGAFALTDLPVTGNGGDLQVWVLESDGTIQTFNVPFTTPAIALREGYLKYNVTVGEYRPSDDSIEGAYLGQLTAMYGLPWSLTAFGGIQVSEHYQGNALGLGLSLGGFGSISLDTIYSRGQQKGYSNEIGKTWRVRYDKSFELTGTSFAAGYQDSSAGYHSLADVLDTYRNGTAYRSYDNRIRRTTINISQALGEWGSVALNGGRDEYRDKVKQDYIGASYSNSWKGITFAVNWSRNNNIGDYYSNSLRTENNLNLWMSIPMKRWLGGDDKGVTATAQIQRITGQNTLYETGLNGRAFGQKLYWDIREQIVPGSKYDADTSLLNLRWSGGYGELTGMYSYNRNTRQMNVGTSGSMAIHSGGIAFGQKTDDTMALIAAPGIAGASVGGWPGVSTDFRGYTLVGHVSPYQENIITLDPTTFPDNTEVSQTDRRVIPTKGALVQAEFKTRVGNRALVTLTRKDGTLLPFGTVVTLERKTGEAFESAGVVDDKGKVYLSGLSEAGKLKAQWGTNSQCYADYKLPLKKGMSGIFLTRAVCM

SEQ ID NO: 6019 - protein, 875 aa, Escherichia coli
MFFGDGGQLLSDKSLTGSAGGGNNRMKFNILPLAFFIGIIVSPARAELYFNRRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQLYMSNQARGYIAPEYWDNGITAALLNYDFSGNRVRDTYGGTSDYAYLNLKTGLNIGSWRLRDNTSWSYSAGKGYSQNNWQHINTWLERDIVSLRSRLTMGDSYTRGDIFDGVNFRGIQLASDDNMVPDSQRGYAPTIHGISRGTSRISIRQNGYEIYQSTLPPGPFEINDIYPAGSGGDLQVTLQEADGSVQRFNVPWSSVPVLQREGHLKYALSAGEFRSGGHQQDNPRFAEGTLKYGLPDGWTVYGGAWIAERYRAFNLGVGKNMGWLGAVSLDATRANARLPDESRHDGQSYRFLYNKSLTETGTNIQLIGYRYSTRGYFTFADTAWKKMSGYSVLTQDGVIQIQPKYTDYYNLAYNKREGAGEYQPADGESSTLYLSGSHQSYWGTDRTDRQLNAGFNSSVNDISWSLNYSLSRNAWQHETDRILSFDVSIPFSHWMRSDSTSAWRNASARYSQTLEAHGQAASTAGLYGTLLGDNNLGYSIQSGYTRGGYEGSSKTGYASLNYRGGYGNASAGYSHSGGYRQLYYGLSGGILAHANGLTLSQPLGDTLILVRAPGASDTRIENQTGVSTDWRGYAVLPYATDYRENRVALDTNTLADNVDIENTVVSVVPTHGAVVRADYKTRVGVKVLMTLMRNGKAVPFGSVVTARNGGSSIAGENGQVYLSGMPLSGQVSVKWGSQTTDQCTADYKLPKESAGQILSHVTASCR

SEQ ID NO: 6020 - protein, 247 aa, Escherichia coli
MKMRAVAVFTGMLTGVLSVTGLLSAGAYAAGGEGNMSASATETNARVFSLHLGATRVVYNPASSGETLTVINDQDYPMLVQSEVLSEDQKSPAPFWWTPPLFRRDGQQSSRRRSVSTGGEFPSDRESRQWICVKGIPPKEDDRWAEGKDGEKKADKVSLNVQLSVSSCIKLFVRPPAVKGRPDDVAGKVEWQRAGNRLKGVNPTPFYINLSTLTVGGKEVKEREYIAPFSSREYPLPAGHRVRFSGR

SEQ ID NO: 6021 - protein, 819 aa, Escherichia coli
MMLAQKQNFMNQFYKKYHYSIQKYQITDLLFFLFLYPFSTSYGNEQFSFDSRFLPSGYNYSLNSNLPPEGEYLVDIYINKIKKESAIIPFYIKGNKLVPCLSKEKLSSLGININNNDNAECAETSKAGISNISFEFSSLRLFIAVPKNLLSEIDKISSKDIDNGIHALFFNYQVNTRLANNKNRYDYISVSPNINYFSWRLRNRFEFNQNNDKKTWERNYTYLEKSFYDKKLNLIVGESYTSSNVYNNYSFTGISVSTDTDMYTPSEIDYTPEIHGVADSDSQIIVRQGNTIIINESVPAGPFSFPITNLMYTGGQLNVEITDIYGNKKQYTVSNSSLPVMRKAGLMVYNFISGKLTKKNSEDGDFFAQGDINYGTHYNSTLFGGYQFSKNYFNLSTGIGTDLGFSGAWLLNVSRSNFKDKNGYNINLQQNTQLRPFNAGVNFDYIYRKKGYVELSGIGWHGNLYNQLKNSFSLSLSKSLDKYGNFSLDYNKIKYWDNAYDSNSMSIRYFFKFMRAMITTNYSLNKYQSYEKKDKRFSINISLPLTKDYGHISSNYSFSNANTGTATSSVGVNGSFFNDARLNWNIQQNRTTRNNGYTDNTSYIATSYASPYGVFTGSYSGSNKYSSQFYSALGGIVLHSDGVAFTQKAGDTSALVRIDNISDIKIGNTPGVYTGYNGFALIPHLQPFKKNTILINDKGIPDDIALANIKKQVIPSRGAIVKVKFDAKKGNNILFKLTTKDGKTPPLGAIAHEKNGKQINTGIVDDDGMLYMSGLSGAGIINVTWNGKVCSFPFSEKDISSKQLSVVNKQCNRPENSGD

SEQ ID NO: 6022 - protein, 802 aa, Escherichia coli
MNQFYKKSHYSIQKHQITGLLFLLFIYPFSTSYGNEQFSFDSRFLPSGYNYSLNSNLPPEGEYLVDIYINKIKKESAIIPFYIKGNKLVPCLSKEKISSLGININNNDNTECVETSKAGISNISFEFSSLRLFIAVPKNLLSEIDKISSKDIDNGIHALFFNYQVNTRLANNKNRYDYISVSPNINYFSWRLRNLFEFNQNNDEKTWERNYTYLEKSFYDKKLNLVVGESYTNSNVYNNYSFTGISVSTDTDMYTPSEIDYTPEIHGVADSDSQIIVRQGNTIIINESVPAGPFSFPITNLMYTGGQLNVEITDIYGNKKQYTVNNSSLPVMRKAGLMVYNFISGKLTKKNSEDGDFFTQGDINYGTHYNSTLFGGYQFSKNYFNLSTGIGTDLGFSGAWLLHVSRSNFKNKNGYNINLQQNTQLRPFNAGVNFDYAYRKKRYVELSDIGWHGNLYNQLKNSFSLSLSKSLNKYGNFSLDYNKMKYWDNAYDSNSMSIRYFFKFMRAMITTNCSLNKYQSYEKKDKRFSINISLPLTKDYGHISSNYSFSNANTGTATSSVGLNGSFFNDARLNWNIQQNRTTRNNGYTDNTSYIATSYASPYGVFTGSYSGSNKYSSQFYSASGGIVLHSDGVAFTQKAGDTSALVRIDNISDIKIGNTPGVYTGYNGFALIPHLQPFKKNTILINDKGIPDGITLANIKKQVIPSRGAIVKVKFDAKKGNDILFKLTTKDGKTPPLGAIAHEKNGKQINTGIVDDDGMLYMSGLSGTGIINVTWNGKVCSFPFSEKDISSKQLSVVNKQC

SEQ ID NO: 6023 - protein, 247 aa, Escherichia coli
MKMRAVAVFTGMLTGVLSVAGLLSAGAYAAGGEGNMSASATETNARVFSLHLGATRVVYNPASSGETLTVINDQDYPMLVQSEVLSEDQKSPAPFVVTPPLFRLDGQQSSRLRIVRTGGEFPPDRESLQWICVKGIPPKEGDRWAEGKDGEKKADKVSLNVQLSVSSCIKLFVRPPAVKGRPDDVAGKVEWQRAGNRLKGVNPTPFYINLSTLTVGGKEVKEREYIAPFSSREYPLPAGHRVRFSGR

SEQ ID NO: 6024 - protein, 859 aa, Escherichia coli
MRDTSSGRMRTGVTGLALAVMVACVMFRAESGIARTYSFDAAMLKGGGKGVDLTLFEEGGQLPGIYPVDIILNGSRVDSQEMAFHAERDAEGRPYLKTCLTREMLARYGVRIEEYPALFRASGEGRGASVAEEACADLTAIPQATESYQFAAQQLVLGIPQVAPSAAEGDWPEALWDDGIPAFLLNWQANAGRSEYRGYGKRVTDSYWVSLQPGINIGPWRVRNLTTWNRSSGQSGKWESSYIRAERGLNGIKSRLTLGEDYTPSDIFDSVPFRGAMMSSDESMVPYNLREFAPVVRGIARTQARIEVRQNGYLIQSQTVAPGAFALTDLPVTGSGSDLQVTVLESDGTAQVFTVPFTTPAIALREGYLKYNVTAGQYRSSDDAVEHTSLGQVTAMYGLPWGLTVYGGLQGADDYQSAALGLGWSLGRLGAVSLDTTHSRGQQKGHDYETGDTWRIRYNKSFELTGTSFTAASYQYSSDGYHTLPDVLDTWRDDRYAYRHTENRSRRTTLSLSQSLGQWGYVGLNGSRDEYRDRPHRDYFGASYSTSWNNISLSVNWSRNRNSGGYYGGWSRTEDSVSMWMSVPLGRWFGGADNDISTTAQMQRSTGQDTRYEAGLNGRAFDRRLYWDVREQMVPGSESHADTSRLNLTWYGTYGELTGMYSYSSTMRQLNAGMSGSMVAHSEGVTFGQRTGDTVALIAAPGVSGASVGGWPGVRTDFRGYTLAGYASPYQENVLTLDPTTFPEDAEVPQTDSRVVPTKGAVVRAGFRTRVGGRALVSLARQDGTPLPFGAVVTVEGERGQAAGSAGVVGDRGEVYLSGLKESGKLKAQWGENSLCHADYRLPEEKGPAGIFLTRTVCM

SEQ ID NO: 6025 - protein, 232 aa, Escherichia coli
MKSKLIILLMLVPFSSFSTENNFEINKTRVIYSDSTPSVQISNNKAYPLIVQSNIWDENNNKNHDFIATPPIFKMESESRNIIKIIKTNIKLPDSQESMRWLCIESMPPTEKSTKINRKEGRTDSINISIRGCIKLIYQPASVPSPVFNNIVEKLKWHKNGKYLVLKNNTPYYISFSEVFFDSDKVNNAKDILYVKPYSEKKIDISNRIIKKIKWAMIDDAGAKTKLYESIL

SEQ ID NO: 6026 - protein, 232 aa, Escherichia coli
MKSKLIILLTLVPFSSFSTGNNFEINKTRVIYSDSTPSVQISNNKAYPLIIQSNVWDESNNKNHDFIATPPIFKMESESRNIIKIIKTTINLPDSQESMRWLCIESMPPIEKSTKINRKEGRTDSINISIRGCIKLIYRPASVPSPVFNNIVEKLKWHKNGKYLVLKNNTPYYISFSEVFFDSDKVNNAKDILYVKPYSEKKIDISNRIIKKIKWAMIDDAGAKTKLYESIL

SEQ ID NO: 6027 - protein, 75 aa, Escherichia coli
MREITESQLRYISGAGGAPATSANAAGAAAIVGALAGIPGGPLGVVVGAVSAGLTTAIGSTVGSGSASSSAGGGS

SEQ ID NO: 6028 - protein, 178 aa, Escherichia coli
MIKSTGALLLFAALSAGQAIASDVAFRGNLLDRPCHVSGDSLNKHVVFKTRASRDFWYPPGRSPTESFVIRLENCHATAVGKIVTLTFKGTEEAALPGHLKVTGVNAGRLGIALLDTDGSSLLKPGTSHNKGQGEKVTGNSLELPFGAYVVATPEALRTKSVVPGDYEATATFELTYR

SEQ ID NO: 6029 - protein, 227 aa, Escherichia coli
MRIWAVLASFLVFFYIPQSYAGVALGATRVIYPEGQKQVQLAVTNNDDKSSYLIQSWIENAEGKKDARFVITPPLFSMQGKKENTLRIIDATNGQMPEDRESLFWVNVKAIPAMDKAKTGENYLQFAIVSRIKLLYRPQGLVIPPEQAPGKLEFTRENGGLTLFNPTPYYLTVTDLKAGNKSLENTMVPPQGKVTVNIPGGYTGGDITYKTINDYGALTEQVKGVVK

SEQ ID NO: 6030 - protein, 998 aa, Escherichia coli
MTVNKIKNIFNNATLTTKSAFNTASSSVRSAGKKLILLIPDNYEAQGVGINELVKAADELGIEIHRTERDDTAIANQFFGAAEKVVGLTERGVAIFAPQLDKLLQKYQKVGSKIGRTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGSLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAAFHKETGAIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQSGKYEYMTFLIVNGKDTWSVKGIKNHKGVYDYSKLIQFVEKDTKHYQARMISELGDKDDVVYSGAGSSEVFAGEGHDPVSYNKTDVGKLTIDATGASKPGEYIVPKNMYGDVEVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYRQNYGHHTIADEGGKGDRLHLSDISFDDIAFKRVGNDLIMNKAINGVLSFNESNDVNGITFKNWFAKDASGADNHLVEVITDKDGREIKVDKIPHNNNERSGYIKASNIASEKSMVNITSVANDINKIISSVSGFDSGDERLASLYNLSLHQNNTHSTTLTTTV

SEQ ID NO: 6031 - protein, 87 aa, Escherichia coli
MKKMFIAVLFALVSVNAMAADCAKGKIEFSKYNEDNTFTVKVSGREYWTNRWNLQPLLQSAQLTGMTVTIISNTCSPGSGFAQVKFN

SEQ ID NO: 6032 - protein, 79 aa, Escherichia coli
ALVSVNAMAADCAKGKIEFSKYNENDTFTVKVAGKEYWTSRWNLQPLLQSAQLTGMTVTIKSSTCESGSGFAEVQFNND

SEQ ID NO: 6033 - protein, 85 aa, Escherichia coli
FMAVLFALVSVNAMAADCAKGKIEFSKYNENDTFTVKVAGKEYWTSRWNLQPLLQSAQLTGMTVTIKSSTCASGSGFAEVQFNND

SEQ ID NO: 6034 - protein, 84 aa, Escherichia coli
FMAVLFALASVNAMAADCAKGKIEFSKYNEENIHSEGAGKEYWTSRWNLQPLLQSAQLTGMTVTIKSSTCESGSGFAEVQFNND

SEQ ID NO: 6035 - protein, 42 aa, Escherichia coli
WTSRWNLQPLLQSAQLTGMTVTIKSSTCASGSGFAEVQFNND

SEQ ID NO: 6036 - protein, 43 aa, Escherichia coli
EEYWTNRWNLQPLLQSAQLTGMTVTIKSNTCASGSGFAEVQFN

SEQ ID NO: 6037 - protein, 44 aa, Escherichia coli
GTEYWTNRWNLQPLLQSAQLTGMTVTIKSNTCASGSGFAEVQFN

SEQ ID NO: 6038 - protein, 43 aa, Escherichia coli
ILDQSLESATATASAQLTGMTVTIKSSTCASGSGFAEVQFNND

SEQ ID NO: 6039 - protein, 660 aa, Escherichia coli
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVGASESSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 6040 - protein, 87 aa, Escherichia coli
MKKIFVAALFAFVSVNAMAADCAKGKIEFSKYNENDTFTVKVAGKEYWTNRWNLQPLLQSAQLTGMTVTIKSNTCASGSGFAEVQFN

SEQ ID NO: 6041 - protein, 43 aa, Escherichia coli
YWTSRWNLQPLLQSAQLTGMTVTIKSSTCASGSGFAEVQFNND

SEQ ID NO: 6042 - protein, 43 aa, Escherichia coli
YWTSRWNLQPLLQSAQLTGMTVTIKSSTCESGSGFAEVQFNND

SEQ ID NO: 6043 - protein, 656 aa, Escherichia coli
MRLKKRYLCTALSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAVSSDLGYLQVSGSQLKQDFLGLPHGVNNDIAAKHGKMINSSADDKRGIVKLGFTPRENDEYTLTYIKQDGEKDNPPYSRNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFGNEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKINDLPTQTMTAWMTLKPWEPLSVTLSEEARSSSYSNSDGSQKAAGFGVTHIRADYTLGHGFSVNASVNNLFDTKYAYSEGFIEEGRNFWAGIEYTF

SEQ ID NO: 6044 - protein, 240 aa, Escherichia coli
MINFAKMKRFTFNRIATTFGLTLAVLMSSQSALASLSADQTRYIFNGNKDSLTITVTNNDKEKTFGGQAWVDNIIEKDTRPTFVVTPSFFKVKPKGQQTLRVIMASDHVPQDKESVYWLNLQDIPPAMEGNGIAVALRTKLKLFYRPKALIEGRKGAEEGITFKVRPDGRNVLVNTTPYIYAIGNLLDVNGKKISVDSDAAKKLLMFMPGDEVPVNGKVVKVESLNDYGEIETWEVNKKR

SEQ ID NO: 6045 - protein, 87 aa, Escherichia coli
MKKIFVAALFAFVSVNAMAADCPKGKIEFSKYNENDTFTVKVAGKEYWTNRWNLQPLLQSAQLTGMTVTIKSNTCASGSGFAEVQFN

SEQ ID NO: 6046 - protein, 1286 aa, Escherichia coli
MNKAYSIIWSHSRQAWIVASELARGHGFVLAKNTLLVLAVVSTIGNAFAVNISGTVSSGGTVSSGETQIVYSGRGNSNATVNSGGTQIVNNGGKTTATTVNSSGSQNVGTSGATISTIVNSGGIQRVSSGGVASATNLSGGAQNIYNLGHASNTVIFSGGNQTIFSGGITDSTNISSGGQQRVSSGGVASNTTINSSGAQNILSEEGAISTHISSGGNQYISAGANATETIVNSGGFQRVNSGAVATGTVLSGGTQNVSSGGSAISTSVYNSGVQTVFAGATVTDTTVNSGGNQNISSGGIVSETTVNVSGTQNIYSGGSALSANIKGSQIVNSEGTAINTLVSDGGYQHIRNGGIASGTIVNQSGYVNISSGGYAESTIINSGGTLRVLSDGYARGTILNNSGRENVSNGGVSYNAMINTGGNQYIYSDGEATAAIVNTSGFQRINSGGTAPVQNSVVVTRTVSSAAKPFDAEVYSGGKQTVYLWRGIWYSNFLTAVWSMFPGTASGANVNLSGRLNAFAGNVVGTILNQEGRQYVYSGATATSTVGNNEGREYVLSGGITDGTVLNSGGLQAVSSGGKASATVINEGGAQFVYDGGQVTGTNIKNGGTIRVDSGASALNIALSSGGNLFTSTGATLPELTTMAALSVSQNHASNIVLENGGLLRVTSGGTATDTTVNSAGRLRIDDGGTINGTTTINADGIVAGTNIQNDGNFILNLAENYDFETELSGSGVLVKDNTGIMTYAGTLTQAQGVNVKNGGIIFDSAVVNADMAVNQNAYINISDQATINGSVNNNGSIVINNSIINGNITNDADLSFGTAKLLSATVNGSLVNNKNIILNPTKESAGNTLTVSNYTGTPGSVISLGGVLEGDNSLTDRLVVKGNTSGQSDIVYVNEDGSGGQTRDGINIISVEGNSDAEFSLKNRVVAGAYDYTLQKGNESGTDNKGWYLTSHLPTSDTRQYRPENGSYATNMALANSLFLMDLNERKQFRAMSDNTQPESASVWMKITGGISSGKLNDGQNKTTTNQFINQLGGDIYKFHAEQLGDFTLGIMGGYANAKGKTINYTSNKAARNTLDGYSVGVYGTWYQNGENATGLFAETWMQYNWFNASVKGDGLEEEKYNLNGLTASAGGGYNLNVHTWTSPEGITGEFWLQPHLQAVWMGVTPDTHQEDNGTVVQGAGKNNIQTKAGIRASWKVKSTLDKDTGRRFRPYIEANWIHNTHEFGVKMSDDSQLLSGSRNQGEIKTGIEGVITQNLSVNGGVAYQAGGHGSNAISGALGIKYSF

SEQ ID NO: 6047 - protein, 177 aa, Escherichia coli
MSRFQRLTKYVAIGGGAALLLAGAAYLAGAKVNTTKSIPVGLYWKSNAPVEKGAYVMFCPPQVGVFSDAKERGYIAGGFCPGDYGYMMKRVLAAKGDEVAITDAGVRVNGGLLPHSALIKADPSGRPLPRYQSDSYTLGTAEVLLMSDVSDTSFDGRYFGPVNRSQIITVIRPVLTW

SEQ ID NO: 6048 - protein, 47 aa, Escherichia coli
MKKITGIILLLLAAIILAACQANYIRDVQGGTVSPSSTAELTGVETQ

SEQ ID NO: 6049 - protein, 558 aa, Escherichia coli
MKLFKSILLIAACHAAQASAAIDINADPNLTGAAPLTGILNGQQSDTQNMSGFDNTPPPSPPVVMSRMFGAQLFNGTSADSGATVGFNPDYILNPGDSIQVRLWGAFTFDGALQVDPKGNIFLPNVGPVKVAGVSNSQLNALVTSKVKEVYQSNVNVYASLLQAQPVKVYVTGFVRNPGLYGGVTSDSLLNYLIKAGGVDPERGSYVDIVVKRGNRVRSNVNLYDFLLNGKLGLSQFADGDTIIVGPRQHTFSVQGDVFNSYDFEFRESSIPVTEALSWARPKPGATHITIMRKQGLQKRSEYYPISSAPGRMLQNGDTLIVSTDRYAGTIQVRVEGAHSGEHAMVLPYGSTMRAVLEKVRPNSMSQMNAVQLYRPSVAQRQKEMLNLSLQKLEEASLSAQSSTKEEASLRMQEAQLISRFVAKARTVVPKGEVILNESNIDSVLLEDGDVINIPEKTSLVMVHGEVLFPNAVSWQKGMTTEDYIEKCGGLTQKSGNARIIVIRQNGAAVNAEDVDSLKPGDEIMVLPKYESKNIEVTRGISTILYQLAVGAKVILSL

SEQ ID NO: 6050 - protein, 178 aa, Escherichia coli
MSRILKRIAAGVVIAGVAALLLAAGGYAAGARVNTTKSIPVGLYWTSSAPVEKGAYVLFCPPQLGVFDDAKERGYIGAGFCQGGYGYMMKRVLAAKDDAVAVADDGVRVNGELLPLSAPIKADKAGRPLPRYQSNSYTLGNSEVLLMSDVSATSFDGRYFGPINRSQIKTVIRPVITW

SEQ ID NO: 6051 - protein, 263 aa, Escherichia coli
MSKRNAVTTFFTNRVTKALGMTLALMMTCQSAMASLAADQTRYIFRGDKDALTITVTNNDKERTFGGQAWVDNIVEKDTRPTFVVTPSFFKVKPNGQQTLRIIMASDHLPKDKESVYWLNLQDIPPALEGSGIAVAVRTKLKLFYRPKALIEGRKGAEEGISLQSRPDGRTMLVNTTPYIFAIGSLLDGNGKRIATDNETAQKLLMFMPGDEVQVKGNVVKVDSLNDYGELQTWTINQKKTPTSSGQKASDSLVNPSDKADKK

SEQ ID NO: 6052 - protein, 805 aa, Escherichia coli
MKLKTFPKISLLALSIWYSHSSLADELNLDFIQNVSVIPSILKSDAIYPEGQYIVDVTVNKERMGRLGLNISKEDEQNNMLCLSPEWLEKAGVMLNMDAYQDVFDEGKGCYVLAKKPHTLVDFDYGAQTLNLNIPQVYLLGKTDPTRWDYGVNGGRLKYYGNFNKTVHNDFNAFGNIDATINLGRWVLSSNMNVSHSDDKTKFTSSDLTLSTAISQVQGDLLLGKSQTRTELFSDFNFYGAALRSNSNMRPWEFRGYAPDISGVALTPSRVTVKQNGYMVYSKMVPAGPYRLDDLRPMGNGDLVVTVEDENGNKTEQVYPVTTLPTLLRPGEFQYNLAIGKKNNSNELDKAFDSDTGLFWLGSLDYGFTNTTLNSAVLLNENYQSGGLGVTHMLGGLGALSLSANVSKASYNNGEEKSGQSFSAKYAKSFTDKTDLQLLTYRYQSKGYVEFADFNPKDIWQYARYGGQRTRYEARLSHRFDGTYLSGSYWWQDYWMREGQDTGGTMSISTSVFDSVSLFLNGTYSKYAWSDKPDYSVSLNVSVPFNLKGTRHYSSNSVGYTYNGGTTFNSSVSATPTDRFNYSLSTNAGSKGDRGASVSASYAFDAIQTNFGVSRSYSKQGYSQSSLSGSVSGSVLGTSETGPLFTKESSDTVGIVSIPGVEGVSVNGSMPTDRNGNTVVWLSEYSENNININMDNVPDNMEFEITSYNVVPTEKAIVYRKFGFENVLRYILRVKDAQGNYLTGGDAKTEQGLNAGFISNNGVLLMNMLAEPKSVSVATGDGKQCRFSIAGLKANTNKVQEVRCE

SEQ ID NO: 6053 - protein, 89 aa, Escherichia coli
MKKMFMAVLFALVSVNAMAADCAKGKIEFSKYNENDTFTVKVAGKEYWTSRWNLQPLLQSAQLTGMTVTIKSSTCESGSGFAEVQFNND

SEQ ID NO: 6054 - protein, 119 aa, Escherichia coli
MNTVLSFQGASAPVEKKSFFSKFTRLNMLRLARAVIPAAVLMMFFPQLAMAAQGQDLMQSGNSTVKATFGKDSSVVKWVVLAEVLVGAVMYMMTKNVKFLAGFAIISVFIAVGMAVVGL

SEQ ID NO: 6055 - protein, 252 aa, Escherichia coli
MTQMTSIMSVIITSILSCFFSTAQAMDNNITNRTKFFSIHIGATRVIYDMASSGATLAITNKHEFPILVQSDVLSEDKEMSTHFIITPPLFRLDPLQSTRLRIVRTGGNFPIDRESMQWICVKGIPPKEDSKWGGTDAENKDEKMTLNVQLSVNSCIKMFIRPSNVKGHPEDVAGKVKWQITGNKLKGINPTPFYINLAELRVGKKEITEPHYIEPFSSYEYQIPTNGAKKVEWKIITDYGGVGKNFEEFLD

SEQ ID NO: 6056 - protein, 713 aa, Escherichia coli
MAMFTPSFSGLKGRALFSLLFAAPMIHATDSVTTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQENYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 6057 - protein, 132 aa, Escherichia coli
MDAVLSVQGASAPVRNKSFFSKFTRLKKYFSFRPSRLNMLRLARAVIPAAVLMMFFPQLAMAAGSSGQDLMASGNTTVKATFGKDSSVVKWVVLAEVLVGAVMYMMTKNVKFLAGFAIISVFIAVGMAVVGL

SEQ ID NO: 6058 - protein, 998 aa, Escherichia coli
MTVNKIKNIFNNATLTTKSAFNTASSSVRSAGKKLILLIPDNYEAQGVGINELVKAADELGIEIHRTERDDTAIANQFFGAAEKVVGLTERGVAIFAPQLDKLLQKYQKVGSKIGGTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGPLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAAFHKETGAIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQSGKYEYMTSLIVNGKDTWSVKGIKNHKGVYDYSKLIQFVEKNNKHYQARIISELGDKDDVVYSGAGSSEVFAGEGYDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYGQNYGHHTIADEGGKGDRLHLSDISFDDIAFKRVGNDLIMNKAINGVLSFNESNDVNGITFKNWFAKDASGADNHLVEVITDKDGREIKVDKIPHNNNERSGYIKASNIASEKNMVNITSVANDINKIISSVSGFDSGDERLASLYNLSLHQNNTHSTTLTTTV

SEQ ID NO: 6059 - protein, 121 aa, Escherichia coli
MDAVLSVQGASAPVKKKSFFSKFTRLNMLRLARAVIPAAVLMMFFPQLAMAAGSSGQDLMASGNTTVKATFGKDSSVVKWVVLAEVLVGAVMYMMTKNVKFLAGFAIISVFIAVGMAVVGL

SEQ ID NO: 6060 - protein, 124 aa, Escherichia coli; identical to SEQ ID NO: 6005

SEQ ID NO: 6061 - protein, 168 aa, Escherichia coli
ITFCLLAGILMFMAMMVAGRAEAGVALGATRVIYPAGQKQEQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINP

SEQ ID NO: 6062 - protein, 232 aa, Escherichia coli
MKSKLIILLTLVPFSSFSTGNNFEINKTRVIYSDSTPSVQISNNKAYPLIIQSNVWDESNNKNHDFIATPPIFKMESESRNIIKIIKTNIKLPDSQESMRWLCIESMPPIEKSTKINRKEGRTDSINISIRGCIKLIYRPASVPSPVFNNIVEKLKWHKNGKYLVLKNNTPYYISFSEVFFDSDKVNNAKDILYVKPYSEKKIDISNRIIKKIKWAMIDDAGAKTKLYESNL

SEQ ID NO: 6063 - protein, 181 aa, Escherichia coli
MKSKLIILLMLVPFSSFSTGNNFEINKTRVIYSDSTPSVQISNNKAYPLIIQSNIWDENNNKNHDFIATPPIFKMESESRNIIKIIKTNIKLPDSQESMRWLCIESMPPTEKSTKINRKEGRTDSINISIRGCIKLIYRPASVPSPVFNNIVEKLKWHKNGKYLVLKNNTPYYISFSEVFF

SEQ ID NO: 6064 - protein, 232 aa, Escherichia coli
MKSKLIILLMLVPFSSFSTGNNFEINKTRVIYSDSTPSVQISNNKAYPLIIQSNIWDENNNKNHDFIATPPIFKMESESRNIIKIIKTNIKLPDSQESMRWLCIESMPPTEKSTKINRKEGRTDSINISIRGCIKLIYRPASVPSPVFNNIVEKLKWHKNGKYLVLKNNTPYYISFSEVFFDSDKVNNAKDILYVKPYSEKKIDISNRIIKKIKWAMIDDAGAKTKLYESIL

SEQ ID NO: 6065 - protein, 148 aa, Escherichia coli
MKSKLIILLMLVPFSSFSTGNNFEINKTRVIYSDSTPSVQISNNKAYPLIIQSNIWDENNNKNHDFIATPPIFKMESESRNIIKIIKTNIKLPDSQESMRWLCIESMPPTEKSTKINRKEGRTDSINISIRGCIKLIYRHCQCSVSCF

SEQ ID NO: 6066 - protein, 185 aa, Escherichia coli
MKSKLIILLMLVPFSSFSTGNNFEINKTRVIYSDSTPSVQISNNKAYPLIIQSNIWDENNNKNHDFIATPPIFKMESESRNIIKIIKTNIKLPDSQESMRWLCIESMPPTEKSTKINRKEGRTDSINISIRGCIKLIYRPASVPSPVFNNIVEKLKWHKNGKYLVLKNNTPYYISFSEVFLIQIK

SEQ ID NO: 6067 - protein, 232 aa, Escherichia coli
MKSKLIILLMFVPFSSFSTGNNFEINKTRVIYSDSTPSVQISNNKAYPLIIQSNIWDENNNKNHDFIATPPIFKMESESRNIIKIIKTNIKLPDSQESMRWLCIESMPPTEKSTKINRKEGRTDSINISIRGCIKLIYRPASVPSPVFNNIVEKLKWHKNGKYLVLKNNTPYYISFSEVFFDSDKVNNAKDILYVKPYSEKKIDISNRIIKKIKWAMIDDAGAKTKLYESIL

SEQ ID NO: 6068 - protein, 876 aa, Escherichia coli
MFFGDGGQLLSDKSLTGSAGGGNNRMKFNILPLAFFIGIIVSPARAELYFNPRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQLYMSNQARGYIAPEYWDNGITAALLNYDFSGNRVRDSYGGTSDYAYLNLKTGLNIGSWRLRDNTSWSYSAGKGYSQNNWQHINTWLERDIVSLRSRLTMGDSYTRGDIFDGVNFRGIQLASDDNMVPDSQRGYAPTIHGISRGTSRISIRQNGYEIYQSTLPPGPFEINDIYPAGSGGDLQVTLQEADGSVQRFNVPWSSVPVLQREGHLKYALSAGEFRSGGHQQDNPRFAEGTLKYGLPAGWTVYGGAWIAERYRAFNLGVGKNMGWLGAVSLDATRANARLPDESRHDGLSYRFLYNKSLTETGTNIQLIGYRYSTRGYFSFADTAWKKMSGYSVLTQDGVIQIQPKYTDYYNLAYNKRGRVQVSISQQTGESSTLYLSGSHQSYWGTDRTDRQLNAGFNSSVNDISWSLNYSLSRNAWQHETDRILSFDVSIPFSHWMRSDSTSAWRNASARYSQTLEAHGQAASTAGLYGTLLGDNNLGYSIQSGYTRGGYEGSSKTGYASLNYRGGYGNASAGYSHSGGYRQLYYGLSGGILAHANGLTLSQPLGDTLILVRAPGASDTRIENQTGVSTDWRGYAVLPYATDYRENRVALDTNTLADNVDIENTVVSVVPTHGAVVRADYKTRVGVKVLMTLMRNGKAVPFGSVVTARNGGSSIAGENGQVYLSGMPLSGQVSVKWGSQTTDQCTADYKLPKESAGQILSHVTVSCR

SEQ ID NO: 6069 - protein, 696 aa, Escherichia coli
MRITTLASVVIPCLGFSASSIAAAEDVMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPNLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLGYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 6070 - protein, 1024 aa, Escherichia coli
MPTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGSAENIGDNLGKAGSVLSTFQNFLGTALSSMKIDELIKKQKSGSNVSSSELAKASIELINQLVDTAASINNNVNSFSQQLNKLGSVLSNTKHLNGVGNKLQNLPNLDNIGAGLDTVSGILSAISASFILSNADADTGTKAAAGVELTTKVLGNVGKGISQYIIAQRAAQGLSTSAAAAGLIASVVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGSVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGKNLTETDNLYSVEELIGTTRADKFFGSKFTDIFHGADGDDHIEGNDGNDRLYGDKGNDTLSGGNGDDQLYGGDGNDKLIGGAGNNYLNGGDGDDELQVQGNSLAKNVLSGGKGNDKLYGSEGADLLDGGEGNDLLKGGYGNDIYRYLSGYGHHIIDDDGGKDDKLSLADIDFRDVAFRREGNDLIMYKAEGNVLSIGHKNGITFRNWFEKESGDISNHQIEQIFDKDGRVITPDSLKKALEYQQSNNKASYVYGNDALAYGSQDNLNPLINEISKIISAAGNFDVKEERAAASLLQLSGNASDFSYGRNSITLTASA

SEQ ID NO: 6071 - protein, 673 aa, Escherichia coli
MKMTRLYPLALGGLLLPAIANAQTSQQDESTLVVTASKQSSRSASANNVSSTVVSAPELSDAGVTASDKFPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 6072 - protein, 856 aa, Escherichia coli
MLKRVSCAPQSVFVLNRLHIMKKNKSTFTINFITYSLMLSLAGVPVYAVDFNTDVLDAADRQNIDFSRFSRAGYIMPGQYQMEIRVNGQDISPSAFQIAFLEPPFSDSDNEKPLPEPCLTPEIVSRMGLTEASQEKVTYWNNGQCADFRQLSGVEIRPNPAEGMLYINMPQAWLEYSDASWLPPSRWDNGIPGLLFDYNINGTVNKPHQGKQSQSLNYNGTAGANFGAWRLRADYQGNLNHTTGSAQGTDSQFTWSRFYMYRAIPRWRANLTLGENYINSEIFSSWRYTGASLESDDRMLPPKLRGYAPQVSGIADTNARVVISQQGRILYDSTVPAGPFTIQDLDSSVRGRLDVEVIEQDGRKKTFQVDTAYVPYLTRPGQVRYKLVSGRSRNYEHSMEGPVFAAGEASWGISNTWSLYGGSIVAGDYNALAVGLGRDLSEFGTVSADVTQSVARIPGYDTKQGKSWRLSYSKRFDEVNTDITFAGYRFSERNYMTMDQYLNARYRNDFTGREKELYTVTLNKNFEDWKASVNLQYSHQTYWDRRTSDYYTLSVNRYFDAFSFKNIALGISASRSKYQNRDNDSAFVRLSVPWGTGTASYSGSMSNDRYTNTVGYSDTLNNGLSSYSLNAGVNSGGGQPSQRQMSAYYNHNGSLTNLSASFSAVENGYSSFGMSASGGATVTMKGAALHAGGMNGGTRLLVDTDGVGGVPVDGGRVYTNRWGIGVVTDVSSYYRNTTSVDLNKLPEDMEATRSVVESVLTEGAIGYREFEVLKGSRLFAVLRMSDNSYPPFGASVTNAKGRELGMVADSGLAWLSGVNPGETLNVGWDGRTQCVVDIPAHPDPAQQLLLPCRQVK

SEQ ID NO: 6073 - protein, 258 aa, Escherichia coli
MKNITFIFFILLASPLYANGDRLYRADSRPPDEIKRSGGLMPRGHNEYFDRGTQMNINLYDHARGTQTGFVRYDDGYVSTKLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNSSRTITGDTCNEETQNLSTIYLREYQSKVKRQIFSDYQSEVDIYNRIRDEL

SEQ ID NO: 6074 - protein, 836 aa, Escherichia coli
MKDRIPFAVNNITCVILLSLFCNAASAVEFNTDVLDAADKKNIDFTRFSEAGYVLPGQYLLDVIVNGQSISPASLQISFVEPQSSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNTISVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 6075 - protein, 567 aa, Escherichia coli
MKIKLRITIILISALCIFNGLLTPGAYAATANGYVANKENLRSFFETVSSYAGKPTIVSKLAMKKQISGNFDLTEPYALIERLSAQMGLIWYDDGKAIYIYDSSEMRNALINLRKVSTNEFNNFLKKSGLYNSRYEIKGGGNGTFYVSGPPVYVDLVVNAAKLMEQNSDGIEIGRNKVGIIHLVNTFVNDRTYELRGEKIVIPGMAKVLSTLLNNNIKQSTGVNVLSEISSRQQLKNVSRMPPFPGAEEDDDLQVEKIISTAGAPETDDIQIIAYPDTNSLLVKGTVSQVDFIEKLVATLDIPKRHIELSLWIIDIDKTDLEQLGADWSGTIKIGSSLSASFNNSGSISTLDGTQFIATIQALAQKRRAAVVARPVVLTQENIPAIFDNNRTFYTKLVGERTAELDEVTYGTMISVLPRFASRNQIELLLNIEDGNEINSDKTNVDDLPQVGRTLISTIARVPQGKSLLIGGYTRDTNTYESRKIPILGSIPFIGKLFGYEGTNANNIVRVFLIEPREIDERMMNNANEAAVDARAITQQMAKNKEINDELLQKWIKTYLNREVVGG

SEQ ID NO: 6076 - protein, 119 aa, Escherichia coli
MNLSLSEGGRPASVKNRAWHYCQMAWRGVCTPKALSRLAAFSPLLLLGMGQMAHATDLLAGGKNDVKATFGADSFVIMCIYIAEIVIGVATYIRTKNLLILLGLVVVIVFTTVGLTFVN

SEQ ID NO: 6077 - protein, 72 aa, Escherichia coli
MKKSILFIFLSVLSFSPFAQDAKPAGSSKEKITLESKKCNIVKKNNESSPESMNSSNYCCELCCNPACTGCY

SEQ ID NO: 6078 - protein, 733 aa, Escherichia coli
MMISKKYTLWALNPLLLTMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAAFLQSGYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTVDLLGSYQLPVGTLSFSIENLFDRDYTTVWGQRAPLYYSPGYGPASLYDYKGRGRTFGLNYSVLF

SEQ ID NO: 6079 - protein, 998 aa, Escherichia coli
MTVNKIKNIFNNATSTTKSAFNTASSSVRSAGKKLILLIPDNYEAQGVGINELVKAADELGIEIHRTERDDTAIANQFFGTAEKVVGLTERGVAIFAPQLDKLLQKYQKVGSKIGGTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGPLGDGLDVVSGILSAVSASFILGNSDAHTGTKAAAGIELTTQVLGNVGKAVSQYILAQRMAQGLSTTAASAGLITSAVMLAISPLSFLAIADKFERAKQLESYSERFKKFNYEGDALLAAFHKESGAIDAALTTINTVLSSVSAGVSAASSASLIGAPISMLVSALTGTISGILEASKQAMFEHVADKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFVTPTFTPGEEVRERKQSGKYEYMTSLIVNGKDTWSVKGIKNHKGVYDYSNLIQFVEKDNKHYQARIISELGDKDDIVYSGAGSSEVFAGEGHDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGRGNDELQAHGAYNILSGGTGDDKLYGGGGIDLLDGGEGNDYLNGGFGNDIYVYRQNYGHHTIADEGGKGDRLHLSDISFDDIAFKKVGNDLIMNKAINGALSFNESNDVNGITFKNWFAKDASGEDNHLVEVITDKDGREIKADKISHNNNEQSGYIKASNIASEKNMVNITSVANDINKIISSVSGFDSGDERLASLYNLSLHQNNTHSTTLTTTV

SEQ ID NO: 6080 - protein, 657 aa, Escherichia coli
MYMNVIKTAICTLITLPVGLQAATSHSSSMTKDTITVVATGNQNTVFETPSMVSVVTNDTPWSKNAVTSAGMLRGVAGLSQTGAGRTNGQTFNLRGYDKSGVLVLVDGVRQLSDMAKSSGTYLDPALVKRIEVVRGPNSSLYGSGGLGGVVDFRTADAADFLPPGETNGVSLWGNIASGDHSTGSGLTWFSKTEKTDALLSVIMRKRGSIYQSDGERAPNKEKPAALFAKGSVSITDSNKAGASLRLYRNSTTEPGNPTLTHGDSGLRDRKTAQNDMQFWYQYAPADNSLINVKSTLYLSDITVKTNGHNKTAEWRNNRTSGVNVVNRSHSLIFPGAHQLSYGAEYYRQQQKPEGTATLYPEGHIDFTSLYFQDEMTMESYPVNIIVGSRYDRYNSFNARAGELNAERLSPRAAMSVSPTDWLMMYGSISSAFRAPTMAEMYRDDVHFYRKGKPNYWVPNLNLKPENNTTREIGAGIQLDSLLTDNDRLQLKGGYFGTDARNYIATRVDMKRMRSYSYNVSRARIWGWDIQGNYQSDYVDWMLSYNRTESMDASSREWLGSGNPDTLISDISIPVGHRGVYAGWRTELSAPATHVKKGDPCQDGYAIHSFSLSYKPVSVKGFEASVTLDNAFNKLAMNGKGVPLSGRTVNLYTRYQW

SEQ ID NO: 6081 - protein, 258 aa, Escherichia coli
MANKRTPIFIAGILIPILLNGCSSGKNKAYLDPKVFPPQVEGGPTVPSPDEPGLPLPGPGPALPTNGAIPIPEPGTAPAVSLMNMDGSVLTMWSRGAGSSLWAYYIGDSNSFGELRNWQIMPGTRPNTIQFRNVDVGTCMTSFPGFKGGVQLSTAPCKFGPERFDFQPMATRNGNYQLKSLSTGLCIRANFLGRTPSSPYATTLTMERCPSSGEKNFEFMWSISEPLRPALATIAKPEIRPFPPQPIEPDEHSTGGEQ

SEQ ID NO: 6082 - protein, 269 aa, Escherichia coli
MKKYIISLIVFLSFYAQADLTDFRVATWNLQGASATTESKWNINVRQLISGENAVDILAVQEAGSPPSTAVDTGTLIPSPGIPVRELIWNLSTNSRPQQVYIYFSAVDALGGRVNLALVSNRRADEVFVLSPVRQGGRPLLGIRIGNDAFFTAHAIAMRNNDAPALVEEVYNFFRDSRDPVHQALNWMILGDFNREPADLEMNLTVPVRRASEIISPAAATQTSQRTLDYAVAGNSVAFRPSPLQAGIVYGARRTQISSDHFPVGVSRR

SEQ ID NO: 6083 - protein, 181 aa, Escherichia coli
MKKLAIVFTMLLIAGCSSSQDSANNQIDELGKENNSLFTFRNIQSGLMIHNGLHQHGRETIGWEIVPVKTPEEALVTDQSGWIMIRTPNTDQCLGTPDGRNLLKMTCNSTAKKTLFSLIPSTTGAVQIKSVLSGLCFLDSKNSGLSFETGKCIADFKKPFEVVPQSHLWMLNPLNTESPII

SEQ ID NO: 6084 - protein, 233 aa, Escherichia coli
MSKFVIFLVFLFISCSSLAAGAFGPTENRLIFDGSKSFISYQISNSDKKIPWLVQAWVEDAKENRTNDFTAAPLVFRVEPSSQFSARLIKKGSVREDQETIYWVVSNAIPGGEEVKTEQERGKISAKLSLAYRYKVPMIYRPKSLSNINKEPESLNWTTNKDGHVKVYNPSRYVVQINHVDINGQRKQGDGISYLIPPMATVDMAIKASVNTKIKYGVINDYGAVNEYEGTVQ

SEQ ID NO: 6085 - protein, 490 aa, Escherichia coli
MDKVTDNSPDVESTESTEGSFPTVGVDTGDTITATLATGTENVGGGGGAFGGASESSAAIHATAKWSTAQLKKHQAEQAARAAAAEAALAKAKSQRDALTQRLKDIVNDALRANAARSPSVTDLAHANNMAMQAEAERLRLAKAEQKAREEAEAAEKALREAERQRDEIARQQAETAHLLAMAEAAEAEKNRQDSLDEEHRAVEVAEKKLAEAKAELAKAESDVQSKQAIVSRVAGELENAQKSVDVKVTGFPGWRDVQKKLERQLQDKKNEYSSVTNALNSAVSIRDAKKTEVQNAEIKLKEAKDALEKSQVKDSVDTMVGFYQYITEQYGEKYSRIAQDLAEKAKGSKFNSVDEALAAFEKYKNVLDKKFSKVDRDDIFNALESITYDEWAKHLEKISRALKVTGYLSFGYDVWDGTLKGLKTGDWKPLFVTLEKSAVDFGVAKIVALMFSFIVGAPLGFWGIAIITGIVSSYIGDDELNKLNELLGI

SEQ ID NO: 6086 - protein, 68 aa, Escherichia coli
AWREEPWIHHAPQGCGDSSRTITGDTCNEETQNLSTIYLRKYQSKVKRQIFSDYQSEVDIYNRIRNEL

SEQ ID NO: 6087 - protein, 72 aa, Escherichia coli; identical to SEQ ID NO: 6077

SEQ ID NO: 6088 - protein, 240 aa, Escherichia coli
MKHILLFIFTVLLSLPSYGSVVIMGTRVIYPAEQKSINVRLNNGDSTPSLIQAWLDTGDPSSPPDSVRVPFIITPPVFRMEPLSGQTMRIMYTGEKLPADRESLFWLNVLDIPAKPSFAGKSEKAQGYNYLQFAVRSRIKFFFRPDGLPFSPDDAYKKVTWQLTGGDTLQASNPTPYFITFSTVSVGQGAQKVSSTQGGMAAPFSSVTFRLKQKVSPSGKVEWTVVNDNGGYQKGESVLK

SEQ ID NO: 6089 - protein, 822 aa, Escherichia coli
MLSVPLWAAEDAEFDPSFLSRTPGSSVIDVRRFTHGNPVPSGNYYSDIYLNGEWKGNAELSFRDMSSSQEESVLCVTPELLSILDVSPEAVAREPDTGNGRCMPFSAVVPDAKIRFDLSLLRLNVEIPQAMLVSRPRGYISPSQWQTGVPAAFVSYDVNHWRYRTPDMENNQSYLGLRAGFNAGGWAFRHRGTESWSDGHAEGYRSIETNLQHDIAMLRAQLTLGDFTTTGELMDSNSLRGIRLASDDRMLPGSLRGYAPVVRGMAGSNARVTVRQNGNIIYETTVPAGPFSISDLYPSGYGGDLTVTVTESDGQTRSFIVPFASVAQLVRPGFSRWQVAAGRYRYGNRTFSDTVFQGTLQYGLTNDITLNTGMSTAPHYLSGLGGVAFNTPLGAVATDITLARTTFPGSDTTHRGYSLHAGYSARIPETSTNVTLAAYRYSSRDFWSLRDAILTRNRDVINDSSVRSATGYRPRNQLQLTVNQSLGEGWGNLYLTGATYHYWGHTGTFNEYQAGYNNVWKKMSYQIGFSQTRRSGDYHHDNRFFFSFSLPLSDTGRTLLSTTVNVSDKNSNSIQSSISGVSGDDNQLSYGVSLNTQENGPTGYAVNGSYRSPVATLQATAGNDSRHNRQISAGISGAIVAHPFGVTASNDLGDTFTVIHADGAGGAVINNAPGNRLDPWGNGIVPYVTPYEKNYISIDPTALAADVELSATEREIIPRANSTTMVTFTTKTGKAMLFDVKMPDGTPPPMAAEALTADGKSAGYIAQGGRLFVRDLDAEKGMLRIVWGSGQNDSCVIHYSASGENARGNAVPENHHVVCMRQ

SEQ ID NO: 6090 - protein, 673 aa, Escherichia coli
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLALNLVGPHYFDGDNQLRQGTYATLDSSLGWQATERMNISVYVDNLFDRRYRTYGYMNGSSAVAQVNMGRTVGINTRIDFF

SEQ ID NO: 6091 - protein, 673 aa, Escherichia coli
MKMTRLYPLALGGLLLPTIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 6092 - protein, 673 aa, Escherichia coli
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNIPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 6093 - protein, 998 aa, Escherichia coli
MTVNKIKNIFNNATLTTKSAFNTASSSVRSAGKKLILLIPDNYEAQGVGINELVKAADELGIEIHRTERDDTAIANQFFGAAEKVVGLTERGVAIFAPQLDKLLQKYQKVGSKIGGTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGPLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAGFHKETGAIDAGLTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITHQHWDEKIGELAGITRNADRSQSGKPYINYLENGGLLEAQPKEFTQQVFDPQKGTIDLSTGNVSSVLTFITPTFTPGEEVRERKQSGKYEYMTSLIVNGKDTWSVKGIKNHKGVYDYSKLIQFVEKNTKHYQARIISELGDKDDVVYSGAGSSEVFAGEGYDPVSYNKTDVGKLTIDATGAPKPGEYIVPKNMYGDVEVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYGQNYGHHTIADEGGKGDRLHLSDISFDDIAFKRVGNDLIMNKAINGVLSFNESNDVNGITFKNWFAKDASGADNHLVEVITDKDGREIKVDKIPHNNNERSGYIKASNIASEKNMVNITSVANDINKIISSVSGFDSGDERLASLYNLSLHQNNTHSTTLTTTV

SEQ ID NO: 6094 - protein, 596 aa, Escherichia coli
MQGTITVRSYDMLNEEQYYQFFLSVLDVYGFAVVDMHNGILKVVRSKDAKTSAVPVASDVSPGTGDEVVTRVVPVSNVAARDLAPLLRQLNDNAGAGSVVHYEPSNVLLMTGRAAVMKRLMEIVERVDKVGNRSVATVPLTYASATDVARLVTELTKETDKTAIPAWMTAKLVADERTNSVLVSGEPISQQRIISIIKQLDRQEDVQGNTKVIYLKYAKAKDLVEVLTGISSSIENDSKKSPSTEALRKGVTIKSHEQTNALILTGAPDVIRDLENVISQLDIRRPQVLVEAIIAEIQDADGLNLGIQWVNKHAGVAQFTSTGLPITTMVQTRQNEILDSDQSNALSMFNGIAAGFYQGNWAMLLTALSTSSKNDILATPSIVTLDNMEATFNVGQEVPVLSGSQTTSGDNIFNTVERKTVGIKLRVKPQINEGDSVLLEIEQEVSGVADTAVATTTDLGATFNTRTVTNAMLVGNCETVVVGGLLDKSIRGSESKVPLLGDIPVLGHLFRAKSEQTAKRNLMLFIRPTIIRERDGFRHASAEKYQSFNQEQVQSRGKETTALTLNEEQLRLSPDQDDTAFRKVKAAIAAFYAQEM

SEQ ID NO: 6095 - protein, 605 aa, Escherichia coli
MLLKTSRRTFLKGLTLSGVAGSLGVWSFNARSSLSLPVAASLQGTQFDLTIGETAVNITGSERQAKTINGGLPGPVLRWKEGDTITLKVKNRLNEQTSIHWHGIILPANMDGVPGLSFMGIEPDDTYVYTFKVKQNGTYWYHSHSGLQEQEGVYGAIIIDAREPEPFAYDREHVVMLSDWTDENPHSLLKKLKKQSDYYNFNKPTVGSFFRDVNTRGLSATIADRKMWAEMKMNPTDLADVSGYTYTYLMNGQAPLKNWTGLFRPGEKIRLRFINGSAMTYFDIRIPGLKMTVVAADGQYVNPVTVDEFRIAVAETYDVIVEPQGEAYTIFAQSMDRTGYARGTLATREGLSAAVPPLDPRPLLTMEDMGMGGMGHDMAGMDHSQMGGMDNSGEMMSMDGADLPDSGTSSAPMDHSSMAGMDHSRMAGMPGMQSHPASETDNPLVDMQAMSVSPKLNDPGIGLRNNGRKVLTYADLKSRFEDPDGREPGRTIELHLTGHMEKFAWSFNGIKFSDAAPVLLKYGERLRITLINDTMMTHPIHLHGMWSDLEDENGNFMVRKHTIDVPPGTKRSYRVTADALGRWAYHCHLLYHMEMGMFREVRVEE

SEQ ID NO: 6096 - protein, 296 aa, Escherichia coli
MKRNLKAIPVLVAGLFTSQLSIAAGSVSADPHAGHDMSAMQMPADENFTEMTSMEPIVTESRTPIPPVTDADRKAAFGNLQGHAIHDSAINYLVLLDQLEWQRSDNTNNFSWSVNSWIGGDTDRIWLKSEGERSNGETEAAEAQLLWGHAVGPWWDLVAGVRQDFRPASARTWAAVGFQGLALYNFESEITGFVSNGGKAALRLGGEYDVLLTNRLILQPSYEVNFYSQDDESRGRGRGLTDTELGLRLRYEIRREFAPYIGVSWNQLYGKTSDMAKREGEKDHQVVFLAGARIWF

SEQ ID NO: 6097 - protein, 126 aa, Escherichia coli
MSILNKAILTGGLVMGVAFSAMAHPELKSSVPQADSAVAAPEKIQLNFSENLTVKFSGAKLTMTGMKGMSSHSPMPVAAKVAPGADPKSMVIIPREPLPAGTYRVDWRAVSSDTHPITGNYTFTVK

SEQ ID NO: 6098 - protein, 144 aa, Escherichia coli
MKKILVSFVAIMAVASSAMAAETMNMHDQVNNAQAPAHQMQSSAEKSAVQGDSMTMMDMSSHDQAAMSHDMMQNGNSAAHQDMAEMHKKMMKSKPAASNETAKSFSEMNEHEKSAVVHEKANNGQSSVIHQQQAEKHRSQITQN

SEQ ID NO: 6099 - protein, 998 aa, Escherichia coli
MTVNKIKNIFNNATLTTKSAFNTASSSVRSAGKKLILLIPDNYEAQGVGINELVKAADELGIEIHRTERDDTAIANQFFGAAEKVVGLTERGVAIFAPQLDKLLQKYQKVGSKIGGTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGPLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAGFHKETGAIDAGLTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITHQHWDEKIGELAGITRNADRSQSGKAYINYLENGGLLEAQPKEFTQQVFDPQKGTIDLSTGNVSSVLTFITPTFTPGEEVRERKQSGKYEYMTSLIVNGKDTWSVKGIKNHKGVYDYSKLIQFVEKNTKHYQARIISELGDKDDVVYSGAGSSEVFAGEGYDPVSYNKTDVGKLTIDATGAPKPGEYIVPKNMYGDVEVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYGQNYGHHTIADEGGKGDRLHLSDISFDDIAFKRVGNDLIMNKAINGVLSFNESNDVNGITFKNWFAKDASGADNHLVEVITDKDGREIKVDKIPHNNNERSGYIKASNIASEKNMVNITSVANDINKIISSVSGFDSGDERLASLYNLSLHQNNTHSTTLTTTV

SEQ ID NO: 6100 - protein, 490 aa, Escherichia coli
MDKVTDNSPDVESTESTEGSFPTVGVDTGDTITATLATGTENVGGGGGAFGGASESSAAIHATAKWSTAQLKKHQAEQAARAAAAEAALAKAKSQRDALTQRLKDIVNDALRANAARSPSVTDLAHANNMAMQAEAERLRLAKAEQKAREEAEAAEKALREAERQRDEIARQQAETAHLLAMAEAAEAEKNRQDSLDEEHRAVEVAEKKLAEAKAELAKAESDVQSKQAIVSRVAGELENAQKSVDVKVTGFPGWRDVQKKLERQLQDKKNEYSSVTNALNSAVSIRDAKKTDVQNAEIKLKEAKDALEKSQVKDSVDTMVGFYQYITEQYGEKYSRIAQDLAEKAKGSKFSSVDEALAAFEKYKNVLDKKISKVDRDAIFNALESVNYDELSKNLTKISKSLKITSRVSFLYDVGSDFKNAIETGNWRPLFVTLEKSAVDVGVAKIVALMFSFIVGVPLGFWGIAIVTGIVSSYIGDDELNKLNELLGI

SEQ ID NO: 6101 - protein, 548 aa, Escherichia coli
MAKELSGYGPTAGESMGGTGANLNQQGGNNNSNSGVHWGGGSGHGNNGGQGNSNSSGSTSTVMKTGESYLTPWGDVVINNDGLPVMNGIVMTEENSTLVDNPFGGVSRVLNSLISDMPSLFAESSGNNNNNTASVNTAPTNAQVSDMDKSSKVVSNVINEKQKQKNKIATQISEKQKKIEEMKKVFKHHSYHGITDLERDVDELQKKSNQLDADISKLNSYKNTLQSKIGDVNKQKEAEEKARENAEVAEHETLNEEKQAVAEAEKRLAEAKAELAKAESDVQSKQATVSRVAGELENAQKSVDVKVTGFPGWRDVQKKLQRQLEAKQAEYSAVENELKNAVSFRDGKAAEVKEAEQKLKEAQDALEKSQIKDAVDTMVGFYQYITEQYGEKYAKIAQDLAEKSKGKKIQGVDEALAAFEKYKNVLDKKFSKVDRDAIFNALESVNYDELSKNLTKISKSLKITSRVSFLYDVGSDFKNAIETGNWRPLFVTLEKSAVDVGVAKIVALMFSFIVGVPLGFWGIAIVTGIVSSYIGDDELSKLNELLGI

SEQ ID NO: 6102 - protein, 512 aa, Escherichia coli
MKKISFFIFTALFCCSAQAAPSSLEKRLGKNEYFIITKSSPVRAILNDFAANYSIPVFISSSVNDDFSGEIKNEKPVKVLEKLSKLYHLTWYYDENILYIYKTNEISRSIITPTYLDIDSLLKYLSDTISVNKNSCNVRKITTFNSIEVRGVPECIKYITSLSESLDKEAQSKAKNKDVVKVFKLNYASATDITYKYRDQNVVVPGVVSILKTMASNGSLPSTGKGAVERSGNLFDNSVTISADPRLNAVVVKDREITMDIYQQLISELDIEQRQIEISVSIIDVDANDLQQLGVNWSGTLNAGQGTIAFNSSTAQVNISSSVISNASNFMIRVNALQQNSKAKILSQPSIITLNNMQAILDKNVTFYTKVSGEKVASLRSITSGTLLRVTPRILDDSSNSLTGKRRERVRLLLDIQDGNQSTNQSNAQDASSTLPEVQNSEMTTEATLSAGKVYYLADLSKIKKVPSKDGIPLLSDIPVIGSLFSSTVKQKHSVVRLFLIKATPIKSASSE

SEQ ID NO: 6103 - protein, 89 aa, Escherichia coli
MKKILLIAASLSFFSASVLAAPDCVTGKVEYTKYNDDDTFTVKVGDKELFTNRWNLQSLLLSAQITGMTVTIKTNACHNGGGFSEVIFR

SEQ ID NO: 6104 - protein, 87 aa, Escherichia coli
MKKMFIAVLFALVSVNAMAADCAKGKIEFSKYNEDNTFTVKVSGREYWTNRWNLQPLLQSAQLTGMTVTIISNTCSSGSGFAQVKFN

SEQ ID NO: 6105 - protein, 87 aa, Escherichia coli
MKKMIIAVLFGLFSANSMAADCAVGKIEFSKYNEDDTFTVKVSGREYWTNRWNLQPLLQSAQLTGMTVTIISNTCSSGSGFAQVKFN

SEQ ID NO: 6106 - protein, 1377 aa, Escherichia coli
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTQMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDAALSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 6107 - protein, 287 aa, Escherichia coli
MRRGISLWGSAGYLQQNCGIQRNYRRLRVNKRSAVTKFFTNRVTKVLGMTLALMMASQSAMASLAADQTRYVFRGDKDALTITVTNNDKTHTFGGQAWVDNIVEKDTRPTFVVTPSFFKVKPNGQQTLRIIMASDHLPKDKESVYWLNLQDIPPALEGSGLAIALRTKLKLFYRPKALLEGRKGAEEGISLQSRPDGRTMLVNTTPYIYAIGGLLDANGKKITTDSETTQKLLMFMPGDEVQVKGNVVKVESLDDFGDLKTWVINQKKSSTTSTNVDKTTQPHKSAA

SEQ ID NO: 6108 - protein, 790 aa, Escherichia coli
MAVMAALESGASYAGEKLDMSFIQGGAGTNPDVWAALNSNYAPGRYLVELSLNGKILGKHILDVTPEDSNELCLTEEWLTKAGVYISTDYFREGYDATRKCYALSKAQAVKVDFDVSTQSLVLTIPQKGLVKVPENVDWDYGTSAFRVNYSANANMGRHNTSAFGSADLKANIGHWVVSSSATASTGDSGDNNASINMFTATRAIRSLSADLAVGKTSTGDSLLGSTGTYGISLSRNNSMKPGNLGYSPVFSGIANGPSRVTLIQNGRILHSEMVPAGPFSITDVQLYTSGDVTMKITGEDGREQTQVFPLSVVNGQLNPGQHEFNIAAGLPDDDSHLKGGVFAASYGYGLDNLTLRAGGVFNHDWLGGSAGVVAGLSYLGAVSVDGAYATAKYRDGNHAGNKVQVAWNKQLEITNTGLRVSWAHQSEEYEDMSSFDPSKLWGEENHGRHTKDEWNMGISQPVGGLFNLSVSGWQRSYYPISGAGYSSLYSDGKDTGLTGTLSTQIKGVSLNFGVSGSRNSQGNDNWSASASVSVPFTLFDRRYSSSTSVSTSKSGGVAFSTGVSGSLNDRFSYGLGGGRDGDGGASGYFNASYSGDRAYLSGALNYSQSGGTSGSVSASGSVLAVPAARDIMFSRTSADTVAVVNVKNTPGVKVMSGNGETDKDGNLVVPLNSYDWNTVTVDAGTLPLDTELGNTSQKVVPTDKAVVWMPFDALKVHRYLLQVKQRNGEFVPGGTWARDSKKTPLGFVANNGVLMINAVDAPGDITLGQCRIPATKLRDTEKLQEITCE

SEQ ID NO: 6109 - protein, 660 aa, Escherichia coli
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGVTTTLVLGNAFDKEYWSPQGIPQDGRNGKIFVSYQW

SEQ ID NO: 6110 - protein, 682 aa, Escherichia coli
MKNKYIIAPGIAVMCSAVISSGYASSDKKEDTLVVTASGFTQQLRNAPASVSVITSEQLQKKPVSDLVDAVKDVEGISITGGNEKPDISIRGLSGDYTLILVDGRRQSGRESRPNGSGGFEAGFIPPVEAIERIEVIRGPMSSLYGSDAIGGVINIITKPVNNQTWDGVLGLGGIIQEHGKFGNSTTNDFYLSGPLIKDKLGLQLYGGMNYRKEDSISQGTPAKDNKNITATLQFTPTESQKFVFEYGKNNQVHTLTPGESLDAWTMRGNLKQPNSKRETHNSRSHWVAAWNAQGEILHPEIAVYQEKVIREVKSGKKDKYNHWDLNYESRKPEITNTIIDAKVTAFLPENVLTIGGQFQHAELRDDSATGKKTTETQSVSIKQKAVFIENEYAATDSLALTGGLRLDNHEIYGSYWNPRLYAVYNLTDNLTLKGGIAKAFRAPSIREVSPGFGTLTQGGASIMYGNRDLKPETSVTEEIGIIYSNDSGFSASATLFNTDFKNKLTSYDIGTKDPVTGLNTFIYDNVGEANIRGVELATQIPVYDKWHVSANYTFTDSRRKSDDESLNGKSLKGEPLERTPRHAANAKLEWDYTQDITFYSSLNYTGKQIWAAQRNGAKVPRVRNGFTSMDIGLNYLILPDTLINFAVLNVTDRKSEDIDTIDGNWQVDEGRRYWANVRVSF

SEQ ID NO: 6111 - protein, 244 aa, Escherichia coli
MWKLSMIRKKILMAAIPLFVISGADAAVSLDRTRAVFDGSEKSMTLDISNDNKQLPYLAQAWIENENQEKIITGPVIATPPVQRLEPGAKSMVRLSTTPDISKLPQDRESLFYFNLREIPPRSEKANVLQIALQTKIKLFYRPAAIKTRPNEVWQDQLILNKVSGGYRIENPTPYYVTVIGLGGSEKQAEEGEFETVMLSPRSEQTVKSANYNTPYLSYINDYGGRPVLSFICNGSRCSVKKEK

SEQ ID NO: 6112 - protein, 89 aa, Escherichia coli
MKKMFMAVLFALVSVNAMAADCAKGKIEFSKYNENDTFTVKVAGKEYWTNRWNLQPLLQSAQLTGMTVTIKSSTCASGSGFAEVQFNND

SEQ ID NO: 6113 - protein, 258 aa, Escherichia coli; identical to SEQ ID NO: 5958

SEQ ID NO: 6114 - protein, 238 aa, Escherichia coli
MLSVYNRTQKMKEEARKKLAKYHELRKQRGMSLLEVIIVLGIIGTIAAGVVILAQRAFDSRTVSELVTNTNTIRVAMKDAYQRDGKYPDYQAPLSLTADSIKTDSTGIAVAQLVQLGKLTPDEARNGISGDYIGIGGAITSSGSTINKGFAMELNGLSQEQCRSILGQVGDNWEYVAVGTSPSGSYDALSAGAVNMLAATDNTTILRSLAANGQVSLTAEKILKTCTATVNSITLASR

SEQ ID NO: 6115 - protein, 221 aa, Escherichia coli
MKNYLWLVALLPLLSGCESQAILVKKDDAYFAPPKTEAPPPADGRAGGVFETGYNWSLTADRRAYRVGDILTVILEESTQSSKQAKTNFGKNNTVDIGAPTIFGHTKDKLSGSIDANRDFDGSATSQQQNSLRGEITVSVHAVQPNGILEIRGEKWLTLNQGDEYIRLSGLVRADDIQNDNSVSSQRIADARISYAGRGALSDANAAGWLTRLFNHPLFPI

SEQ ID NO: 6116 - protein, 119 aa, Escherichia coli
MDAVLSVQGASAPVKKKSFFSKFTRLNMLRLARAVIPAAVLMMFFPQLAMAAQGQDLMASGNTTVKATFGKDSSVVKWVVLAEVLVGAVMYMMTKNVKFLAGFAIISVFIAVGMAVVGL

SEQ ID NO: 6117 - protein, 72 aa, Escherichia coli
MTVNKIKNIFNNATLTTKSAFNTASSSVRSAGKKLILLIPDNYEAQGVGINELVKAADELGIEIHRTERDDT

SEQ ID NO: 6118 - protein, 267 aa, Escherichia coli
MMYNQEMRMHQFPLSSLMINVLICILICCTNAQAGVVVGGTRFVYPEKQSSISVELKNTASKDMLVKISVTPDDGRQLKGTLESQPLLPDKAFIATPPLLVLKQDKNTKIRINRVGGQLPIDRESLFILNIAVLPAQEQNSQLKNENQLQVAVRNRMKIFYRPETLSGNPLDAYQQLRWSRNNEAVTVFNPTPWYVTLYNLSIDGKSINGGMVAPFSHRQQDWCQRQGYCEINWQTLDLYNNALPVWSVKLNVLQNNAIMGAVAIHG

SEQ ID NO: 6119 - protein, 250 aa, Escherichia coli
MRWISKNKCFSNRNINSLLKTQYIIRAGALFLLSAISINAIAAGGFGLGSTRLVYPSDSQQITLSVQNGGANTSYLIQSWIDDNQSSKKSQDFVVTPPLFMLPTRKEASLRIMFIGKSQLPTDRETLFWMNVKAIPPTDEKNTQKNTLQLALQNRIKLFYRPTNLPVQAGKARDMLRFKYEGKQLRVINPSPYYLTVTGIRVQGAKLPNAFVPPKSDVTVSSPVTLAGEITYQTINDYGATTARQKGTMQ

SEQ ID NO: 6120 - protein, 512 aa, Escherichia coli
MKKISFFIFTALFCCSAQAAPSSLEKRLGKNEYFIITKSSPVRAILNDFAANYSIPVFISSSVNDDFSGEIKNEKPVKVLEKLSKLYHLTWYYDENILYIYKTNEISRSIITPTYLDIDSLLKYLSDTISVNKNSCNVRKITTFNSIEVRGVPECIKYITSLSESLDKEAQSKAKNKDVVKVFKLNYASATDITYKYRDQNVVVPGVVSILKTMASNGSLPSTGKGAVERSGNLFDNSVTISADPRLNAVVVKDREITMDIYQQLISELDIEQRQIEISVSIIDVDANDLQQLGVNWSGTLNAGQGTIAFNSSTAQANISSSVISNASNFMIRVNALQQNSKAKILSQPSIITLNNMQAILDKNVTFYTKVSGEKVASLESITSGTLLRVTPRILDDSSNSLTGKRRERVRLLLDIQDGNQSTNQSNAQDASSTLPEVQNSEMTTEATLSAGESLLLGGFIQDKESSSKDGIPLLSDIPVIGSLFSSTVKQKHSVVRLFLIKATPIKSASSE

SEQ ID NO: 6121 - protein, 89 aa, Escherichia coli
  MOD_RES (9)..(9): Any amino acid
  MOD_RES (30)..(30): Any amino acid
  MOD_RES (72)..(72): Any amino acid
  MOD_RES (81)..(81): Any amino acid
MKKMFMAVXFALVSVNAMAADCAKGKIEFXKYNEDDTFTVKVDGKEYWISRWNLQPLLQSAQLTGMTVTIKXSTCESGSGXAEVQFNND

SEQ ID NO: 6122 - protein, 89 aa, Escherichia coli
  MOD_RES (24)..(24): Any amino acid
  MOD_RES (66)..(66): Any amino acid
MKKMFMAVLFALASVNAMAADCAXGKIEFSKYNEDDTFTVKVDGKEYWTSRWNLQPLLQSAQLTGXTVTIKSSTCESGSGFAEVQFNND

SEQ ID NO: 6123 - protein, 89 aa, Escherichia coli
  MOD_RES (24)..(24): Any amino acid
  MOD_RES (30)..(30): Any amino acid
  MOD_RES (72)..(72): Any amino acid
  MOD_RES (81)..(81): Any amino acid
MKKMFMAVLFALVSVNAMAADCAXGKIEFXKYNEDDTFTVKVDGKEYWTSRWNLQPLLQSAQLTGMTVTIKXSTCESGSGXAEVQFNND

SEQ ID NO: 6124 - protein, 89 aa, Escherichia coli
  MOD_RES (25)..(25): Any amino acid
MKKMFMAVLFALVSVNAMAADCAKXKIEFSKYNEDDTFTVKVDGKEYWTSRWNLQPLLQSAQLTGMTVTIKSSTCESGSGFAEVQFNND

SEQ ID NO: 6125 - protein, 89 aa, Escherichia coli
  MOD_RES (24)..(24): Any amino acid
MKKMFMAVLFALVSVNAMAADCAXGKIEFSKYNEDDTFTVKVDGKEYWTSRWNLQPLLQSAQLTGMTVTIKSSTCESGSGFAEVQFNND

SEQ ID NO: 6126 - protein, 89 aa, Escherichia coli
  MOD_RES (24)..(24): Any amino acid
MKKMFMVVLFALVSVNAMAADCAXGKIEFSKYNENDTFTVKVAGKEYWTSRWNLQPLLQSAQLTGMTVTIKSSTCESGSGFAEVQFNND

SEQ ID NO: 6127 - protein, 89 aa, Escherichia coli
  MOD_RES (72)..(72): Any amino acid
MKKMFMAVLFALVSVNAMAADCAKGKIEFSKYNENDTFTVKVAGKEYWTSRWNLQPLLQSAQLTGMTVTIKXSTCESGSGFAEVQFNND

SEQ ID NO: 6128 - protein, 241 aa, Escherichia coli
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDKAAEKLRFRRSANSLTLINPTPYYLTVTELNAGTRVLENALVPPMGESTVKLPSDAGSNITYRTINDYGALTPKMTGVME

SEQ ID NO: 6129 - protein, 241 aa, Escherichia coli
MSNKNVNVRKSQEITFCLLAGILIFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGAFTPKMTGVME

SEQ ID NO: 6130 - protein, 241 aa, Escherichia coli
MSNKNVNVRKSQEITFCLLAGILIFMAMMVAGRAEAGVALGATRVIYPAGQKQVQLAVTNNDENSTYLIQSWVENADGVKDGRFIVTPPLFAMKGKRENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 6131 - protein, 241 aa, Escherichia coli
MSNKNVNVRKSQEITFCLLAGILIFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 6132 - protein, 241 aa, Escherichia coli
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLVIISRIKLYYRPAKLALPPDQAAEKLRFRRSANSLTLINPTPYYLTVTELNAGTRILENALVPPMGESTVKLPSDAGSNITYRTINDYGALTPKMTGVME

SEQ ID NO: 6133 - protein, 241 aa, Escherichia coli
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNHLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 6134 - protein, 241 aa, Escherichia coli
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 6135 - protein, 241 aa, Escherichia coli
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKRENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 6136 - protein, 241 aa, Escherichia coli
MSNKNVNVRKSQEITFCLLAGILMFMAMVVAGRAEAGVALGATRVIYPAGQKQVQLAVTNNDENSTYLIQSWVENADGVKDGRFIVTPPLFAMKGKRENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 6137 - protein, 241 aa, Escherichia coli
MSNKNVNVRKSQEITFCLLAGILMFMAMVVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 6138 - protein, 241 aa, Escherichia coli
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKRENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 6139 - protein, 241 aa, Escherichia coli
MSNKNVNVRKSQEITFCLLAGILMFMAMVVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESAVKLPSDAGSNITYRTINDYGALTPKMTGVME

SEQ ID NO: 6140 - protein, 241 aa, Escherichia coli
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESAVKLPSDAGSNITYRTINDYGALTPKMTGVME

SEQ ID NO: 6141 - protein, 241 aa, Escherichia coli
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRRANSLTLINPTPYYLTVTELNAGTRVLENALVPPMGESTVKLPSDAGSNITYRTINDYGALTPKMTGVME

SEQ ID NO: 6142 - protein, 241 aa, Escherichia coli
MSNKNVNVRKSQEIIFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 6143 - protein, 241 aa, Escherichia coli
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 6144 - protein, 878 aa, Escherichia coli
MSYLNLRLYQRNTQCLHIRKHRLAGFFVRLFVACAFTAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAQLDVGQQRLNLTIPQAFMSNRARGYIPPELWDPGINAGLLNYNFSGNSVQNRIGGNSHYAYLNLQSGLNIGAWRLRDNTSWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYALLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 6145 - protein, 243 aa, Escherichia coli
MSRKSCLIRLFKTTVSCKLFTAIILSVFLGQPALTYAGVVIGGTRVVYLSNNADKSISVFSKEEKIPYLIQAWVDPFNKEDKSKAPFTVIPPVSRLEPSQEKILRIIHTKGVSLPDDRESVFWLNIKNIPPSASNKATNSLEIAVKTRIKLFWRPANIRLIPEDAAPKVKWRREGRNLIAENPNPIHISVMDVIVDGHDVPLNMIRPFETLTLPLPANSAGGQMTWRFINDYGAVSDPIKMTL

SEQ ID NO: 6146 - protein, 505 aa, Escherichia coli
MYKKTTLAVLIALLTGATTVHAQTDISSIESRLAALEQRLKNAESRAQAAEARAKTAELQVQKLAETQQQNQLTTQEVAQRTVQLEQKSAENSGFEFHGYARSGLLMNDAGSSSKSGPYLTPAGETGGAVGRLGKEADTYVELNVEHKQTLDNGATTRFKAMLADGQRDYNDWTGGSSNLNIRQAFAELGALPSFTGAFQDSTVWAGKRFDRDNFDIHWLDSDVVFLAGTGGGIYDVKWNDTFRSNFSLYGRNFGDLDDIDNNVQNYILTMNHYAGPFQLMVSGLGAKDNDDRKDGNGDLIQTDAANTGVHALVGLHNDTFYGLREGTAKTALLYGHGLGAEVKGIGSDGALLSEANTWRFASYGTTPLGSGWYVAPAILAQSSKDRYVKGDSYEWVTFNTRLIKEVTQNFALAFEGSYQYMDLKPKGYQNHNAVNGSFYKLTFAPTLKANDINNFFSRPELRLFATWMDWSSKLDDFASNDAFGSSGFNTGGEWNFGVQMETWF

SEQ ID NO: 6147 - protein, 695 aa, Escherichia coli
MRITILASVVIPCLGFSASCMAAEDVMIVSASGYEKKLTNAAASVSVINQEELQSSQYHDLAEALRSVEGVDVESGTGKTGGLEVSIRGMPASYTLILIDGVRQGGSSDVTPNGFSAMNTGFMPPLAAIERIEVIRGPMSTLYGSDAMGGVVNIITKKNADKWHSSINAGLNQQESNKWGNSSQFNFWSSGPLVDDSVSLQIRGSTQQRQGSSVTSLSDTAATRIPYPTESQNYNLGARIDWKTTEQDMLWFDMDTTRQRYDNRDGQLGSLTGGYDHTLRYERNKISAGYDHAFTFGTWKSYLNWNETENKGRELVRSVLKSDKWGLAGKPRELKESNLILNSLLLTPLGESHLVTVGGEYQSSSMKDGVVLASTGETFRQKSWSVFAEDEWHLTDALALTAGSRYEHHEQFGGHLSPRAYLVWDVTDAWTLKGGVTTGYKAPSMGQLHKGISGVSGQGRTNLLGNPELKPEESVSYEAGVYYDNLAGLNANITGFITDFSNKIVSYSIDDNTNSYTNSGKARLHGVEFAGTLPLWSEDVTLSLNYTWTQSEQRDGDNKGAPLSYTPEHMVNAKLNWQITEEVASWLGARYRDKTPRFTQNYSSLSAVQKKVYDEKGEYLKAWTVVDAGMSWKVTDTLALNAAVNNVLNKDYSDVSLYRAGSSTLYAGDYFQTGASTTGYVIPERNYWMSLNYQF

SEQ ID NO: 6148 - protein, 725 aa, Escherichia coli
MISKKYTLWALNPLLLTMMAPAVAQRTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVSKKGQPETMKEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAVFLQSGYDINNLFTLNGGVRYQYTENKIDDFIGYAQQRQIAAGKAISADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATVYIGWAPDPWSLRVQSTTSFDVSDAQGYKVDGYTIVDLLGSYQLPVGTLSFSIENLFDRDYTTVWGQRAPLYYSPGYGPASLYGDKGRGPPLV

SEQ ID NO: 6149 - protein, 884 aa, Escherichia coli
MCMPNHSNFRLRGIACYIALAISGGSVNAWADDSIQFDPRFLELKGDTKIDLGKFSKKGYVDAGKYNLRVFINKQPLSDEYDINWYVSENDPTKNYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKNWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSADGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNADEHMMVFWEGSAQCEIVLPKPLPADLFSGLLLPCEQKGTAAPDSSAPEIKPVIQDQTRQVTPTEAPTSISATQ

SEQ ID NO: 6150 - protein, 250 aa, Escherichia coli
MSYKLSCPMLVSTALMALLTTASLTAHASVTPDRTRLVFNESDKSISVTLRNNNEKLPYLAQSWLEDEKGNKITSPLAVLPPVQRIDAMMNGQVKIQALPDIHTLPSDRESLFYYNVREIPPKSGKANTLQIALQTRIKLFWRPKALEKIDMRRPWQFKVTLTRSGQDYTVNNPTPYHVIISDASTQKKGLTAAGFKPLVMPPKTSQPLKAKMASAPVLTYINDYGARMPLIFRCEGNTCKVDEDQSSKG

SEQ ID NO: 6151 - protein, 696 aa, Escherichia coli
MRITTLASVVIPCLGFSASSIAAAEDVMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASAQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTVGSRYEHHEQFGGHFSPRAYLVWDVADAWTLKGGVTTGYKAPRMGQLHKGISGVSGQGKTNLLGNPDLKPEESVSYEAGVYYDNPAGLNANVTGFMTDFSNKIVSYSVNDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVNAGLSWKMTDALTLNAAVNNLLNKDYSDVSLYSAGKSTLYAGDYFQTGSSTTGYVIPERNYWMSLNYQF

SEQ ID NO: 6152 - protein, 733 aa, Escherichia coli
MMISKKYTLWALNPLLLTMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAAFLQSDYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTVDLLGSYQLPVGTLSFSIENLFDRDYTTVWGQRAPLYYSPGYGPASLYDYKGRGRTFGLNYSVLF

SEQ ID NO: 6153 - protein, 876 aa, Escherichia coli
MFFGDGGQLLSDKSLTGSAGGGNNRMKFNILPLAFFIGIIVSPARAELYFNPRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQLYMSNQARGYIAPEYWDNGITAALLNYDFSGNRVRDSYGGTSDYAYLNLKTGLNIGSWRLRDNTSWSYSAGKGYSQNNWQHINTWLERDIVSLRSRLTMGDSYTRGDIFDGVNFRGIQLASDDNMVPDSQRGYAPTIHGISRGTSRISIRQNGYEIYQSTLPPGPFEINDIYPAGSGGDLQVTLQEADGSVQRFNVPWSSVPVLQREGHLKYALSAGEFRSGGHQQDNPRFAEGTLKYGLPAGWTVYGGAWIAERYRAFNLGVGKNMGWLGAVSLDATRANARLPDESRHDGQSYRFLYNKSLTETGTNIQLIGYRYSTRGYFSFADTAWKKMSGYSVLTQDGVIQIQPKYTDYYNLAYNKRGRVQVSISQQTGESSTLYLSGSHQSYWGTDRTDRQLNAGFNSSVNDISWSLNYSLSRNAWQHETDRILSFDVSIPFSHWMRSDSTSAWRNASARYSQTLEAHGQAASTAGLYGTLLGDNNLGYSIQSGYTRGGYEGSSKTGYASLNYRGGYGNASAGYSHSGGYRQLYYGLSGGILAHANGLTLSQPLGDTLILVRAPGASDTRIENQTGVSTDWRGYAVLPYATDYRENRVALDTNTLADNVDIENTVVSVVPTHGAVVRADYKTRVGVKVLMTLMRNGKAVPFGSVVTARNGGSSIAGENGQVYLSGMPLSGQVSVKWGSQTTDQCTADYKLPKESAGQILSHVTASCR

SEQ ID NO: 6154 - protein, 231 aa, Escherichia coli
MMKHMRIWAVLASFLVFFYIPQSYAGVALGATRVIYPEGQKQVQLAVTNNDDKSSYLIQSWIENAEGKKDARFVITPPLFSMQGKKENTLRIIDATNGQMPEDRESLFWVNVKAIPAMDKAKTGENYLQFAIVSRIKLLYRPQGLVIPPEQAPGKLEFTRENGGLTLFNPTPYYLTVTDLKAGNKSLENTMVPPQGKVTVNIPGGYTGGDITYKTINDYGALTEQVKGVVK

SEQ ID NO: 6155 - protein, 732 aa, Escherichia coli
MMISKKYTLWALNPLLLTMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQIPWGLDADHERFTSNQMFFDLAQASASGGLNNKKIYTTGRYPSYDITNLAAFLQSGYDINNLFTLNGGVRYQYTENKIDDFIGYAQQRQIAAGKATSADALWRLSRLRHFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTVDLLGSYQLPVGTLSFSIENLFDRDYTTVWGQRAPLYYSPGYGPASLYDYKGRGRTFGLNYSVLF

SEQ ID NO: 6156 - protein, 308 aa, Escherichia coli
GLLEAQPKEFTQQVFDPQKGTIDLSTGNVSSVLTFITPTFTPGEEVRERKQSGKYEYMTSLIVNGKDTWSVKGIKNHKGVYDYSKLIQFVEKNNKHYQARIISELGDKDDVVYSGAGSSEVFAGEGYDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDK

SEQ ID NO: 6157 - protein, 505 aa, Escherichia coli
MYRKSTLAMLIALLTSAASAHAQTDISTIEARLNALEKRLQEAENRAQTAENRAGAAEKKVQQLTAQQQKNQNSTQEVAQRTARLEKKADDKSGFEFHGYARSGVIMNDSGASTKSGAYITPAGETGGAIGRLGNQADTYVEMNLEHKQTLDNGATTRFKVMVADGQTSYNDWTASTSDLNVRQAFVELGNLPTFAGPFKGSTLWAGKRFDRDNFDIHWIDSDVVFLAGTGGGIYDVKWNDGLRSNFSLYGRNFGDIDDSSNSVQNYILTMNHFAGPLQMMVSGLRAKDNDERKDSNGNLVKGDAANTGVHALLGLHNDSFYGLRDGSSKTALLYGHGLGAEVKGIGSDGALRPGADTWRIASYGTTPLSENWSVAPAMLAQRSKDRYADGDSYQWATFNLRLIQAINQNFALAYEGSYQYMDLKPEGYNDRQAVNGSFYKLTFAPTFKVGSIGDFFSRPEIRFYTSWMDWSKKLNNYASDDALGSDGFNSGGEWSFGVQMETWF

SEQ ID NO: 6158 - protein, 265 aa, Escherichia coli
MKMRAVAVFTGMLTGVLSVAGLLSAGAYAAGGEGNMSASATETNARVFSLHLGATRVVYNPASSGETLTVINDQDYPMLVQSEVLSEDQKSPAPFVVTPPLFRLDGQQSSRLRIVRTGGEFPPDRESLQWICVKGIPPKEGDRWAEGKDGEKKADKVSLNVQLSVSSCIKLFVRPPAVKGRPDDVAGKVEWQRAGNRLKGVNPTPFYINLSTLTVGGKEVKEREYIAPFSSREYPLPAGASGKVQWKVITDYGGTSKQFEAELKG

SEQ ID NO: 6159 - protein, 119 aa, Escherichia coli; identical to SEQ ID NO: 5985

SEQ ID NO: 6160 - protein, 867 aa, Escherichia coli
MFSGDGGQLLSDKSLTGSAGGGNNRMKFNILPLAFFIGIIVSPARAELYFNPRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQLYMINQARGYIAPEYWDNGITAALLNYDFSGNRVRDSYGGTSDYAYLNLKTGLNIGSWRLRDNTSWSYSAGKGYSQNNWQHINTWLERDIVPLRSRLTMGDSYTRGGYFCRCKFQGIQLASDDNMVPDSQRGYAPTIHGISRGTSRISIRQNGYEIYQSTVPPGPFEINDIYPAGSGGELQVTLQEADGSVQRFNVPWFSVPVLQREGHLKYAFSAGEFRSGGHQQDNPRFAEGTLNYGLPAGWTVYGGPWIAERYRAFNLGMGKNMGWLGAVSLDATRANARLPDESRHDGHSYRFLYNKSLTETGTNIHLIGYRYSTRGYFSFADTAWKKMSGYSVLTQDGVIQIQPKYTDYYNLAYNKRGRVQVSITQQKGESSTLYLSGSHQSYWGTDRTDRQLNAGFNSSVNDISWSLNYSLSRNAWQHETDRILSFDVSIPFSHWMRSDSTSAWRNASAPYSQTLEAYGQAASTAGLYGTSLGDNNLGYTIQSGYTRGGYEGSSKTGYASLNYRGGYGNASAGYSHSGGYRQLYYGLSGGILAHANGLTLSQPLGDTLILVRAPGASDTRIENQTGVSTDWRGYAVLPYATDYRENRVALDTNTLADNVDIENTVVSVVPTHGAVVRADYKTRVGVKVLMTLMRNGKAVPFGSVVTARNGGSSIAGENGQVYLSGMPLSGQVSVKWGSQTTDQCTADYKLPKKAPDRY

SEQ ID NO: 6161 - protein, 61 aa, Escherichia coli
VLSFSPFAQDAKPAGSSKEKITLESKKCNIVKKNNESSPESMNGSNYCCELCCNPACTGCY

SEQ ID NO: 6162 - protein, 61 aa, Escherichia coli
VLSFSPFAQDAKPVESSKEKITLESKKCNIAKKSNKSDPESMNSSNYCCELCCNPACTGCY

SEQ ID NO: 6163 - protein, 61 aa, Escherichia coli
LYYLPSFSQKAESVDSSKEKITLDTKKCNVVKNNSEKKSENMNNTFYCCELCCNPACAPCY

SEQ ID NO: 6164 - protein, 99 aa, Escherichia coli
GAPQSITELCSEYRNTQIYTINDKILSYTESMAGKREMVIITFKSGATFQVEVPGSQHIDSQKKAIERMKDTLRIAYLTETKIDKLCVWNNKTPNSIAA

SEQ ID NO: 6165 - protein, 616 aa, Escherichia coli
MGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 6166 - protein, 856 aa, Escherichia coli
MLKRVGCALQSVFVLNRLHIMKKNKSTFTINFITYSLMLSLAGVPVYAVDFNTDVLDAADRQNIDFSRFSRAGYIMPGQYQMEIRVNGQDISPSAFQIAFLEPPFSDSDNEKPLPEPCLTPEIVSRMGLTEASQEKVTYWNNGQCADFRQLSGVEIRPNPAEGMLYINMPQAWLEYSDASWLPPSRWDNGIPGLLFDYNINGTVNKPHQGKQSQSLNYNGTAGANFGAWRLRADYQGNLNHTTGSAQGTDSQFTWSRFYMYRAIPRWRANLTLGENYINSEIFSSWRYTGASLESDDRMLPPKLRGYAPQVSGIADTNARVVISQQGRILYDSTVPAGPFTIQDLDSSVRGRLDVEVIEQDGRKKTFQVDTAYVPYLTRPGQVRYKLVSGRSRTYEHTMEGPVFAAGEASWGISNTWSLYGGSIVAGDYNALAVGLGRDLSKFGTVSADVTQSVARIPGYDTKQGKSWRLSYSKRFDEVNTDITFAGYRFSERNYMTMDQYLNARYRNDFTGREKELYTVTLNKNFEDWKASVNLQYSHQTYWDRRTSDYYTLSVNRYFDAFSFKNIALGISASRSKYLNRDNDSAFVRLSVPWGTGTASYSGSMSNDRYTNTVGYSDTLNNGLSSYSLNAGVNSGGGQPSQRQMSAYYNHNGSLTNLSASFSAVENGYSSFGMSASGGATVTMKGAALHAGGMNGGTRLLVDTDGVGGVPVDGGRVYTNRWGIGVVTDVSSYYRNTTSVDLNKLPEDMEATRSVVESVLTEGAIGYREFEVLKGSRLFAVLRMSDNSYPPFGASVTNAKGRELGMVADSGLAWLSGVNPGETLNVGWDGRTQCVVDIPAHPDPAQQLLLPCRQVK

SEQ ID NO: 6167 - protein, 243 aa, Escherichia coli
MQKMKPALKKTLMAVACLSAVPAAQAAVSLDRTRAIFNGDEKSMTLNIANDNKQLPYLAQAWVENEKKEKITTGPIIATPPVQRLEPGSKSMVRLTSTPDISRLPQDRESLFYFSLREIPPKSDKANVLQIALQTKIKLFYRPESIKAKPNAVWQDQLVLNKTSGGYRIDNPTPYYVTVIGIGGSEKQAREGEFDAVMLAPKSTQMVKSGTYNTPYLSYINDYGGRPVLQFSCGGSRCTAVKK

SEQ ID NO: 6168 - protein, 72 aa, Escherichia coli; identical to SEQ ID NO: 5952

SEQ ID NO: 6169 - protein, 53 aa, Escherichia coli
KYNDDDTFTVKVGDKELFTNRWNLQSLLLSAQITGMTVTIKTNACHNGGGFSE

SEQ ID NO: 6170 - protein, 673 aa, Escherichia coli
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 6171 - protein, 42 aa, Escherichia coli
EYWTNRWNLQPLLQSAQLTGMTVTIKSNTCASGSGFAEVQFN

SEQ ID NO: 6172 - protein, 43 aa, Escherichia coli
KEYWTNRWNLQPLLQSAQLTGMTVTIKSNTCASGSGFAEVQFN

SEQ ID NO: 6173 - protein, 758 aa, Escherichia coli
SFILGNSDAHTGTKAAAGIELTTQVLGNVGKAVSQYILAQRMAQGLSTTAASAGLITSAVMLAISPLSFLAAADKFERAKQLESYSERFKKLNYEGDALLAAFHKETGAIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQSGKYEYMTSLIVNGKDTWSVKGIKNHKGVYDYSKLIQFVEKNNKHYQARIISELGDKDDVVYSGAGSSEVFAGEGYDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYGQNYGHHTIADEGGKGDRLHLSDISFDDIAFKRVGNDLIMNKAINGVLSFNESNDVNGITFKNWFAKDASGADNHLVEVITDKDGREIKVDKIPHNNNERSGYIKASNIASEKNMVNITSVANDINKIISSVSGFDSGDERLASLYNLSLHQNNTHSTTLTTTV

SEQ ID NO: 6174 - protein, 239 aa, Escherichia coli; identical to SEQ ID NO: 5991

SEQ ID NO: 6175 - protein, 121 aa, Escherichia coli
MNAVLSVQGASAPVKKKSFFSKFTRLNMLRLARAVIPAAVLMMFFPQLAMAAGSSGQDLMASGNTTVKATFGKDSSVVKWVVLAEVLVGAVMYMMTKNVKFLAGFAIISVFIAVGMAVVGL

SEQ ID NO: 6176 - protein, 247 aa, Escherichia coli; identical to SEQ ID NO: 6023

SEQ ID NO: 6177 - protein, 89 aa, Escherichia coli
MKKMFMAVLFALVSVNAMAADCAKGKIEFSKYNEDDTFTVKVDGKEYWTSRWNLQPLLQSAQLTGMTVTIKSSTCESGSGFAEVQFNND

SEQ ID NO: 6178 - protein, 656 aa, Escherichia coli
MYMNVIRTVICTLIILPVGLQAATSHSSMVKDTITIVATGNQNTVFETPSMVSVVTNDTPWSQNAVTSAGMLKGVAGLSQTGAGRTNGQTFNLRGYDKSGVLVLVDGVRQLSDMAKSSGTYLDPALVKRIEVVRGPNSSLYGSGGLGGVVDFRTADAADFLPPGETNGLSLWGNIASGDHSTGSGLTWFGKTGKTDALLSVIMRKRGNIYQSDGEHAPNKEKPAALFAKGSVGITDSNKAGASLRLYRNNTTEPGNSTQTHGDSGLRDRKTVQNDVQFWYQYAPVDNSLINVKSTLYLSDITIKTNGHNKTAEWRNNRTSGVNVVNRSHTLIFPGAHQLSYGAEYYRQQQKPEGSATLYPEGNIDFTSLYFQDEMTMKSYPVNIIVGSRYDRYKSFNPRAGELKAERLSPRAAISVSPTDWLMMYGSISSAFRAPTMAEMYRDDVHFYRKGKPNYWVPNLNLKPENNITREIGAGIQLDGLLTDNDRLQLKGGYFGTDARNYIATRVDMKRMRSYSYNVSRARIWGWDMQGNYQSDYVDWMLSYNRTESMDASSREWLGSGNPDTLISDISIPVGHRGVYAGWRAELSASATHVKKGDPHQAGYTIHSFSLSYKPVSVKGFEASVTLDNAFNKLAMNGKGVPLSGRTVSLYTRYQW

SEQ ID NO: 6179 - protein, 242 aa, Escherichia coli
MQKMKPALKKTLMAVVSERTPAAQAAVSLDRTRAIFNGDEKSMTLNIANDNKQLPYLAQAWVENEKKEKITTGPIIATPPVQRLEPGSKSMVRLTSTPDISRLPQDRESLFYFSLREIPPKSDKANVLQIALQTKIKLFYRPESIKAKPNAVWQDQLVLNKTSGGYRIDNPTPYYVTVIGIGGSEKQAREGEFDAVMLAPKSTQMVKSGTYNTPYLSYINDYGGRPVLQFSCGGSRCTAVKK

SEQ ID NO: 6180 - protein, 855 aa, Escherichia coli
MLKRVSCAPQSVFVLNRLHIMKKNKSTFTINFITNYLMLSLAGVPVYAVDFNTDVLDAADRQNIDFSRFSRAGYIMPGQYQMEIRVNGQDISPSAFQIAFLEPPFSDSDNEKPLPEPCLTPEIVSRMGLTEASQEKLRTWNNGQCAIRQLSGVEIRPESGRRMLYINMPQAWLEYSDASRRAAVRWDNGIPGLLFDYNINGTVNKPHQGKQSQSLNYNGTAGANFGAWRLRADYQGNLNHTTGSAQGTDSQFTWSRFYMYRAIRWRANLTLGENYINSEIFSSWRYTGASLESNDRMLPPKLRGYAPQVSGIADTNARVVISQQGRILYDSTVPAGPFTIQDLDSSVRGRLDVEVIEQDGRKKTFQVDTAYVPYLTRPGQVRYKLVSGRSRNYEHSMEGPVFAAGEASWGISNTWSLYGGSIVAGDYNALAVGLGRDLSEFGTVSADVTQSVARIPGYDTKQGKSWRLSYSKRFDEVNTDITFAGYLSPERNYMTMDQYLNARYRNSNFTGREKELYTVTLNKNFEDWKASVNLQYSHQTYWDRRTSDYYTLSVNRYFDAFSFKNIALGISASRSKYQNRDNDSAFVRLSVPWGTGTASYSGSMSNDRYTNTVGYSDTLNNGLSSYSLNAGVNSGGGQPSQRQMSAYYNHNGSLTNLSASFSAVENGYSSFGMSASGGATVTMKGAALHAGGMNGGTRLLVDTDGVGGVPVDGGRVYTNRWGIGVVTDVSSYYRNTTSVDLNKLPEDMEATRSVVESVLTEGAIGYREFEVLKGSRLFAVLRMSDNSYPPFGASVTNAKGRELGMVADSGLAWLSGVNPGETLNVGWDGRTQCVVDIPAHPDPAQQLLLPCRQVK

SEQ ID NO: 6181 - protein, 89 aa, Escherichia coli
MKKVLLIAVSLSFLSASVLAAPDCVTGKVEYTKYNDDDTFTVKVADKELFTNRWNLQSLLLSAQITGMTVTIKTTACHNGGGFSEVIFR

SEQ ID NO: 6182 - protein, 835 aa, Escherichia coli
MSKHHLILAPLILGIGTNVDARDYFDPSLLASDVAGGGDIDLSAFAIPGGGMEGEQEVGIYINNDFYSRATLNFKNTDERGLLPDFPADFFDDILYEEYLVFDKTQVIPSSDFLAKVPFSEVTFDQALSRVNVSIPQAYIDEGAKLVSSPDTWDYGVPALLFDYNISGNRNKYNDSNSESFYASSLVGVNLWGWRLRTSANYNQYTTESVWGKTRSETNSFFNTYIERDISSLRAGLRIGEASTGGIILDSIPFRGIKLYSDDDMLGYRLRNYSPTVRGIARSQAVVTISQNGRQVYQTNVPPGPFQLNDFYISGYSGDMVVTVREADGSEHSFVQPYSTLPEMKREGVSGFELSVGKYDNYGSDDYYDQPSFVYGNWSRGFSYGITTFGETLQAEKYQSLGLGSTVSLGALGAASADVSVSRAEKYGDVKTGQSYGFKYSKSQLETGTTLTLATYRYSTKNFYTFSDFASNSEEARFVWENKLKNRMTLSVSQALGAYGHLSLSANQQSYWTSSEVTRNYSLSHSFSWEDIFFSTTFSLDQSHNRYNDYAENKQIDFYVSVPLSKFLGDKDITSSSLTYNVTNSDHRVRNSAALNGNIPETDFRYRVGGSWGNNNLNSTKTASLSWTGSYTSASLGYTYSHNNNTLDYSLSGAAVAYPWGLALGNNNVTNSGAIVVETSGAPGVRTSAGYSTSFLGTALIGSPQKYTENRIDLYPDGLPDDTVLAETSKVAVPAKGAVVVLDYKVFKGSQVVFSLKQESGKPLPFGTIVSLDGMPKGKENTGIVGEDGQVYMAGVPSKGSLKAVWGGNTCGIKFHLDDKKTVGPIRETTEVCKA

SEQ ID NO: 6183 - protein, 230 aa, Escherichia coli
MFKKSILLFFISSSAIAGAFGPRESKLIFESDKAYIQYRIDNTGKDMPWLVQAWVEDSKEKKTKEFTPTPLVFRVEPSSVFSVRVMKTGSPDEHKETLYWIVSNSLPGGDKTELKSHDDKITAKMNLAYRFKVPMFYRPISLKNIPQQPENLEWSVDGKGKVKVKNSSRYIVQLQSINIHNSLHQGKGVSYFINPMSDVALNVSAKSGTKIHYSVINDYGAVKEYEGVIK

SEQ ID NO: 6184 - protein, 843 aa, Escherichia coli
MHWMHLPLYHYRAHFSFSLLALTIASSLPAYGGKFNPKFLENVQGIDQHIDLSVYDSPVGQQIPGKYRVSVFVNEEKMASRTLDFSTASEAKRKASGESLMPCLSRVQLEEMGVRVDSFPALKMSPPEACVAFDEIIPQATSRFDFNTQTLHLSFPQAAMMMTARGTVDPSRWDEGIPALLLDYSFSGSNGRNEGTGSSSDSTSDSYYPNLRSGLNVGPWRLRNNSIWNRTDGKNQWDNVGTSLNRAIIPLKSQITLGDTATPGEIFDSVQMRGALLASDDEMLPDSQRGFAPVVRGIAKSNAEVSIEQNGYVIYRTFVQPGAFEINDLYATSGSGDLTVIIKEADGSEQRFIQPFSAVAIFQREGYLKYSLAAGEYRAGNYDSDKPHFGQFTAMYGLPWGMTAYGGALLSADYNALALGLGKNFGTIGAVSVDVTQAKSQLRNNEKEEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSVAYTWTRSPEWEEDDRLWSFSVSIPLGGAWSSYRMTTDQNGKTSQQASVSGTLLEDRNLSYNVQQGYTSNGVGYSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNVELQEAFQKVVPTRGAVVRSRFDTRVGYRVLMSLKQANGNAVPFGATAALIDESKPASSIVGEEGQLYISGMPEEGELQVSWGNEQAQRCRVPFRLPENKDNAAIVMVNAVCEK

SEQ ID NO: 6185 - protein, 228 aa, Escherichia coli
MKRISFAVLALLMTAQQCFAGGVALSTTRVIYDGGKKEASLTVENHNKNEEFLIQSWIDDVNGNKKTPFIITPPLFKLDPDKNNVLRIVNIEDTLPKDRESVYWINVKAIPAKSAENENKNVLQIAVRTRLKLFYRPKGLPGSNLEAMKQLRFQRQNNQIVVNNDSAYNLTFNQFSINGQKIERAGMVLAKGKLNINLPAGTGNAHEVKYSIINDFGVAGEMLTKPIN

SEQ ID NO: 6186 - protein, 159 aa, Escherichia coli
ILKWQNGGKALVDGIEASMSFPLVKDRLNWNTNATWMITSEQKDTGNPLSVIPKYTINNSLNWTITQAFSASVNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 6187 - protein, 85 aa, Escherichia coli
LLIAASLSFFSASALATPDCVTGKVEYTKYNDDDTFTVKVGDKELFTNRWNLQSLLLSAQITGMTVTIKTNACHNGGGFSEVIFR

SEQ ID NO: 6188 - protein, 1024 aa, Escherichia coli
  MOD_RES (59)..(59): Any amino acid
MPTITTAQIKSTLQSAKQSAANKLHSAGQSTKDALKKAAEQTRNAGNRLILLIPKDYKXQGSSLNDLVRTADELGIEVQYDEKNGTAITKQVFGTAEKLIGLTERGVTIFAPQLDKLLQKYQKAGNKLGGSAENIGDNLGKAGSVLSTFQNFLGTALSSMKIDELIKKQKSGGNVSSSELAKASIELINQLVDTAASLNNNVNSFSQQLNKLGSVLSNTKHLNGVGNKLQNLPNLDNIGAGLDTVSGILSAISASFILSNADADTGTKAAAGVELTTKVLGNVGKGISQYIIAQRAAQGLSTSAAAAGLIASVVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFEILSQYNKEYSVERSVLITQQHWDTLIGELAGVTRNGDKTLSGKSYIDYYEEGKRLEKEPDEFQKQVFDPLKGNIDLSVIKSSTLLKFITPLLTPGKEIRERRQSGKYEYITELLVKGVDKWTVKGVQDKGSVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGTDLTETDNLYSVEELIGTNRADKFFGSKFTDIFHGADGDDHIEGNDGNDRLYGDKGNDTLRGGNGDDQLYGGDGNDKLTGGVGNNYLNGGDGDDELQVQGNSLAKNVLSGGKGNDKLYGSEGADLLDGGEGNDLLKGGYGNDIYRYLSGYGHHIIDDDGGKDDKLSLADIDFRDVAFKREGNDLIMYKAEGNVLSIGHKNGITFRNWFEKESGDISNHQIEQIFDKDGRVITPDSLKKAFEYQQSNNQANYVYGEYASTYADLDNLNPLINEISKIISAAGNFDVKEERSAASLLQLSGNASDFSYGRNSITLTASA

SEQ ID NO: 6189 - protein, 836 aa, Escherichia coli
MKDRIPFAVNNITCVILLSLFCNAASAVEFNTDVLDAADKKNIDFTRFSEAGYVLPGQYLLDVIVNGQSISPASLQISFVEPQSSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 6190 - protein, 1024 aa, Escherichia coli
MPTITTAQIKSTLQSAKQSAANKLHSAGQSTKDALKKAAEQNRNAGNRLILLIPKDYKGQGSSLNDLVRTADELGIEVQYDEKNGTAITKQVFGTAEKLIGLTERGVTIFAPQLDKLLQKYQKAGNKLGGSAENIGDNLGKAGSVLSTFQNFLGTALSSMKIDELIKKQKSGSNVSSSELAKASIELINQLVDTAASINNNVNSFSQQLNKLGSVLSNTKHLNGVGNKLQNLPNLDNIGAGLDTVSGILSVISASFILSNADADTGTKAAAGVELTTKVLGNVGKGISQYIIAQRAAQGLSTSAAAAGLIASAVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGSVYDYSNLIQHASVGNNQYREIRIESHLGDGDDKVFLAAGSANIYAGKGHDVVYYDKTDTGYLTIDGTKATEAGNYTVTRVLGGDVKVLQEVVKEQEVSVGKRTEKTQYRSYEFTHINGTDLTETDNLYSVEELIGTNRADKFFGSKFTDIFHGADGDDHIEGNDGNDRLYGDKGNDTLRGGNGDDQLYGGDGNDKLTGGVGNNYLNGGDGDDELQVQGNSLAKNVLSGGKGNDKLYGSEGADLLDGGEGNDLLKGGYGNDIYRYLSGYGHHIIDDDGGKDDKLSLADIDFRDVAFKREGNDLIMYKAEGNVLSIGHKNGITFRNWFEKESGDISNHQIEQIFDKDGRVITPDSLKKAFEYQQSNNQANYVYGEYASTYADLDNLNPLINEISKIISAAGNFDVKEERSAASLLQLSGNASDFSYGRNSITLTASA

SEQ ID NO: 6191 - protein, 835 aa, Escherichia coli
MNKYYLLIILFFVRSTKVFAEDYFDPSLLATDIIGEGNIDLSAFSRPGGGMEGEQEVAIYVNDEFYSRNTLFFKNTLDKGLLPEFTPGFFDELLSGDFLVSEEDKTISSSDFLKKVPYSDINFNQGMSRVNVSIPQAYLGDGAKLISSPDTWEYGGPAFLLDYNISGNRNDSGNYDSRSLYISSQMGVNLMKWRLRTSSSYSNYKTNSVWGGARSEQNSFYNTYAERDISSLRAILRLGEVSTAGLILDSVPFRGMKLSSSDDMLGMRLRNYTPTVRGMASSQAVVTITQNGRQVYQTNVPAGPFELNDFYLSGYSGDMLVTVREADGSEHSFLQPYSTLPEMKREGVSGFEVSVGRYDNNGAEHYYDAESFVYGNWSRGFARGVTFFAETLQAEKYQSLGGGSTLSLGRLGAASADISLSRADKYGDIRIGQSYGFKYSKSQIETGTTVTLATYRYSTENFYTFRDFVSKTDTARYIWENKLKSRMTFSLSQSLGEYGYLSANASQQDYWNSREVSRNYSLTHSFSWNDIYFSTTLSMDDQRGRETGHLSNKQAGIYASVPLSKLLPRTDPTSSSLTWSTSHADHKVRNSVTLDGKVPESDVRYRVGGSWGNGTTEGSRMASVSWTGDHASTSLGYTRVGKYRTLDYSMSGAAVMYPWGIAVGNSSVTGDGAIVVETPGAKGVRTSTGYKTSWLGTALISSPQKYTENRINLYPDGLPSDTVLGETSKTAVPAKGAVVVLDYTVFRGSQVVFTLRQTDGNPLPFGTVITLDGVSRGKENSGIVGEEGRVYMAGIPEKGTLTASWGLNKTCSIPFRINQHKAEAVIREVQGVCRV

SEQ ID NO: 6192 - protein, 233 aa, Escherichia coli
MRYQYSVLFVFLFSGVVQAAEFFGPRESRLLFEEKKGNTFYRIDNSDKKLPWLVQAWIEDASEKKTTALTATPMVFRVEPSSVFTVRVVKTGALPEDRETLFWAVSNSLPGGASTKQDNEEGKISAKISLAYRFKVPLIYRPAALDNFRQEPEKLEWTYNGKEGLKLYNPTRYVVQLHNVTANGREFKGKGVSFILLPMSGKNVSAAVNKGTRIKYGVINDYGAVKEYDGVVK

SEQ ID NO: 6193 - protein, 241 aa, Escherichia coli
MLRFVLFFFTLSVSAVVQGSVVIMGTRVVYPATQKSISIRLNNDNESPALVQSWLDDGDAAAPPESVHVPFIITPPIFRMDSKSGQTVRIVYTGESLPKDRESLFYLNVLDIPAKPGAKKDSDNSEQRNNNYLQLAIRSRIKFFFRPAHLKLTPNDAYLKVTWHQEEGRIKAVNPTPYYITYNKIAVDQNKHLMPVEHGGMIPPFSSTVFALKGRTAPASKVSWVIVNDYGGYQQGESVLE

SEQ ID NO: 6194 - protein, 861 aa, Escherichia coli
MITEDISKENLFWSKVIMNANNLSCLIYCRCSLLLFAALGLTVTNHSFAAEEAEFDSEFLHLDKGINAIDIRRFSHGNPVPEGRYYSDIYVNNVWKGKADLQYLRTANTGAPTLCLTPELLSLIDLVKDTMSGNTSCFPASTGLSSASINFDLSTLRLNIEIPQALLNTRPRGYISPSQWQSGVPAAFINYDANYYQYSSSGTSNEQTYLGLKAGFNLWGWALRHRGSESWNNSYPAGYQNIETSIMHDLAPLRAQFTLGDFYTNGELMDSLSLRGVRLASDERMLPGSLRGYAPAVRGIANSNAKVTIYQNAHILYETTVPAGPFVINDLYPSGYAGDLIVKITESNGQTRMFTVPFAAVAQLIRPGFSRWQMSVGKYRYANKTYNDLIAQGTYQYGLTNDITLNSGLTTASGYTAGLAGLAFNTPLGAIASDITLSRTAFRYSGVTRKGYSLHSSYSINIPASNTNITLAAYRYSSKDFYHLKDALSANHNAFIDDVSVKSTAFYRPRNQFQISINQELGEKWGGMYLTGTTYNYWGHKGSRNEYQMGYSNFWKQLGYQIGLSQSRDNEQQRRDDRFYINFTLPLGESVQSPVFSTVLNYSKEEKNSIQTSISGTGGEDNQFSYGLSGNSQENGPSGYAMNGGYRSPYVNITTTVGHDTQNNNQRSFGASGAVVAHPYGVTLSNDLSDTFAIIHAEGAQGAAINNASGSRLDFWGNGIVPYVTPYEKNQISIDPSNLDLNVELSATEQEIIPRANSATLVKFDTKTGRSLLFDIRMSTGNPPPMASEVLDEHGQLAGYVAQAGKVFTRGLPEKGHLSVVWGPDNKDRCSFVYHVAHNKDDMQSQLVPVLCIQHPNQEKT

SEQ ID NO: 6195 - protein, 125 aa, Escherichia coli
MINKFYRTVLYSLFVFPLYAKATPQNITDLCNEYQNTMIYSLNKEIATYTESLAGKREMVIISFSNGATFQVEVPGSQHLESQKRPLERMKDTLRAAYFTGIKISKLCAWTNKSPNSIAAIELSN

SEQ ID NO: 6196 - protein, 89 aa, Escherichia coli
MKKMFMAVLFALVSVNAMAADCAKGKIEFSKYNENDTFTVKVDGKEYWTSRWNLQPLLQSAQLTGMTVTIKSSTCASGSGFAEVQFNND

SEQ ID NO: 6197 - protein, 725 aa, Escherichia coli
MRINKILWSLTVLLVGLNSQVSVAKSSDDDNDETLVVEATAEQVLKQQPGVSVITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPTNDWHGSLSLYTNQPESSDEGATRRANFSLSGPLAGNALTTRLYGNLNKTDADSWDINSPVGTKNAAGHEGVRNKDINGVVSWKLNPQQILDFEAGYSRQGNIYAGDTQNSSSSAVTESLAKSGKETNRLYRQNYGITHNGIWDWGQSRFGVYYEKTNNTRMNEGLSGGGEGRILAGEKFTTNRLSSWRTSGELNIPLNVMVDQTLTVGAEWNRDKLDDPSSTSLTVNDSDISGISGSAADRSSKNHSQISALYIEDNIEPVPGTNIIPGLRFDYLSDSGGNFSPSLNLSQELGDYFKVKAGVARTFKAPNLYQSSEGYLLYSKGNGCPKDITSGGCYLIGNKDLDPEISVNKEIGLEFTWEDYHASVTYFRNDYQNKIVAGDNVIGQTASGAYILKWQNGGKALVDGIEASMSFPLVKDRLNWNTNATWMITSEQKDTGNPLSVIPKYTINNSLNWTITQAFSASVNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 6198 - protein, 84 aa, Escherichia coli
MKKMFMAVLFALVSVNAMAADCAKGKIEFSKYNENDTFTVKVAGKEYWTSRWNLQPLLQSAQLTGMTVTIKSSTCESGSGFAEV

SEQ ID NO: 6199 - protein, 580 aa, Escherichia coli
MHIGSTTTTGLPLAKILASTELLDNTIQAANDAANKLFSLTIADLTANKNINTTNAHSTSNILIPELKAPKSLNASSQLTLLIGNLIQILGEKSLTALTNKITAWKSQQQARQQKNLEFSDKINTLLSETEGLTRDYEKQINKLKNADSKIKDLENKINQIQTRLSELDPDSPENKKLRREEIQLTIKKDAAVKDRTLIEQKTLSIHSKLTDKSMQLEKEIDSFSAFSNTASAEQLSTQQKSLTGLASVTQLMATFIQLVGKNNEESLKNDLALFQSLQESRKTEMERKSDEYAAEVRKAEELNRVMGCVGKILGALLTIVSVVAAAFSGGASLALAAVGLALMVTDAIVQAATGNSFMEQALNPIMKAVIEPLIKLLSDAFTKMLEGLGVDSKKAKMIGSILGAIAGALVLVAAVVLVATVGKQAAAKLAENIGKIIGKTLTDLIPKFLKNFSSQLDDLITNAVARLNKFLGAAGDEVISKQIISTHLNQAVLLGESVNSATQAGGNVASAVFQNNASKNLADLTLSKYQVEQLSKYIGDAIEKFGQLQGVIAELLASMSNSQANRTDVAKAILQQTTA

SEQ ID NO: 6200 - protein, 580 aa, Escherichia coli
AYNVSTTTTGLSLAKILASTELGDNTIQAANDAANKLFSLTIADLTANKNINTTNAHSTSNILIPELKAPKSLNASSQLTLLIGNLIQILGEKSLTALTNKITAWKSQQQARQQKNLEFSDKINTLLSETEGLTRDYEKQINKLKNADSKIKDLENKINQIQTRLSELDPDSPEKKKLSREEIQLTIKKDAAVKDRTLIEQKTLSIHSKLTDKSMQLEKEIDSFSAFSNTASAEQLSTQQKSLTGLASVTQLMATFIQLVGKNNEESLKNDLALFQSLQESRKTEMERKSDEYAAEVRKAEELNRVMGCVGKILGALLTIVSVVAAAFSGGASLALAAVGLALMVTDAIVQAATGNSFMEQALNPIMKAVIEPLIKLLSDAFTKMLEGLGVDSKKAKMIGSILGAIAGALVLVAAVVLVATVGKQAAAKLAENIGKIIGKTLTDLIPKFLKNFSSQLDDLITNAVARLNKFLGAAGDEVISKQIISTHLNQAVLLGESVNSATQAGGSVASAVFQNSASTNLADLTLSKYQVEQLSKYISEAIEKFGQLQEVIADLLASMSNSQANRTDVAKAILQQTTA

SEQ ID NO: 6201 - protein, 89 aa, Escherichia coli
MKKMFMAVLFALASVNAMAADCAKGKIEFSKYNEDDTFTVKVDGKEYWTSRWNLRPLLQSAQLTGMTVTIKSSTCESGSGFAEVQFNND

SEQ ID NO: 6202 - protein, 848 aa, Escherichia coli
MLHINSMVKVCFFVIIAFSLFHTRNSDGKTYSFDASLLKRRGEGVDLTLFENGGQLPGIYPVDIFLNGTIVGSEDIFFHAEHSNGKPYLKACLSEELLMRYGVKTEKYPKLFLSHYGKKDERQCADLSVIPQATEEFLFEAQKLVLSIPQVAIRSPLRGVASDLIWEDGISTFLLNWQVEAGHSEFQHYEKTTSDNFWVSLEPGINIGPWRIRNLTTLNKSSGQVGKWESSYIRAERGLNNIKSRLTLGEDYTPADIFASVPFRGVMLGTDENMIPYDQRGFAPVIRGIARTQARIEIRQNGYLIQSQTVAAGPFALTDLPITGSGGEFQVTIFESDGAIQSFNVPFTTPAIALREGYLKYNISAGQYRSSDESVEKAYLWQATAMYGLPRALTVFGGVQTAEHYQAAALGVGLSLGNMGAASLDTIYSRGQQKGYDFDTGNSWRIRYDKSFELTDTSFSAASYQYSNEGYHELSDILDTYRSGANFVFNDTDRKRRRITININQSLGPWGFIGLSGGRDEYKGGDRQDYIGASYSMSWKDISFSVNWTRNRNVGDYFSNRTFNEDTVGMWMSIPLKHWLGKNDNDVNATAQIQHSTRQNTRYEMGLNGRAFDQKLYWDIREQIVPGSLLMQISRLNMRWSGSYGELVGMYSYNSHTRQMNAGMSGSIAMHSEGITFGQRFGDTMALIAAPGVRGASVGGWPGVSTDSRGYALVSYITPYQENIITLDPTTFPENAEVLQTDTRVVPTKGAVVRAKFKTRVGNRAVVRLARADGTPLPFGTVVTLEGKTEVSNSTGVVDDKGMVYLSGLSEAGKLKAQWGMNSHCYANYRLPVKKGPAGLYLTSAVCI

SEQ ID NO: 6203 - protein, 250 aa, Escherichia coli
MKIRTALLVSSLPLCFFVSANAKTFENEGNKTQMFSLHLGATRVIYNIFSSGETLTIINDYDYPMLVQSEVLLEDQKTPAPFIITPPLFRLDALQSSRLRIVRTGGDFPKDRETLQWICVKGIPPKSDEKWAESNKNSLNNVTLNVQVSLSTCIKMFVRPSSVKGHPEDVAGEVKWQRVNNKLKGVNPTPFYINLSELRVGGEEISEHHYIAPFSSFEYPIPVSKSSKVQWKIVTDYGGVSEFFETDINL

SEQ ID NO: 6204 - protein, 306 aa, Escherichia coli
MHNVSTTTTGLSLAKILASTELGDNTIQAANDAANKLFSLTIADLTANKNINTTNAHSTSNILIPELKAPKSLNASSQLTLLIGNLIQILGEKSLTALTNKITAWKSQQQARQQKNLEFSDKINTLLSETEGLTRGYEKQINKLKNADSKIKGLENKINQIQTRLSELDPDSPEKKKLSREEIQLTIKKDAAVKDRTLIEQKTLSIHSKLTDKSMQLEKEIDSFSAFSNTASAEQLSTQQKSLTGLASVTQLMATFIQLVGKNNEESLKNDLALFQSLQESRKTEMERKSDEYAAEVRKAEELNRV

SEQ ID NO: 6205 - protein, 306 aa, Escherichia coli
MHNVSTTTTGLPLAKILASTELGDNTIQAANDAANKLFSLTIADLTANKNINTTNAHSTSNILIPELKAPKSLNASSQLTLLIGNLIQILGEKSLTALTNKITAWKSQQQARQQKNLEFSDKINTLLSETEGLTRDYEKQINKLKNADSKIKDLENKINQIQTRLSELDPDSPENKKLRRGEIQLTIKKDAAVKDRTLIEQKTLSIHSKLTDKSMQLEKEIDSFSAFSNTASAEQLSTQQKSLTGLASVTQLMATFIQLVGKNNEESLKNDLALFQSLQESRKTEMERKSDEYAAEVRKAEELNRV

SEQ ID NO: 6206 - protein, 306 aa, Escherichia coli
MRNVSATTTGLPLAKILASTELGDNTIQAANDAANKLFSLTIADLTANKNINTTNAHSTSNILIPELKAPKSLNASSQLTLLIGNLIQILGEKSLTALTNKITAWKSQQQARQQKNLEFSDKINTLLSETEGLTRDYEKQINKLKNADSKIKDLENKINQIQTRLSELDPDSPENKKLRREEIQLTIKKDAAVKDRTLIEQKTLSIHSKLTDKSMQLEKEIDSFSAFSNTASAEQLSTQQKSLTGLASVTQLMATFIQLVGKNNEESLKNDLALFQSLQESRKTEMERKSDEYAAEVRKAEELNRV

SEQ ID NO: 6207 - protein, 306 aa, Escherichia coli
MRDVSAATTGLSLAKILASTELGDNTIQAANDAANKLFSLTIADLTANKNINTTNAHSTSNILIPELKAPKSLNASSQLTLLIGNLIQILGEKSLTALTNKITAWKSQQQARQQKNLEFSDKINTLLSETEGLTRDYEKQINKLKNADSKIKDLENKINQIQTRLSELDPDSPEKKKLSREEIQLTIKKDAAVKDRTLIEQKTLSIHSKLTDKSMQLEKEIDSFFAFSNTASAEQLSTQQKSLTGLASVTQLMATFIQLVGKNNEESLKNDLALFQSLQESRKTEMERKSDEYAAEVRKAEELNRV

SEQ ID NO: 6208 - protein, 306 aa, Escherichia coli
MRNVSTTTTGLPLAKILASTELGDNTIQAANDAANKLFSLTIADLTANKNINTTNAHSTSNILIPELKAPKSLNASSQLTLLIGNLIQILGEKSLTALTNKITAWKSQQQARQQKNLEFSDKINTLLSETEGLTRDYEKQINKLKNADSKIKDLENKINQIQTRLSELDPDSPENKKLRREEIQLTIKKDAAVKDRTLIEQKTLSIHSKLTDKSMQLEKEIDSFSAFSNTASAEQLSTQQKSLTGLASVTQLMATFIQLVGKNNEESLKNDLALFQSLQESRKTEMERKSDEYAAEVRKAEELNRV

SEQ ID NO: 6209 - protein, 306 aa, Escherichia coli
MREVSTTTTGLPLAKILASTELGDNTIQAANDAANKLFSLTIADLTANKNINTTNAHSTSNILIPELKAPKSLNASSQLTLLIGNLIQILGEKSLTALTNKITAWKSQQQARQQKNLEFSDKINTLLSETEGLTRDYEKQINKLKNADSKIKDLENKINQIQTRLSELDPDSPENKKLRREEIQLTIKKDAAVKDRTLIEQKTLSIHSKLTDKSMQLEKEIDSFSAFSNTASAEQLSTQQKSLTGLASVTQLMATFIQLVGKNNEESLKNDLALFQSLQESRKTEMERKSDEYAAEVRKAEELNRV

SEQ ID NO: 6210 - protein, 306 aa, Escherichia coli
MHNVSTTTTGLPLAKILASTELGDNTIQAANDAANKLFSLTIADLTANKNINTTNAHSTSNILIPELKAPKSLNASSQLTLLIGNLIQILGEKSLTALTNKITAWKSQQQARQQKNLEFSDKINTLLSETEGLTRDYEKQINKLKNADSKIKDLENKINQIQTRLSELDPDSPENKKLRREEIQLTIKKDAAVKDRTLIEQKTLSIHSKLTDKSMQLEKEIDSFSAFSNTASAEQLSTQQKSLTGLASVTQLMATFIQLVGKNNEESLKNDLALFQSLQESRKTEMERKSDEYAAEVRKAEELNRV

SEQ ID NO: 6211 - protein, 89 aa, Escherichia coli
MKKILLIAASLSFFSASVLAAPDCVTGNVEYTKYNDDDTFTVKVGDKELFTNRWNLQSLLLSAQITGMTVTIKTNACHNGRGFSEVIFR

SEQ ID NO: 6212 - protein, 89 aa, Escherichia coli
MKKILLIAASLSFFSASVLAAPDCVTGNVEYTKYNDDDTFTVKVGDKELFTNRWNLQSLLLSAQITGMTVTINTNACHNGGGFSEVIFR

SEQ ID NO: 6213 - protein, 89 aa, Escherichia coli
MKKTLLIAASLSFFSASALATPDCVTGKVEYTKYNDDDTFTVKVGDKELFTNRWNLQSLLLSAQITGMTVTIKTNACHNGRGFSEIIFR

SEQ ID NO: 6214 - protein, 89 aa, Escherichia coli
MKKMFMAVLFALVSVNAMAADCAKGKIEFSKYNGDNTFTVKVDGKEYWTNRWNLQPLLQSAQLTGMTVTIKSNTCESGSGFAEVQFNND

SEQ ID NO: 6215 - protein, 243 aa, Escherichia coli
MSRKSCLIRLFKTTVSCKLFTAIILSVFLGQPALTYAGVVIGGTRVVYLSNNADKSISVFSKEEKIPYLIQAWVDPFNKEDKSKAPFTVIPPVSRLEPAQEKILRIIHTKGVSLPDDRESVFWLNIKNIPPSASNKATNSLEIAVKTRIKLFWRPANIRLIPEDVAPKVKWRREGRNLIAEDPNPIHISVMDVIVDGHDVPLNMIRPFETLTLPLPANSAGGQMTWRFINDYGAVSDPIKMTL

SEQ ID NO: 6216 - protein, 616 aa, Escherichia coli
MGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFFNAGRTR

SEQ ID NO: 6217 - protein, 147 aa, Escherichia coli
LQNFTGIALSGMALDELLRKQREGEDISQNDIAKSSIELINQLVDTVSSINSTVDSFSEQLNQLGSFLSSKPRLSSVGGKLQNLPDLGPLGDGLDVVSGILSAVSASFILGNSDAHTGTKAAAGIELTTQVLGNVGKAVSQYILAQR

SEQ ID NO: 6218 - protein, 587 aa, Escherichia coli
MRGMKDRIPFAVNNITCVILLSLFCNAASAVEFNTDVLDAADKKNIDFTRFSEAGYVLPGQYLLDVIVNGQSISPASLQISFVEPQSSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVRLDCQPQGLNIWGVITILLTCVYPCRWGRGQRATVAV

SEQ ID NO: 6219 - protein, 244 aa, Escherichia coli
MWKLSMIRKKILMAAIPLFVISGADAAVSLDRTRAVFDGSEKSMTLDISNDNKQLPYLAQAWIENENQEKIIAGPVIATPPVQRLEPGAKSMVRLSTTPDISKLPQDRESLFYFNLREIPPRSEKANVLQIALQTKIKLFYRPAAIKTRPNEVWQDQLILNKVSGGYRIENPTPYYVTVIGLGGSEKQAEEGEFETVMLSPRSEQTVKSANYNTPYLSYINDYGGRPVLSFICNGSRCSVKKEK

SEQ ID NO: 6220 - protein, 682 aa, Escherichia coli
MKNKYIIAPGIAVMCSAVISSGYASSDKKEDTLVVTASGFTQQLRNAPASVSVITSEQLQKKPVSDLVDAVKDVEGISITGGNEKPDISIRGLSGDYTLILVDGRRQSGRESRPNGSGGFEAGFIPPVEAIERIEVIRGPMSSLYGSDAIGGVINIITKPVNNQTWDGVLGLGGIIQEHGKFGNSTTNDFYLSGPLIKDKLGLQLYGGMNYRKEDSISQGTPAKDNKNITATLQFTPTESQKFVFEYGKNNQVHTLTPGESLDAWTMRGNLKQPNSKRETHNSRSHWVAAWNAQGEILHPEIAVYQEKVIREVKSGKKDKYNHWDLNYESRKPEITNTIIDAKVTAFLPENVLTIGGQFQHAELRDDSATGKKTTETQSVSIKQKAVFIENEYAATDSLALTGGLRLDNHEIYGSYWNPRLYAVYNLTDNLTLKGGIAKAFRAPSIREVSPGFGTLTQGGASIMYGNRDLKPETSVTEEIGIIYSNDSGFSASATLFNTDFKNKLTSYDIGTKDPVTGLNTFIYDNVGEANIRGVELATQIPVYDKWHVSANYTFTDSRRKSDDESLNGKSLKGEPLERTPRHAANAKLEWDYTQDITFYSSLNYTGKQIWAAQRNGAKVPRVRNGFTSMDIGLNYQILPDTLINFAVLNVTDRKSEDIDTIDGNWQVDEGRRYWANVRVSF

SEQ ID NO: 6221 - protein, 185 aa, Escherichia coli
MNLGAALFRLERPFAYLDTDNVYKEQGNQVNNGLELTAAGNVWQGLNIYSGVTFLDPKLKDTANASTSNKQVVGVPKVQANLLAEYSLPSIPEWVYSANVHYTGKRAANDTNTSYASSYTTWDLGTRYTTKVSNVPTTFRVVVNNVFDKHYWASIFPSGTDGDNGSPSAFIGGGREVRASVTFDF

SEQ ID NO: 6222 - protein, 616 aa, Escherichia coli
MGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 6223 - protein, 124 aa, Escherichia coli
MNKVKCYVLFTALLSSLYAHGAPQTITELCSEYRNTQIYTINDKILSYTESMAGKREMVIITFKSGETFQVEVPGSQHIDSQKKAIERMKDTLRITYLTETKIDKLCVWNNKTPNSIAAISMEN

SEQ ID NO: 6224 - protein, 89 aa, Escherichia coli
MKKMFMAVLFALVSVNAMAADCAKGKIEFSKYNENDTFTVKVAGKEYWTSRWNLQPLLQSAQLTGMTVTIKSSTCESGSGFAEVHLIMT

SEQ ID NO: 6225 - protein, 84 aa, Escherichia coli
MKKMFMAVLFALVSVNAMAADCAKGKIEFSKYNENDTFTVKVAGKEYWTSRWNLQPLLQSAQLTGMTVTIKSSTCESGSGFAEC

SEQ ID NO: 6226 - protein, 89 aa, Escherichia coli
MKKILLIAASLSFFSASVLAAPDCVTGKVGYTKYSDDDTFTVKVGDKELFTNRWNLQSLLPSAQITGMTVTIKTNACHNGGGFSEVIFR

SEQ ID NO: 6227 - protein, 89 aa, Escherichia coli
MKKILLIAASLSFFSASVLAAPDCVTGKVEYTKYNDDDTFTVKVGDKELFTNRWNLQSLLLSAQIAGMTVTIKTNACHNGGGFSEVIFR

SEQ ID NO: 6228 - protein, 89 aa, Escherichia coli
MKKIFVAALFAFVSVNAMAADCAKGKIEFSKYNENDTFTVKVAGKEYWTNRWNLQPILQSAQLTGMTVTIKSNTCASGSGFAEVQFNND

SEQ ID NO: 6229 - protein, 89 aa, Escherichia coli
MKKIFVAALFAFVSVNAMAADCAKGKIEFSKYNENDTFTVKVAGKEYWTNRWNLQPLLQGAQLTGMTVTIKSNTCASGSGFAEVQFNND

SEQ ID NO: 6230 - protein, 220 aa, Escherichia coli
MNKLGKVALTALLSVSFCNQAMAAFVLNGTRFIYEEGKKNVSFEVTNNADKTYGGQVWIDNTNQGNGVYMVPQPPFFKVGAKQKQIIRIINTDSNLPKDRESLFWLNVQEVPPKPEVKDSDEGVLAIAMNSRVKLIYRPASIKNGRQDAEKQLKMELRGDTTWLKNPTPYYMAIISVKHDGKDISLSDNVMKEIAQLRPFSDVNLGRVVRDKISVDAVND

SEQ ID NO: 6231 - protein, 754 aa, Escherichia coli
QYVVDVLVNNERTGRANLVITEEDEKNNHLCLSHEWLDSAGVMMKKDAYDYAFDREKQCYVLTRNSHTKVDFDYGAQTLKFNIPQAYLLSKTDPARWDYGLNGGRLKYYTNFNKNVHDDVNVFGNLDATINLGRWVLSSNMNMSHDRDKTEITSSDLTLSTAISQVQGDLLLGKSQTRTELFSDFNFYGVALRSNSNMRPWESRGYAPGITGIASTPSRITVKQNGYTVYSKMVPAGPYRLDDLRPMGNGELVVTVEDESGNKTEQVYPVTTLPTLLRPGEFQYNVAVGKKNNNNELDKAFHSDTGLFWLGSLDYGFSTTTLNSAFILNDDYQAAGLGGTQMLGGLGALSLSANMSKASYDNGEVKTGESFSAKYAKSFTDRTDLQLLTYRYQSKGYVEFADFNPKDIWSYARYGGQRSRYEARLSHRFDGTYLSGSYWRQDYWMREGTDTGSTLSFSTSVFDSVSVFLNGAYSKYAWSDKADYAVSLSLSVPFDLKGTRHYSSNSVGYTRTGGTTFNTSVSAMPTERLNYSLSANAGSTGDRGASASASYAFDAIQTNLGVSRSYNKHGNSHTSFSGSVSGSVLGTSESGPLFTKESSDTVGIVSIPGVEGVSVNGSMPTNRDGNTVVWLSEYSENNININMDNVPDDMEFETTSFNVVPTEKAMVYRKFGFENVLRYILRVKNAQGNYLTGGDAKTEQGLNAGFISNNGVLLMNMLAEPKAVSVNIGNGKQCRFSTAGLKANTNKVQEVRCE

SEQ ID NO: 6232 - protein, 89 aa, Escherichia coli
MKKTLLIAASLSFFSASALATPDCVTGKVEYTKYNDDDTFTVKVGDKELFTNRWNLQSLLLSAQITGMTVTIKTNACHNGGGFSEVIFR

SEQ ID NO: 6233 - protein, 89 aa, Escherichia coli
MKKMFMAVLFALASVNAMAADCAKGKIEFSKYNEDDTFTVKVDGKEYWTSRWNLQPLLQSAQLTGMTVTIKSSTCESGSGFAEVQFNND

SEQ ID NO: 6234 - protein, 835 aa, Escherichia coli
MKNNTSFVINGITYALLFSLAGAPTYAVDFNTDVLDAADRQNIDFSRFSQAGYIMPGQYQMEIMVNDQGISPSAFPVTFLEQPASVADGKKMLPQPCLTAEMVSRMGLTEASQKKVTYWNNGQCADLSQLPGVEIRPNLAEGMLYINMPQAWLEYSDASWLPPSRWDNGIPGLLFDYNLNGTVNKPHKGKQSQSLSYNGTAGANFGAWRLRADYQGNLNHTTGSGQGTDSQFTWSRFYMYRAIPRWRTNLTLGENYINSEVFSSWRYTGASLESDDRMLPPKLRGYAPQVSGIADTNARVVISQQGRILYDSTVPAGPFTIQDLDSSVRGRLDVEVIEQDGRKKTFQVDTAYVPYLTRPGQIRYKLVSGRSRNYEHTTEGPVFAAGEASWGISNKWSLYGGGIVAGDYNALAVGLGRDLNEFGTVSADMTQSVARIPGEETKQGKSWRLSYSKRFDDVNADITFVGYRFSERNYMTMDQYLNARYRNDFTGREKELYTATFNKSFEDWNTSVNLQYSHQTYWDRRASDYYTLSVNRYFDAFGFKNVSLGLSASRSKYQKRDNDSAFVRLSMPWGTGTASYSGSMSNDRYTNTVGYSDTLNKGLSSYNLNAGVSSGGGQPSQSQMSAYYNHSSPLASLSANFSAVENGYTSFGMSASGGATITAKGAALHAGGMNGGTRLLVDTDGVGGVPVDGGRVATNRWGVGVVTDVSSYYRNTTSVDLNRLPEDMEATRSVVESVLTEGAIGYREFEVLKGSRLFAVLRLADNSYPPFGASVTNAKGRELGMVADSGLAWLSGVSPDETLNVDWDGRTQCVVDIPAKLDPAQQLLLHCRKTK

SEQ ID NO: 6235 - protein, 753 aa, Escherichia coli
MNVIKLAIGSGILLLSCGAYSQSISEKTNSDKKGAAEFSPLSVSVGKTTSEQEALEKTGATSSRTTDKNLQSLDATVRSMPGTYTQIDPGQGAISVNIRGMSGFGRVNTMVDGITQSFYGTSTSGTTAHGSTNNMAGVLIDPNLLVAVDVTRGDSSGSEGINALAGSANMRTIGVDDVIFNGNTYGLRSRFSVGSNGLGRSGMIALGGKSDAFTDTGSIGVMAAVSGSSVYSNFSNGSGINSKEFGYDKYMKQNPKSQLYKMDIRPDEFNSFELSARTYENKFTRRDITSDDYYIKYHYTPFSELIDFNVTASTSRGNQKYRDGSLYTFYKTSAQNRSDALDINNTSRFTVADNELEFMLGSKLMRTRYDRTIHSAAGDPKANQESIENNPFAPSGQQDISALYTGLKVTRGIWEADFNLNYTRNRITGYKPACDSRVICVPQGSYDIDDKEGGFNPSVQLSAQVTPWLQPFIGYSKSMRAPNIQEMFFSNSGGASMNPFLKPERAETWQAGFNIDTRDLLVEQDALRFKALAYRSRIQNYIYSESYLVCSGGRKCSMAEVIGNDWEGISDEYSDNMYIYVNSASDVIAKGFELEMDYDAGFAFGRLSFSQQQTDQPTSIASTYFGAGDMTELPRKYMTLDTGVRFFDNALTLGTIIKYTGKARRLSPDFEQDEHTGAIIKQDLPQIPTIIDLYGTYEYNRNLTLKLSVQNLMNRDYSEALNKLNMMPGLGDETHPANSARGRTWIFGGDIRF

SEQ ID NO: 6236 - protein, 243 aa, Escherichia coli
MLKMKPALKKTLMAVACLSTVPAAQAAISLDRTRVIFNGGEKSMTLNIANDNKQLPYLAQAWVENEKKEKITTGPLIATPPVQRLEPDSKSMVRLTSTPDINRLPQDRESLFYFSLREIPPKSDKANVLQIALQTKIKLFYRPESIKAKPNAVWQDQLVLNKTTGGYQIENPTPYYVTVIGIGGNEKQAKEGEFDAVMLAPKSTQMVKSGTYSTPYLSYINDYGGRPVLQFSCAGSRCTAVKK

SEQ ID NO: 6237 - protein, 230 aa, Escherichia coli
MNKLGKVALTALLSVSFCNQAMAAFVLNGTRFIYEEGKKNVSFEVTNNADKTYGGQVWIDNTNQGNGVYMVPQPPFFKVGAKQKQIIRIINTDSNLPKDRESLFWLNVQEVPPKPEVKDSDEGVLAIAMNSRVKLIYRPASIKNGRQDAEKQLKMELRGDTTWLKNPTPYYMAIISVKHDGKDISLSDNVMKEIAQLRPFSDVNLGRVVRDKISVDAVNDWGGVQSYEIP

SEQ ID NO: 6238 - protein, 804 aa, Escherichia coli
MKKRYIFKLSLLALSICSQFSVATELNLDFIHGISAIPSILKTDTTLPAGQYVVDVLVNNERTGRANLVITEEDEKNNHLCLSHEWLDSAGVMMKKDAYDYAFDREKQCYVLTRNSHTKVDFDYGAQTLKFNIPQAYLLSKTDPARWDYGLNGGRLKYYTNFNKNVHDDVNVFGNLDATINLGRWVLSSNMNMSHDRDKTEITSSDLTLSTAISQVQGDLLLGKSQTRTELFSDFNFYGVALRSNSNMRPWESRGYAPGITGIASTPSRITVKQNGYTVYSKMVPAGPYRLDDLRPMGNGELVVTVEDESGNKTEQVYPVTTLPTLLRPGEFQYNVAVGKKNNNNELDKAFHSDTGLFWLGSLDYGFSTTTLNSAFILNDDYQAAGLGGTQMLGGLGALSLSANMSKASYDNGEVKTGESFSAKYAKSFTDRTDLQLLTYRYQSKGYVEFADFNPKDIWSYARYGGQRSRYEARLSHRFDGTYLSGSYWRQDYWMREGTDTGSTLSFSTSVFDSVSVFLNGAYSKYAWSDKADYAVSLSLSVPFDLKGTRHYSSNSVGYTRTGGTTFNTSVSAMPTERLNYSLSANAGSTGDRGASASASYAFDAIQTNLGVSRSYNKHGNSHTSFSGSVSGSVLGTSESGPLFTKESSDTVGIVSIPGVEGVSVNGSMPTNRDGNTVVWLSEYSENNININMDNVPDDMEFETTSFNVVPTEKAMVYRKFGFENVLRYILRVKNAQGNYLTGGDAKTEQGLNAGFISNNGVLLMNMLAEPKAVSVNIGNGKQCRFSTAGLKANTNKVQEVRCE

SEQ ID NO: 6239 - protein, 89 aa, Escherichia coli
MKKMFMAVLFALVSVNAMAADCAKGKIEFSKYNENDTFTVKVAGKEYWTSRWNLQPLLQSAQLTGMTVTIKSSTCASGSGFAEVQFNND

SEQ ID NO: 6240 - protein, 682 aa, Escherichia coli
MKNKYIIAPGIAVMCSAVISSGYASSDKKEDTLVVTASGFTQQLRNAPASVSVITSEQLQKKPVSDLVDAVKDVEGISITGGNEKPDISIRGLSGDYTLILVDGRRQSGRESRPNGSGGFEAGFIPPVEAIERIEVIRGPMSSLYGSDAIGGVINIITKPVNNQTWDGVLGLGGIIQEHGKFGNSTTNDFYLSGPLIKDKLGLQLYGGMNYRKEDSISQGTPAKDNKNITATLQFTPTESQKFVFEYGKNNQVHTLTPGESLDAWTMRGNLKQPNSKRETHNSRSHWVAAWNAQGEILHPEIAVYQEKVIREVKSGKKDKYNHWDLNYESRKPEITNTIIDAKVTAFLPENVLTIGGQFQHAELRDDSATGKKTTETQSVSIKQKAVFIENEYAATDSLALTGGLRLDDHEIYGSYWNPRLYAVYNLTDNLTLKGGIAKAFRAPSIREVSPGFGTLTQGGASIMYGNRDLKPETSVTEEIGIIYSNDSGFSASATLFNTDFKNKLTSYDIGTKDPVTGLNTFIYDNVGEANIRGVELATQIPVYDKWHVSANYTFTDSRRKSDDESLNGKSLKGEPLERTPRHAANAKLEWDYTQDITFYSSLNYTGKQIWAAQRNGAKVPRVRNGFTSMDIGLNYQILPDTLINFAVLNVTDRKSEDIDTIDGNWQVDEGRRYWANVRVSF

SEQ ID NO: 6241 - protein, 725 aa, Escherichia coli
MRINKILWSLTVLLVGLNSQVSVAKYSDDDNDETLVVEATAEQVLKQQPGVSVITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPTNDWHGSLSLYTNQPESSEEGATRRANFSLSGPLAGDALTTRLYGNLNKTDADSWDINSPVGTKNAAGHEGVRNKDINGVISWKLNPQQILDFEAGYSRQGNIYAGDTQNSSSSAVTESLAKSGKETNRLYRQNYGITHNGIWDWGQSRFGIYYEKTNNTRMNEGLSGGGEGRILAGEKFTTNRLSSWRTSGELNIPLNVMVDQTLTVGAEWNRDKLDDPSSTSLTVNDRDISGISGSAADRSSKNHSQISALYIEDNIEPVPGTNIIPGLRFDYLSDSGGNFSPSLNLSQELGDYFKVKAGVARTFKAPNLYQSSEGYLLYSKGNGCPKDITSGGCYLIGNKDLDPEISVNKEIGLEFTWEDYHASVTYFRNDYQNKIVAGDNVIGQTASGAYILKWQNGGKALVDGIEASMSFPLVKDRLNWNTNATWMITSEQKDTGNPLSVIPKYTINNSLNWTITQAFSANVNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 6242 - protein, 614 aa, Escherichia coli
MIKKYWFLMVYSVTAFSVWAQDTPLDTLVVTANRFQEPLSTVLAPVTIVTREDIDRWQVSSVNDVLRRLPGVAISQHGGEGQLSTIFVRGTNSNHTLVLIDGVRLNLAGVSGAADLSQFPVALVQRIEYIRGPRSAIYGSDAIGGVINIITSRENTGTEISAGWGSNSYQHYDISTHQQLGENTRVTLLGDYTYTRGFDAVAYGSTGMQPQSDRDGFLSKTFYGKLEHNLSDTWSGFVRGYGYNNRTKYDAWYSPGSPLIDTRKLYSQSWDAGLRYAGETLQSQLVSSYSHSKDYNYDPHYGRYDTSANLDDMKQYNLQWTNSVTVGHGNVGAGIDWQKQSTTPGTGYLPKGYDQRNTGIYLTGLQKLGDFTLEGAVRNDDNSQFERHTTWQSSAGWEFIEGYRFIASYGTAFKAPNLGQLYGMYGNPNLAPEKSKQWEGAFEGLTGGVNWRISGYRNDISEMINYNPHTLRYYNDGKVHVKGIEATVNFDTGALTHTVSYDYTDARNALTDKPLERRPKLQVKYQLDWQVFDFDWGITYQYMGSRYDSDYSSWPYKSVKMGGVSLWDVAVAYPVTPHLIVRGKIANLFNKDYETGYGYQAAGREYILSGSYTF

SEQ ID NO: 6243 - protein, 695 aa, Escherichia coli
MRITTLASVVIPCLGFSASSMAAEDVMIVSASGYEKKLTNAAASVSVISQEELQSSQYHDLAEALRAVEGVDVESGTGKTGGLEISIRGMPASYTLILIDGVRQGGSGDVTPNGFSAMNTGFMPPLAAIERIEVIRGPMSTLYGSDAMGGVVNIITKKNADKWLSSVNAGLNLQESNKWGNSSQFNFWSSGPLVDDSVSLQIRGSTQQRQGSSVTSLSDTSATRIPYPTESQNYNLGARIDWKATEQDVLWFDMDTTRQRYDNQDGQLGSLTGGYDHTLRYERNKISAGYDHTFTFGTWKSYLNWNETENKGRELVRSVLKSDKWGLAGKPRELKESNLILNSLLLTPLGESHLLTVGGEYQSSSMKDGVVLASTGETFRQKSWSVFAEDEWHLTDVLALTAGSRYEHHDQFGGHFSPRAYLVWDVTDAWTLKGGVTTGYKAPTMGQLHKGISGVSGQGRTNLLGNPELKPEESVSYEAGVYYDNLSGLNANITGFITDFSNKIVSYSIDDNTNSYTNSGKARLHGVEFAGTLPLWSEDVTLSLNYTWTQSEQRDGDNKGAPLSYTPEHMVNAKLNWQITEEVASWLGARYRGKTPRFTRNYSSLSAVQKKVYDEKGEYLKAWTVVDAGLSWKVTDALTLNAAVNNLLNKDYSDVSLYSADKSTLYAGDYFQTGSSTTGYVIPERNYWMSLNYQF

SEQ ID NO: 6244 - protein, 706 aa, Escherichia coli
MRDEMLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWQFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPA

SEQ ID NO: 6245 - protein, 124 aa, Escherichia coli
MNKVKCYVLFTALLSSLCAYGAPQSITELCSEYRNTQIYTINDKILSYTESMAGKREMVIITFKSGATFQVEVPGSQHIDSQKKAIERMKDTLRITYLTETKIDKLCVWNNKTPNSIAAISMEN

SEQ ID NO: 6246 - protein, 835 aa, Escherichia coli
MHKYQILMISFFVLCAETFAEDYFNPSLLATDIIGEGNIDLSAFSRHGGGMEGEREVAIYVNNNFYSRRTLVFKNTSDKGLLPEFTPGFFDNLVSGDILVSEKNKIISSSDFLKKVPYSDINFDQGMSRVNVSIPQAYLGDGAKLISSPDTWEYGVPAFLLDYNISGNRNASGNNDSRSLYISSQMGVNLMKWHLRTSSSYSNYKTNSVWGGARSERNSFYNTYAERDISSLRAVLRLGEISTRGLILDSVPFRGVKLSSSDDMLDARLRNYTPTVRGMARSQAVVTITQNGRQVYQTNVPAGPFELNDFYLSGYSGDMQVTVREADGSEHSFLQPYSTLPEMKREGISGFEISVGRYDNNGAEHYYDAESFVYGNWSRGFARGVTFFGETLQAEKYQSLGVGSTLSLGRLGASSADISLSRVDKYGAIRGGQSYGFKYSKSQIETGTTLTLATYRYSTEHFYTFRDFVSKTDTARYVWENKLKNRMTLSLSQSLGEYGYLSASASKQDYWTSREVSRNYALTHSFNWNDIYLSTTLSMDDQRGREAGDLSNKQAGLYVTVPLNKFLLGIDSTGSSLTWSTSHADHNVRNSVTLNGKMPESDVRYRVGGSWGNGNTEGSRTVSVSWSGDYVSTSLGYARTGKYRTLDYNMSGAAVMYPWGIAMGNNSVTGDGAIVVETPGAKGVRTSTGYRTSWLGTSLVSSPRKYTENRIDLYPDGLPDDTVLGETSRTTVPVKGAVVVLDYTVFRGKQVVFTLRQSNGKPLPFGTVVTLDGVSRGKENSGIVGEEGRVYMAGMPEKGTLTATWGQDKSCSVPFRINQHKTEAVISEIHGVCRV

SEQ ID NO: 6247 - protein, 255 aa, Escherichia coli
MKIRHLAALVGILAGLPASGVMAAGNQESTKTTSKVFSLHLGATRVIYNLDSSGASLTVMNDLDYPMLVQSEVLAENQKDPAPFVVTPPLFRLDALQSSRLRIVRTGGVFPEDRESLQWLCVKGIPPKHDDRWAEEKGADKKKADKATLQVNLSVSSCVKLFVRPPAVKGPPEDAGGKVEWTKSGNKLKGNNPTPFYINISELSVGGKEVKEHRYISPYSSYEYEIPSGASGKVSWTVITDYGGKSKPFESELKS

SEQ ID NO: 6248 - protein, 859 aa, Escherichia coli
MRDTSSGRMRTGVTGLALAVMVACVMFRAESGIARTYSFDAAMLKGGGKGVDLTLFEEGGQLPGIYPVDIILNGSRVDSQEMAFHAERDAEGRPYLKTCLTREMLARYGVRIEEYPALFRASGEGRGASVAEEACADLTAIPQATESYQFAAQQLVLGIPQVAPSAAEGDWPEALWDDGIPAFLLNWQANAGRSEYRGYGKRVTDSYWVSLQPGINIGPWRVRNLTTWNRSSGQSGKWESSYIRAERGLNGIKSRLTLGEDYTPSDIFDSVPFRGAMMSSDESMVPYNLREFAPVVRGIARTQARIEVRQNGYLIQSQTVAPGAFALTDLPVTGSGSDLQVTVLESDGTAQVFTVPFTTPAIALREGYLKYNVTAGQYRSSDDAVEHTSLGQVTAMYGLPWGLTVYGGLQGADDYQSAALGLGWSLGRLGAVSLDTTHSRGQQKGHDYETGDTWRIRYNKSFELTGTSFTAASYQYSSDGYHTLPDVLDTWRDDRYAYRHTENRSRRTTLSLSQSLGQWGYVGLNGSRDEYRDRPHRDYFGASYSTSWNNISLSVNWSRNRNSGGYYGGWSRTEDSVSMWMSVPLGRWFGGADNDISTTAQMQRSTGQDTRYEAGLNGRAFDRRLYWDVREQMVPGSESHADTSRLNLTWYGTYGELTGMYSYSSTMRQLNAGMSGSMVAHSEGVTFGQRTGDTVALIAAPGVSGASVGGWPGVRTDFRGYTLAGYASPYQENVLTLDPTTFPEDAEVPQTDSRVVPTKGAVVRAGFRTRVGGRALVSLARQDGTPLPFGAVVTVEGEAGQAAGSAGVVGDRGEVYLSGLKESGKLKAQWGENSLCHADYRLPEEKGPAGIFLTRTVCM

SEQ ID NO: 6249 - protein, 859 aa, Escherichia coli
MRDTSSGRMRTGVTGLALAVMVACVMFRAESGIARTYSFDAAMLKGGGKGVDLTLFEEGGQLPGIYPVDIILNGSRVDSQEMAFHAERDAEGRPYLKTCLTREMLARYGVRIEEYPALFRASGEGRGASVAEEACADLTAIPQATESYQFAAQQLVLGIPQVAPSAAEGDWPEALWDDGIPAFLLNWQANAGRSEYRGYGKRVTDSYWVSLQPGINIGPWRVRNLTTWNRSSGQSGKWESSYIRAERGLNGIKSRLTLGEDYTPSDIFDSVPFRGAMMSSDESMVPYNLREFAPVVRGIARTQARIEVRQNGYLIQSQTVAPGAFALTDLPVTGSGSDLQVTVLESDGTAQVFTVPFTTPAIALREGYLKYNVTAGQYRSSDDAVEHTSLGQVTAMYGLPWGLTVYGGLQGADDYQSAALGLGWSLGRLGAVSLDTTHSRGQQKGHDYETGDTWRIRYNKSFELTGTSFTAASYQYSSDGYHTLPDVLDTWRDDRYAYRHTENRSRRTTLSLSQSLGQWGYVGLNGSRDEYRDRPHRDYFGASYSTSWNNISLSVNWSRNRNSGGYYGGWSRTEDSVSMWMSVPLGRWFGGTDNDISATAQMQRSTGQDTRYEAGLNGRAFDRRLYWDVREQMVPGSESHADTSRLNLTWYGTYGELTGMYSYSSTMRQLNAGMSGSMVAHSEGVTFGQRTGDTVALIAAPGVSGASVGGWPGVRTDFRGYTLAGYASPYQENVLTLDPTTFPEDAEVPQTDSRVVPTKGAVVRAGFRTRVGGRALVSLARQHGTPLPFGAVVTVEGEAGQAAGSAGVVGDRGEVYLSGLKESGKLKAQWGENSLCHADYRLPEEKGPAGIFLTRTVCM

SEQ ID NO: 6250 - protein, 247 aa, Escherichia coli
MKMRAVAVFTGMLTGVLSVTGLLSAGAYAAGGEGNMSASATETNARVFSLHLGATRVVYNPASSGETLTVINDQDYPMLVQSEVLSEDQKSPAPFVVTPPLFRLDGQQSSRLRIVRTGGEFPSDRESLQWICVKGIPPKEDDRWAEGKDGEKKADKVSLNVQLSVSSCIKLFVRPPAVKGRPDDVAGKVEWQRAGNRLKGVNPTPFYINLSTLTVGGKEVKEREYIAPFSSREYPLPAGHRVRFSGR

SEQ ID NO: 6251 - protein, 512 aa, Escherichia coli
MKKISFFIFTALFCCSAQAAPSSLEKRLGKNEYFIITKSSPVRAILNDFAANYSIPVFISNSVNDDFSGEIKNEKPMKVLEKLSRLYHLTWYYDENILYIYKTNEISRSIITPTYLDIDSLLKYLRDTISVNKNSCNVRKITTFNSIEVRGVPECIKYITSLSESLDKEAQSKAKNKDVVRVFKLNYASATDITYKYRDQNVVVPGVVSILKTMASNGSLPSTGKGAVERNGNLFDNSVKISADPRLNAVVVKDREITMDIYRQLISELDIEQRQIEISVSIIDVDANDLQQLGVNWSGTLNAGQGSIAFNSSTAQANLSSSVISNANNFMIRVNALQQNSKAKILSQPSIITLNNMQAILDKNVTFYTKVSGEKVASLESITSGTLLRVTPRILDDNSNSLTGKRRERVRLLLDIQDGNQSTNQSNAQDASSILPEVQNSEMTTEATLSAGESLLLGGFIQDKESSSKDGIPLLSDIPVIGNLFSSTTKQKHSVVRLFLIKATPIKSASSE

SEQ ID NO: 6252 - protein, 83 aa, Escherichia coli
MKKMFMAVLFALASVNAMAADCAKGKIEFSKYNEDDTFTVKVDGKEYWTSRWNLQPLLQSAQLTGMTVTIKSSTCESGSGFAE

SEQ ID NO: 6253 - protein, 245 aa, Escherichia coli
MGGESPPIPGEVMCYQYSILFAFLFSGIVQAAEAFGPRENRLFFDEKKGNTFYRIDNSDKKLPWLVQAWIEDASENKTTALTSIPMVFRVEPSSVFTVRVVKTGVLPEDRETLFWAVSNSLPGVVPTKLDNKEGKITAKLSLAYRFKVPLIYRPTALNNFRQEPEKLEWTYNGNEGLKLYNPTRYIVQLYNITVNGHEFKGEGVSSIITPMSGKNVSATVKKGTRIKYSVINDNGAIKEYEGIVN

SEQ ID NO: 6254 - protein, 89 aa, Escherichia coli
MKKMFMAVLFALVSVNAMAADCAKGKIEFSKYNEDDTFTVKVDGKEYWTSRWNLQPLLQSAQLTGMTVTVKSSTCESGSGFAEVQFNND

SEQ ID NO: 6255 - protein, 876 aa, Escherichia coli
MFSGDGGQLLSDKSLTGSAGGGNNRMRFNILPLAFFIGIIVSPARAELYFNPRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQIYMSNQARGYIAPEYWDNGITAALLNYDFSGNRVRDSYGGTSDYAYLNLKTGLNIGSWRLRDNTSWSYSAGKGYSQNNWQHINTWLERDIVPLRSRLTMGDSYTRGDIFDGVNFRGIQLASDDNMVPDSQRGYAPTIHGISRGTSRISIRQNGYEIYQSTLPPGPFEINDIYPAGSGGDLQVTLQEADGSVQRFNVPWSSVPVLQREGHLKYALSAGEFRSGGHQQDNPRFAEGTLKYGLPAGWTVYGGAWIAERYRAFNLGVGKNMGWLGAVSLDATRANARLPDESRYDGQSYRFLYNKSLTETGTNIQLIGYRYSTRGYFSFADTAWKKMSGYSVLTQDGVIQIQPKYTDYYNLAYNKRGRVQVSISQQTGESSTLYLSGSHQSYWGTDRTDRQLNAGFNSSVNDISWSLNYSLSRNAWQHETDRILSFDVSIPFSHWMRSDSTSAWRNASARYSQTLEAHGQAASTAGLYGTLLEDNNLGYSIQSGYTRGGYEGSSKTGYASLNYRGGYGNASAGYSHSGGYRQLYYGLSGGILAHANGLTLSQPLGDTLILVRAPGASDTRIENQTGVSTDWRGYAVLPYATDYRENRVALDTNTLADNVDIENTVVSVVPTHGAVVRADYKTRVGVKVLMTLMRNGKAVPFGSVVTARNGGSSIAGENGQVYLSGMPLSGQVSVKWGSQTTDQCTADYKLPKESAGQILSHVTVSCR

SEQ ID NO: 6256 - protein, 231 aa, Escherichia coli
MMKHMRIWAVLASFLVFFYIPQSYAGVALGATRVIYPEGQKQVQLAVTNNDDKSSYLIQSWIENAEGKKDARFVITPPLFSMQGKKENTLRIIDATNGQMPEDRESLFWVNVKAIPAMDKAKTGENYLQFAIVSRIKLLYRPQGLVIPPEQAPGKLEFTRENGGLTLFNPTPYYLTVTDLKAGNKSLENTMVPPQGKVTVNIPGGYTGGDITYKTINDYGALTEQVRGVVK

SEQ ID NO: 6257 - protein, 660 aa, Escherichia coli
MSRPQFTSLRLSLLALAVSATLPTFAFATETMTVTATGNARSSFEAPMMVSVIDTSAPENQTATSATDLLRYVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 6258 - protein, 70 aa, Escherichia coli
MKKIFVAALFAFVSVNAMAADCAKGKIEFSKYNENDTFTVKVAGKEYWTNRWNLQPLLQSAQLTGMTVTI

SEQ ID NO: 6259 - protein, 364 aa, Escherichia coli
MKVKVLSLLVPALLVAGAANAAEIYNKDGNKLDLYGKVDGLHYFSDNDSKDGDKTYMRLGFKGETQVTDQLTGYGQWEYQIQGNEPESDNSSWTRVAFAGLKFQDVGSFDYGRNYGVVYDVTSWTDVLPEFGGDTYDSDNFMQQRGNGFATYRNTDFFGLVDGLDFAVQYQGKNGSAHGEGMTTNGRDDVFEQNGDGVGGSITYNYEGFGIGAAVSSSKRTWDQNNTGLIGTGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNRFTRDAGINTDDIVALGLVYQF

SEQ ID NO: 6260 - protein, 89 aa, Escherichia coli
MKKMFMAVLFALVSVNAMAADCAKGKIEFSKYNEDDTFTVKVDGEEYWTSRWNLQPLLQSAQLTGMTVTIKSSTCESGSGFAEVQFNND

SEQ ID NO: 6261 - protein, 90 aa, Escherichia coli
PFIITPPVFRVEPLSGQTMRIMYTGEKLPADRESLFWLNVLDIPAKPSFAGKSEKAQGYNYLQFAVRSRIKFFFRPDGLPFSPDDAYKKV

SEQ ID NO: 6262 - protein, 998 aa, Escherichia coli
MTVNKIKNIFNNATSTTKSAFNTASSSVRSAGKKLILLIPDNYEAQGVGINELVKAADDLGIEIHRTERDDTAIANQFFGTAEKVVGLTERGVAIFAPQLDKLLQKYQKVGSKIGGTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPNLGPLGDGLDVVSGILSAVSASFILGNSDAHTGTKAAAGIELTTQVLGNVGKAVSQYILAQRMAQGLSTTAASAGLITSAVMLAISPLSFLAIADKFERAKQLESYSERFKKLNYEGDALLAAFHKETGAIDAALTTINTVLSSVSAGVSAASSASLIGAPISMLVSALTGTISGILEASKQAMFEHVADKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFVTPTFTPGEEVRERKQSGKYEYMTSLIVNGKDTWSVKGIKNHKGVYDYSNLIQFVEKDNKHYQARIISELGDKDDIVYSGAGSSEVFAGEGHDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDRDDYISGGQGDDQLFGGSGNDKLSGGDGNNYLTGGSGNDELQAHGAYNILSGGTGDDKLYGGGGIDLLDGGEGNDYLNGGFGNDIYVYRQNYGHHTIADEGGKGDRLHLSDISFDDIAFKRVGNDLIMNKAINGVLSFNESNDVNGITFKNWFAKDASGADNHLVEVITDKDGREIKADKIPHNNNERSGYIKASNIASEKNMVNITSVADDINKIISSVSGFDSGDERLASLYNLSLHQNNTHSTTLTTTV

SEQ ID NO: 6263 - protein, 89 aa, Escherichia coli
MKKIFVAALFAFVSVNAMAADCAKGKIEFSKYNENDTFTVKVAGKEYWTNRWNLQPLLQSAQLTGMTVTIKSNTCASGSGFAEVQFNND

SEQ ID NO: 6264 - protein, 838 aa, Escherichia coli
MRILTCVPKYTKTRVALAVILACAFIYSSTGEARRYSFDASQLNGGGKGVDLSLFEEGAQLPGVYPVDIILNGSRVDSREMAFYGVKVEDYPGLFRQGDGDSGKDADACADLSVIPGATETHQFAAQQLLLGIPQVALRPQFTGIAPEALWDDGIPAFLLNWQANAYRSEYRGYGKSVSDSFQATLEPGINVGPWRVRNLTTWNKSSGQPGEWESSYTRAERGLNGIKSRLTLGESYTPSDIFDSVPFRGVMLGSDENMVPYSQREFAPVVRGIARTQARIEVRQNGYLIRSLTVAPGAFALTDLPVTGSGGDLQVTVLESDGTTQVFTVPFTTPAIALREGYMKYNVTGGQYRSYDDAVEHTSLGQATLMYGLPWGLTVFGGVQGAKHYQSAALGLGWALGSLGAVSVDGIHSRGQKKGRVQESGDTWRVRYNKSFETTGTSFTAASYQYSSDGYYTLSDVLDTYRHHGSGYSYKSSEHRSRRTTLNLSQSMGSLGYVSLWGSRDEYRDGRENRDSMGASYSTTWKDISLSVNWSRNRNAGGYYGWRQGKTEDSVSVWMSVPLGRWLGNTDNDIRATARVQRSTGQDTRYEAGMNGRAFDRRLSWDIRKQVTPGSETNSDSSRLNLTWYGTYGEATGMYSYSSHSRQMSAGLSGGLVAHRHGVTLGQKTGETVALVEAPGVSGASVSGWPGVRTDFRGYTLLGWISPYQENVVTLDPTTFPADAEVPQTDSRVVPTKGAVVSAGFVTRVGGRALVTLTRGDGTPLPFGAVVTVDGEAGRISGAAGVVGDNGEVYMSGLSETGKLKAQWGQNSQCHADYRLPEEKGPAGIFLTRSVCM

SEQ ID NO: 6265 - protein, 366 aa, Escherichia coli
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSEGMTNNGREALRQNGDGVGGSITYDYEGFGIGAAVSSSKRTDDQNSPLYIGNGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLFYQF

SEQ ID NO: 6266 - protein, 89 aa, Escherichia coli
  MOD_RES (84)..(84): Any amino acid
MKKMFMAVLFALASVNAMAADCAKGKIEFSKYNEDDTFTVKVDGKEYWTSRWNLQPLLQSAQLTGMTVTIKSSTLESGSGFAEXLFNND

SEQ ID NO: 6267 - protein, 89 aa, Escherichia coli
  MOD_RES (48)..(48): Any amino acid
  MOD_RES (75)..(75): Any amino acid
  MOD_RES (85)..(85): Any amino acid
MKKMFMAVLFALASVNAMAADCAKGKIEFSKYNEDDTFTVKVDGKEYXDQSLNLQPLLQSAQLTGMTVTIKSSTXESGSGFAEGXFNND

SEQ ID NO: 6268 - protein, 89 aa, Escherichia coli
  MOD_RES (75)..(75): Any amino acid
  MOD_RES (78)..(78): Any amino acid
  MOD_RES (84)..(85): Any amino acid
MKKMFMAVLFALASVNAMAADCAKGKIEFSKYNEDDTFTVKVDGKEYWTSRWNLQPLLQSAQLTGMTVTIKSSTXESXSGFAEXXFNND

SEQ ID NO: 6269 - protein, 89 aa, Escherichia coli
  MOD_RES (78)..(78): Any amino acid
  MOD_RES (87)..(87): Any amino acid
MKKMFMAVLFALASVNAMAADCAKGKIEFSKYNEDDTFTVKVDGKEYWTSRWNLQPLLQSAQLTGMTVTIKSSTCESXSGFAEVQFXND

SEQ ID NO: 6270 - protein, 89 aa, Escherichia coli
  MOD_RES (52)..(52): Any amino acid
  MOD_RES (75)..(75): Any amino acid
MKKMFMAVLFALASVNAMAADCAKGKIEFSKYNEDDTFTVKVDGKEYWTSRXNLQPLLQSAQLTGMTVTIKSSTXESGSGFAEGQFNND

SEQ ID NO: 6271 - protein, 89 aa, Escherichia coli
MKKMFMAVLFALASVNAMAADRAKGKIEFSKYNEDDTFTVKVDGKEYWTSRWNLQPLLQSAQLTGMTVTIKSSTCESGSGFAEVQFNND

SEQ ID NO: 6272 - protein, 89 aa, Escherichia coli
  MOD_RES (75)..(75): Any amino acid
MKKMFMAVLFALASVNAMAADCAKGKIEFSKYNEDDTFTVKVDGKEYWTSRWNLQPLLQSAQLTGMTVTIKSSTXESGSGFAEGQFNND

SEQ ID NO: 6273 - protein, 89 aa, Escherichia coli
  MOD_RES (75)..(75): Any amino acid
  MOD_RES (84)..(84): Any amino acid
MKKMFMAVLFALASVNAMAADCAKGKIEFSKYNEDDTFTVKVDGKEYWTSRWSLQPLLQSAQLTGMTVTIKSSTXESGSGFAEXQFNND

SEQ ID NO: 6274 - protein, 89 aa, Escherichia coli
  MOD_RES (69)..(69): Any amino acid
MKKMFMAVLFALASVNAMAADCAKGKIEFSKYNEDDTFTVKVDGKEYWTSRWNLQPLLQSAQLTGMTVXIKSSTCESGSGFAEVQFNND

SEQ ID NO: 6275 - protein, 89 aa, Escherichia coli
MKKMFMAVLFALASVNAMAADCAQGKIEFSKYNEDDTFTVKVDGKEYWTSRWNLQPLLQSAQLTGMTVTIKSSTCESGSGFAEVQFNND

SEQ ID NO: 6276 - protein, 673 aa, Escherichia coli
MKMTRLYPLALGGLLLPTIANAQTSQQDESTLEVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSLSDGSPDPYMRRCTDSQTLSGKYTTDDWVFNLISAWQQQHYSRTFPSGSLIVNMPQRWNQDVQELRAATLGDARTVDMVFGLYRQNTREKLNSAYNMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 6277 - protein, 725 aa, Escherichia coli
MRINKILWSLTVLLVGLNSQVSVAKYSDDDNDETLVVEATAEQVLKQQPGVSVITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPTNDWHGSLSLYTNQPESSEEGATRRANFSLSGPLAGDALTTRLYGNLNKTDADSWDINSPVGTKNAAGHEGVRNKDINGVVSWKLNPQQILDFEVGYSRQGNIYAGDTQNSSSSAVTESLAKSGKETNRLYRQNYGITHNGIWDWGQSRFGVYYEKTNNTRMNEGLSGGGEGRILAGEKFTTNRLSSWRTSGELNIPLNVMVDQTLTVGAEWNRDKLDDPSSTSLTVNDRDISGISGSAADRSSKNHSQISALYIEDNIEPVPGTNIIPGLRFDYLSDSGGNFSPSLNLSQELGDYFKVKAGVARTFKAPNLYQSSEGYLLYSKGNGCPKDITSGGCYLIGNKDLDPEISVNKEIGLEFTWEDYHASVTYFRNDYQNKIVAGDNVIGQTASGAYILKWQNGGKALVDGIEASMSFPLVKERLNWNTNATWMITSEQKDTGNPLSVIPKYTINNSLNWTITQAFSASFNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 6278 - protein, 861 aa, Escherichia coli
MHRNKSSSGLSLYCVKTKITAVALSVMAACTLLYTGNTEARTYSFDASMLKGGGKGVDLTLFEEGAQLPGIYPVDIILNGSRVDSRDMAFRTEKDAEGKTYLKTCLTREMLARYGVMTEEYPELFHGDDGKEAEACAELSVIPQATETYQFASQQLLLSIPQVALRPPLRGIAPEALWDDGIPAFLLNWQANTSRSEYRGYGKSVTDNYWVTLEPGINLGPWRVRNLTTWNRSSGQPGQWESAYIRAERGINSLRSRLTLGEDYTPSDIFDSVPFRGVMLGADESMVPYNQREFAPVVRGIARTQARIEVRQNGYLIDSRTVAPGAFALTDLPLTGSGGDLQVTVQESDGTAQVFTVPYTTPAIALREGYMKYSIAGGEYRSSDDAVEHSPLGQMSVMYGLPWGLTAFGGAQMSSHYQSAALGLGWSMGRLGAVSVDGIHSRGQQKGRDTETGETWRLRYNKSFELTNTDLTAARYQYTSSGFHTLSDVLSTFRNDNFRAYSYSGDRSRRTTLRLNQSVGSLGYMSFYGSRDEFRHNRQKQDSFGMSYGTSWKNISWYVNWSGNYSTNAYYQRGHIEDSINLWMNIPLGQWIGGRDNDINVTTQTQRTTGQNTWYETGLNGRAFDRRLYWDVSERIAPGSENNVDSSRLNLRWFGTYGELAGMYSYSSYIRQMSAGISGGMVLHNEGITLGQKGEDTVALVVAPGVNGASVGSLPGVRTDTRGYTLVNHVSPYQENLITLDPTTFPENVEVSQTDTRVVPTKGAVVRAKFITRVGGRALITLSRSGSRLPFGAVVTEEGKKGQMPGGAGVVGDNGEVYLSGLDETGQLKVQWGRNSSCRANYRLPEEKEATGIFLVRTVCM

SEQ ID NO: 6279 - protein, 241 aa, Escherichia coli
MKIRRIRLVLILALVFFMNAQASENTRVFSLHLGATRVVYNQQSSGEALAVINDHNYPMLVQSEVLTEDKKESAPFVITPPLFRLDALQSSRLRVVRIGGTFPADRETLQWICVKGIPPKANDRWAENDSKNVLDNKVALNIHLSVTSCIKLFFRPLVVKGHPEDVAGEVRWQKIGDKLKGINPTPFYINLSELKFGGEEITERHYIAPFSSYEYLIPKTMNRNNIVQWKVVTDYGGISNS

SEQ ID NO: 6280 - protein, 58 aa, Escherichia coli
MIKHFHFNKLSSGKKNNVPSPAKGVIQIKKSASQLTKGGAGHVPEYFVGIGTPISFYG

SEQ ID NO: 6281 - protein, 856 aa, Escherichia coli
MWQIKTSLTAVAYSVMMTCTLLHVEDVIARTYSFNSSLLSGGVKGVDLTVFEEGGQLPGIYQTDIILNGSRVDSLEMPFHTEKDENGRPYLKTCLTQEMLARYGVKTEEYPALFRSLGGGSDTSGERGVCADLSAIPQATENYQFAAQQLVLGIPQVALRPLLRGIAPEVLWDDGIPAFLLNWQANAGRSEYRGYIKDVEDYFWSSLEPGINIGSWRIRNLTTWNKSSGQSGKWESLYIRAERGLNSLKSRLTLGENYTPSDIFDSVPFRGGMLSSDESMVPYNQREFAPVVRGIARTQARIEVRQNGYLIQSQTVAPGAFALTDLPVTGSGSDLQVTVRESDGTVQVFTVPFTTPAIALREGYLKYNVMAGQYRSSDDAVEDSTLGQVMGMYGLPWGLTVFGGLQGAEHYQSAALGLGWSLGKLGAVSLDTIHSRGQQKGYNYETGNTWRIRYNKSFELTGTSFTAASYQYSSSGYHTLSDVLETYRDDGRFAYRSTDSRTSRTTVNLSQSLGRWGYLGLNGSRDEYRDRPHQDYIGASYGASWNRMSLSVNWSRNHSTRGYYGSKSRTEDSISIWMSIPLESWLGRSDNNISATAQMQRSTEQNTRYELGLNGRAFDRRLFWEVHEQMVSGSEYNTGTSRLNLRWSGTYGELAGMYSYSSNMRQINAGMSGSMVAHGEGVTFGQRAGDTVTLIAAPGVSGASVGDWPGVRTDFRGYALAGYASPYQENVITLDPTTFPEDAEVPQTDSRVVPTKGAVVRAGFRTRVGGRALVSLTRQDGSSLPFGAIVTLEGKPGETSGSAGVVDDKGRVYLSGLSETGKLKAQWGENSLCHADYRLPEEKGPAGIFLTRTVCM

SEQ ID NO: 6282 - protein, 351 aa, Escherichia coli
  strain 55989 / EAEC
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSEIRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 6283 - protein, 784 aa, Escherichia coli
  strain 55989 / EAEC
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYEDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLDESVNRVMPQFKVDGKMVFERDMEMLAPGYTQTLEPRAQYLYVPYRDQSDIYNYDSSLLQSDYSGLFRDRTYGGLDRIASANQVTTGVTSRIYDDAAVERFNISVGQIYYFTESRTGDDNITWENDDKTGSLVWAGDTYWRISERWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 6284 - protein, 412 aa, Escherichia coli
  strain 55989 / EAEC
MKQWIAALLLMLIPGVQAAKPQKVTLMVDDVPVAQVLQALAEQEKLNLVVSPDVSGTVSLHLTDVPWKQALQTVVKSAGLITRQEGNILSVHSIAWQNDNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 6285 - protein, 102 aa, Escherichia coli
  strain 55989 / EAEC
MKKVLALVVAAAMGLSSAAFAAETATTPAPTATTTKAAPAKTTHHKKQHKAAPAQKAQAAKKHHKNTKAEQKAPEQKAQAAKKHAGKHSHQQPAKPAAQPAA

SEQ ID NO: 6286 - protein, 541 aa, Escherichia coli
  strain 55989 / EAEC
MAMAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 6287 - protein, 700 aa, Escherichia coli
  strain 55989 / EAEC
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGAGMNIAWRFE

SEQ ID NO: 6288 - protein, 843 aa, Escherichia coli
  strain 55989 / EAEC
MHWMHLPLYHYRAHFSFSLLALTIASSLPAYGGKFNPKFLENVQGIDQHIDLSVYDSPVGQQIPGKYRVSVFVNEEKMASRTLDFSTASEAKRKASGESLMPCLSRVQLEEMGVRVDSFPALKMSPPEACVAFDEIIPQATSRFDFNTQTLHLSFPQAAMMMTARGTVDPSRWDEGIPALLLDYSFSGSNGRNEGTGSSSDSTSDSYYLNLRSGLNVGPWRLRNNSIWNRTDGKNQWDNVGTSLNRAIIPLKSQITLGDTATPGEIFDSVQMRGALLASDDEMLPDSQRGFAPVVRGIAKSNAEVSIEQNGYVIYRTFVQPGAFEINDLYATSGSGDLTVIIKEADGSEQRFIQPFSAVAIFQREGYLKYSLAAGEYRAGNYDSDKPHFGQFTAMYGLPWGMTAYGGALLSADYSALALGLGKNFGTIGAVSVDVTQAKSQLRNNEKEEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSVAYTWTRSPEWEEDDRLWSFSVSIPLGGAWSSYRMTTDQNGKTSQQASVSGTLLEDRNLSYNVQQGYTSNGVGYSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNVELQEAFQKVVPTRGAVVRSRFDTRVGYRVLMSLKQANGNAVPFGATAALIDESKPASSIVGEEGQLYISGMPEEGELQVSWGNEQAQRCRVPFRLPENKDNAAIVMVNAVCEK

SEQ ID NO: 6289 - protein, 228 aa, Escherichia coli; identical to SEQ ID NO: 6185
  strain 55989 / EAEC

SEQ ID NO: 6290 - protein, 883 aa, Escherichia coli
  strain 55989 / EAEC
MTAIRAAFKAYRMHQVLIMPRFARLTIALGLATAVFPVDAEYYFNPRFLSNDLAESVDLSAFTKGREAPPGTYRVDIYLNDEFMTSRDITFIADDNNAELIPCLSTDLLVSLGIKKSELLDNKEHSAEKHVPDNSACTPLQDRLADASTEFDVGQQHLSLSVPQIYVGRMARGYVSPELWEEGINAGLLNYSFNGNSINNRSNHNAGKSNYAYLNLQSGINIGSWRLRDNSTWSYNSGSSNSSNSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGRIVAENGQVYLTGLPQSGKLQVSWGKDKNSNCIVEYKLPEVSPGTLLNQQTAICR

SEQ ID NO: 6291 - protein, 239 aa, Escherichia coli
  strain 55989 / EAEC
MHQMQTTRTPYSISFMATVLLLLLFACHSTVANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDITHAATGDISFQTINDYGALTPRIKATMQ

SEQ ID NO: 6292 - protein, 122 aa, Escherichia coli; identical to SEQ ID NO: 5737
  strain 55989 / EAEC

SEQ ID NO: 6293 - protein, 243 aa, Escherichia coli; identical to SEQ ID NO: 6145
  strain 55989 / EAEC

SEQ ID NO: 6294 - protein, 230 aa, Escherichia coli
  strain 55989 / EAEC
MMTKIKLLMLIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVSSQIPLPSGVQGKLKFQTVNDYGSVTPVREVNLN

SEQ ID NO: 6295 - protein, 869 aa, Escherichia coli
  strain 55989 / EAEC
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGIRLYSSDNMYPDSQQGFAPTVRGIARTAAQLTIRQNGLIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSLNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQATYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 6296 - protein, 746 aa, Escherichia coli
  strain 55989 / EAEC
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 6297 - protein, 334 aa, Escherichia coli
  strain 55989 / EAEC
MKKNQFLKESDVTAESVFFMTRRQVLKALGISAAALSLPHAAHADLLSWFKGNDRPPAPAGKPLEFSKPAAWQNDLPLTPADKVSGYNNFYEFGLDKADPAANAGSLKTDPWTLKISGEVAKPLTLDHDDLTRRFPLEERIYRMRCVEAWSMVVPWIGFPLHKLLALAEPTSNAKYVAFETIYAPEQMPGQQDRFIGGGLKYPYVEGLRLDEAMHPLTLMTVGVYGKALPPQNGAPVRLIVPWKYGFKGIKSIVSIKLTRERPPTTWNLAAPDEYGFYANVNPHVDHPRWSQATERFIGSGGILDVQRQPTLLFNGYAEQVASLYRGLDLRENF

SEQ ID NO: 6298 - protein, 673 aa, Escherichia coli
  strain 55989 / EAEC
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSSDSYRSKFNLSGPIEDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 6299 - protein, 208 aa, Escherichia coli; identical to SEQ ID NO: 5717
  strain 55989 / EAEC

SEQ ID NO: 6300 - protein, 193 aa, Escherichia coli
  strain 55989 / EAEC
MRYLATLLLSLAVLITAGCGWHLRDTTQVPSTMKVMILDSGDPNGPLSRAVRNQLRLNGVELLDKETTRKDVPSLRLGKVSIAKDTASVFRNGQTAEYQMIMTVNATVLIPGRDIYPISAKVFRSFFDNPQMALAKDNEQDMIVKEMYDRAAEQLIRKLPSIRAADIRSDEEQTSTTTDTPATPARVSTTLGN

SEQ ID NO: 6301 - protein, 826 aa, Escherichia coli
  strain 55989 / EAEC
MLRMTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKELRADGQPLMFGYEVNDIHGHNIGVVGQGSQLFIRTNEVPPSVNVAIDKQQGLSCTITFGKEIDESRNYICQ

SEQ ID NO: 6302 - protein, 224 aa, Escherichia coli
  strain 55989 / EAEC
MKGLLSLLIFSMVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVSRSGNGLVIKNDSANWVTISDVKANNVKVNYETIMIAPLESQSVNVKSNNANNWYLTIIDDHGNYISDKI

SEQ ID NO: 6303 - protein, 614 aa, Escherichia coli
  strain 55989 / EAEC
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVENGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 6304 - protein, 251 aa, Escherichia coli
  strain 55989 / EAEC
MSLIKEMKMTFMKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPAPEKNSDHAVLQVAIQSRIKVFWRPAALRKKAGEKVELQLQVSQQGNQLTLKNPTAYYLTIAYLGRNEKGVLPGFKTVMVAPFSTVNTNTGNYSGSQFYLGYMDDYGALRMTTLNCSGQCHLQAVEAKK

SEQ ID NO: 6305 - protein, 833 aa, Escherichia coli
  strain 55989 / EAEC
MAALSPPFIKYLSGMDTVNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGVLMDYNLFASSYRPQDGSSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAKTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAIGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPIQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 6306 - protein, 430 aa, Escherichia coli; identical to SEQ ID NO: 5758
  strain 55989 / EAEC

SEQ ID NO: 6307 - protein, 663 aa, Escherichia coli
  strain 55989 / EAEC
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 6308 - protein, 828 aa, Escherichia coli
  strain 55989 / EAEC
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPGGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 6309 - protein, 162 aa, Escherichia coli; identical to SEQ ID NO: 5896
  strain 55989 / EAEC

SEQ ID NO: 6310 - protein, 367 aa, Escherichia coli
  strain 55989 / EAEC
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSARGEGMTNNGRDALRQNGDGVGGSITYDYEGFGIGAAVSSSKRTDAQNTAAYIGNGDRAETYTGGLKYDANNIYLAAQYTQTYNATRVGSLGWANKAQNFEAVAQYQFDFGLRPSVAYLQSKGKNLGTIGTRNYDDEDILKYVDVGATYYFNKNMSTYVDYKINLLDDNQFTRDAGINTDNIVALGLVYQF

SEQ ID NO: 6311 - protein, 200 aa, Escherichia coli
  strain 55989 / EAEC
MLAFCRSSLKSKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRLLQCGNEIYSAIKDLQSKAPDKNIVIFTHNHCLTYIAKNKRDATFKPDYLDGLVMHVEKGKVYLDGEFVNH

SEQ ID NO: 6312 - protein, 446 aa, Escherichia coli
  strain 55989 / EAEC
MMITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYNGDSKVNPNYGKAVTADFNGGSFGRGDSDEWTFGAQMEIWW

SEQ ID NO: 6313 - protein, 237 aa, Escherichia coli
  strain 55989 / EAEC
MRKITQAISAVCLLFALNSSAVALASSPSPLNPGTNVARLAEQAPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPVTNMNPVIFAGDKPGQNTKSQWLQDKNIRIFYGDSDNDITAARDVGARGIRILRASNSTYKPLPQAGAFGEEVIVNSEY

SEQ ID NO: 6314 - protein, 478 aa, Escherichia coli; identical to SEQ ID NO: 5711
  strain 55989 / EAEC

SEQ ID NO: 6315 - protein, 360 aa, Escherichia coli
  strain 55989 / EAEC
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRNEVTEANGDGFGFSTTYEYEGFGVGATYAKSDRTNNQVIYGNNGLNASGQNAEVWAAGLKYDANNIYLATTYSETQNMTVFGNNHIANKAQNFEAVAQYQFDFGLRPSVAYLHSKGKDLGVWGDQDLVEYVDVGATYYFNKNMSTFVDYKINLIDKSDFTKASGVATDDIVAVGMVYQF

SEQ ID NO: 6316 - protein, 274 aa, Escherichia coli
  strain 55989 / EAEC
MNKTAIALLALLASSASLAATPWQKITQPVPGSAQSIGSFSNGCIVGADTLPIQSEHYQVMRTDQRRYFGHPDLVMFIQRLSSQVSNLGMGTVLIGDMGMPAGGRFNGGHASHQTGLDVDIFLQLPKTRWTSAQLLRPQALDLVSRDGKHVVSTLWKPEIFSLIKLAAQDKDVTRIFVNPAIKQQLCLDAGTDRDWLRKVRPWFQHRAHMHVRLRCPADSLECEDQPLPPPGDGCGAELQSWFAPPKPGTTKPEKKTPSPLPPSCQALLDEHVI

SEQ ID NO: 6317 - protein, 250 aa, Escherichia coli
  strain 55989 / EAEC
MSDLLCSAKLGATTLALLLSAASLSAQASVTPDRTRLIFNESDKSISVTLRNNDPKLPYLAQSWIEDEKGNKISSPLTVLPPVQRIDSMMNGQVKVQGMPDINKLPADRESLFYFNVREIPPKSNKANTLQIALQTRIKLFWRPKALENVSMKNPWQYKVTLTRNGQEFTVNNPTPYYVIFSNASTQKNGNPAAGFSPIVMSPKTSAPLNVKMGSVPVLTYVNDYGARMPLFFTCNGNSCQVDEEQSRKG

SEQ ID NO: 6318 - protein, 880 aa, Escherichia coli
  strain 55989 / EAEC
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVANNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNRLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 6319 - protein, 759 aa, Escherichia coli
  strain 55989 / EAEC
MAQRQPEKTAAGGCFFNSLYSKYSGITMMRKKYMPRALGPLLLVVLSPAVAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLGQELVGQVYYRDESLRYYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLSLTKSVNVSDSKLEGVKVDSYELGWRFTGDNLRTQIAAYYSLSNKSVERNKDLTISVKDDRRRIYGVEGAVDYLIPDTDWSTGVNFNVLKTESKVNGQWQKYDVKESSPSKATAYINWAPEPWSLRVQSTTSFDVSDAEGNDINGYTTVDFISSWQLPVGTLSFSVENLFDRDYTTVWGQRAPLYYSPGYGPASLYDYKGRGRTFGLNYSVLF

SEQ ID NO: 6320 - protein, 696 aa, Escherichia coli
  strain 55989 / EAEC
MRITTLASVVIPCLGFSASSIAAAEDVMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPDLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 6321 - protein, 332 aa, Escherichia coli
  strain 55989 / EAEC
MMKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGNEAGHE

SEQ ID NO: 6322 - protein, 760 aa, Escherichia coli
  strain 55989 / EAEC
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPTGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 6323 - protein, 204 aa, Escherichia coli; identical to SEQ ID NO: 5755
  strain 55989 / EAEC

SEQ ID NO: 6324 - protein, 472 aa, Escherichia coli; identical to SEQ ID NO: 5729
  strain 55989 / EAEC

SEQ ID NO: 6325 - protein, 774 aa, Escherichia coli
  strain 55989 / EAEC
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPISLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 6326 - protein, 362 aa, Escherichia coli; identical to SEQ ID NO: 5809
  strain 55989 / EAEC

SEQ ID NO: 6327 - protein, 233 aa, Escherichia coli
  strain 55989 / EAEC
MKTCITKGIVTVSLTAILLSCSSAWAAGKGGIGLAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLGEAPAKLRCTSSADMVTVSNPTPYFITLTDLKIGGKVVKNQMISPFDKYQFSLPKGAKNSSVTYRTINDYGAETPQLNCKS

SEQ ID NO: 6328 - protein, 866 aa, Escherichia coli
  strain 55989 / EAEC
MYRTHRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGLPAQGAITVRWGEAPDQICHISYQLTEQQINSAITRMDAICR

SEQ ID NO: 6329 - protein, 236 aa, Escherichia coli
  strain 55989 / EAEC
MTNTWNRLALLIFAVLSLLVAGELRAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQLSVNGKALSNAGVVPPKSQRQTSWCQAIAPCHVAWRAINDYGGLSAKKEQNLP

SEQ ID NO: 6330 - protein, 432 aa, Escherichia coli; identical to SEQ ID NO: 5727
  strain 55989 / EAEC

SEQ ID NO: 6331 - protein, 511 aa, Escherichia coli; identical to SEQ ID NO: 5749
  strain 55989 / EAEC

SEQ ID NO: 6332 - protein, 359 aa, Escherichia coli
  strain 55989 / EAEC
MKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLQSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 6333 - protein, 170 aa, Escherichia coli [sequence omitted]

SEQ ID NO: 6334 - protein, 232 aa, Escherichia coli; identical to SEQ ID NO: 5747
  strain 55989 / EAEC

SEQ ID NO: 6335 - protein, 365 aa, Escherichia coli
  strain 55989 / EAEC
MIKFLSALILLLVTTAAQAERIRDLTSVQGVRQNSLIGYGLVVGLDGTGDQTTQTPFTTQTLNNMLSQLGITVPTGTNMQLKNVAAVMVTASLPPFGRQGQTIDVVVSSMGNAKSLRGGTLLMTPLKGVDSQVYALAQGNILVGGAGASAGGSSVQVNQLNGGRITNGAVIERELPSQFGVGNTLNLQLNDEDFSMAQQIADTINRVRGYGSATALDARTIQVRVPSGNSSQVRFLADIQNMQVNVTPQDAKVVINSRTGSVVMNREVTLDSCAVAQGNLSVTVNRQANVSQPDTPFGGGQTVVTPQTQIDLRQSGGSLQSVRSSASLNNVVRALNALGATPMDLMSILQSMQSAGCLRAKLEII

SEQ ID NO: 6336 - protein, 729 aa, Escherichia coli
  strain 55989 / EAEC
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGIYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGTPRNFSITGTYQF

SEQ ID NO: 6337 - protein, 213 aa, Escherichia coli; identical to SEQ ID NO: 5744
  strain 55989 / EAEC

SEQ ID NO: 6338 - protein, 191 aa, Escherichia coli; identical to SEQ ID NO: 5748
  strain 55989 / EAEC

SEQ ID NO: 6339 - protein, 686 aa, Escherichia coli
  strain 55989 / EAEC
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 6340 - protein, 837 aa, Escherichia coli
  strain 55989 / EAEC
MEQMYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEEAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSFSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDNYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 6341 - protein, 866 aa, Escherichia coli
  strain 55989 / EAEC
MTIKPTKNYHNHLTRIATFCALLYCNSAFCAELVEYDHTFLMGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTIMQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSAGAFSFDVTHSNVRIPDDKTYQGQSYRVSWNKLFEETSTSLNIAAYRYSTQNYLGLNDTLTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEKGNVIGNVGQGGQAFVRGIEQQGNISIKWLEESKPVSCLAHYQQSSEAEKIAQSIILNGIRCQIQ

SEQ ID NO: 6342 - protein, 246 aa, Escherichia coli
  strain 55989 / EAEC
MFFNTKHTTALCFVTCMAFSSSSIADIVISGTRVIYKSDQKSVNVRLENKGNNPLLVQSWLDTGDDNAEPGSITVPFTATPPVSRIDAKRGQTIKLMYTASTSLPKDRESVFWFNVLEVPPKPDAEKVANQSLLQLAFRTRIKLFYRPDGLKGNPSEAPLALKWFWSGSEGKASLRVTNPTPYYVSFSSGDLEASGKRYPIDVKMIAPFSDEVMKVTGLNGKASSAKVHFYAINDFGGAIEGNASL

SEQ ID NO: 6343 - protein, 747 aa, Escherichia coli
  strain 55989 / EAEC
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 6344 - protein, 266 aa, Escherichia coli; identical to SEQ ID NO: 5772
  strain 55989 / EAEC

SEQ ID NO: 6345 - protein, 810 aa, Escherichia coli
  strain 55989 / EAEC
MAMKKLLIASLLFSSATVYGAEGFVVKDIHFEGLQRVAVGAALLSMPVRTGDTVNDEDISNTIRALFATGNFEDVRVLRDGDTLLVQVKERPTIASITFSGNKSVKDDMLKQNLEASGVRVGESLDRTTIADIEKGLEDFYYSVGKYSASVKAVVTPLPRNRVDLKLVFQEGVSAEIQQINIVGNHAFTTDELISHFQLRDEVPWWNVVGDRKYQKQKLAGDLETLRSYYLDRGYARFNIDSTQVSLTPDKKGIYVTVNITEGDQYKLSGVEVSGNLAGHSAEIEQLTKIEPGELYNGTKVTKMEDDIKKLLGRYGYAYPRVQSMPEINDADKTVKLRVNVDAGNRFYVRKIRFEGNDTSKDAVLRREMRQMEGAWLGSDLVDQGKERLNRLGFFETVDTDTQRVPGSPDQVDVVYKVKERNTGSFNFGIGYGTESGVSFQAGVQQDNWLGTGYAVGINGTKNDYQTYAELSVTNPYFTVDGVSLGGRLFYNDFQADDADLSDYTNKSYGTDVTLGFPINEYNSLRAGLGYVHNSLSNMQPQVAMWRYLYSMGEHPSTSDQDNSFKTDDFTFNYGWTYNKLDRGYFPTDGSRVNLTGKVTIPGSDNEYYKVTLDTATYVPIDDDHKWVVLGRTRWGYGDGLGGKEMPFYENFYAGGSSTVRGFQSNTIGPKAVYFPHQASNYDPDYDYECATQDGAKDLCKSDDAVGGNAMAVASLEFITPTPFISDKYANSVRTSFFWDMGTVWDTNWDSSQYSGYPDYSDPSNIRMSAGIALQWMSPLGPLVFSYAQPFKKYDGDKAEQFQFNIGKTW

SEQ ID NO: 6346 - protein, 161 aa, Escherichia coli; identical to SEQ ID NO: 5769
  strain 55989 / EAEC

SEQ ID NO: 6347 - protein, 203 aa, Escherichia coli
  strain 55989 / EAEC
MKLRWFAFLIVLLAGCSSKHDYTNPPWNAKVPVQRAMQWMPISQKAGAAWGVDPQLITAIIAIESGGNPNAVSKSNAIGLMQLKASTSGRDVYRRMGWSGEPTTSELKNPERNISMGAAYLNILETGPLAGIEDPKVLQYALVVSYANGAGALLRTFSSDRKKAISKINDLDADEFLDHVARNHPAPQAPRYIYKLEQALDAM

SEQ ID NO: 6348 - protein, 565 aa, Escherichia coli
  strain 55989 / EAEC
MKSPAPSRPQKMALIPACIFLCFAALSVQAEETPVTPQPPDILLGPLFNDVQNAKLFPDQKTFADAMPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 6349 - protein, 207 aa, Escherichia coli; identical to SEQ ID NO: 5743
  strain 55989 / EAEC

SEQ ID NO: 6350 - protein, 249 aa, Escherichia coli
  strain 55989 / EAEC
MRYLNTKNLIAAGVLLACMSSIAWGAIIPDRTRIIMNESDKGEALKLTNQSKNLPYLAQTWKEDTKGNKSRDFIVTVPPMVRLNPSEQIQIRMISQEKIAQLPNDRETLFYFNVREIPPKTDKKNVMQVTMQHALKLFWRPKAIELEDDGVMSYEKVEIIRRNDGSIRFNNKMPYHVTLGYIGTNGITMLPQTQSLMVTPYSHADTQFKNVPSAFQVGYINDFGGLSFYEINCPTVNNSCNVSVAKRDK

SEQ ID NO: 6351 - protein, 231 aa, Escherichia coli
  strain 55989 / EAEC
MSKRTFAVIITLLCSFCIGQALAGGIVLQRTRVIYDASRKEAALPVANKGAETPYLLQSWVDNIDGTSRAPFIITPPLFRLEAGDDSSLRIIKTADNLPENKESLFYINVRAIPAKKKSDDVNANELTLVFKTRIKMFYRPAHLKGRVNDAWTSLEFKRSDHSLNIYNPTEYYVVFAGLAVDKTDLTSKIEYIAPGEHKQLPLPASGGKNVKWAAINDYGGSSGTETRPLQ

SEQ ID NO: 6352 - protein, 838 aa, Escherichia coli
  strain 55989 / EAEC
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWNYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 6353 - protein, 678 aa, Escherichia coli
  strain 55989 / EAEC
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPAPVSTPAATTTAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGTPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 6354 - protein, 331 aa, Escherichia coli; identical to SEQ ID NO: 5720
  strain 55989 / EAEC

SEQ ID NO: 6355 - protein, 120 aa, Escherichia coli; identical to SEQ ID NO: 5917
  strain 55989 / EAEC

SEQ ID NO: 6356 - protein, 849 aa, Escherichia coli
  strain 55989 / EAEC
MLHINSMVKVCFFVIIAFSLFHTRNSDGKTYSFDASLLKRRGEGVDLTLFENGGQLPGIYPVDIFLNGTIVGSEDIFFHAEHSNGKPYLKACLSEELLMRYGVKTEKYPKLFLSHYGKKDERQCADLSVIPQATEEFLFEAQKLVLSIPQVAIRSPLRGVASDLIWEDGISTFLLNWQVEAGHSEFQHYEKTTSDNFWVSLEPGINIGPWRIRNLTTLNKSSGQVGKWESSYIRAERGLNNIKSRLTLGEDYTPADIFASVPFRGVMLGTDENMIPYDQRGFAPVIRGIARTQARIEIRQNGYLIQSQTVAAGPFALTDLPITGSGGEFQVTIFESDGAIQSFNVPFTTPAIALREGYLKYNISAGQYRSSDESVEKAYLWQATAMYGLPRALTVFGGVQTAEHYQAAALGVGLSLGNMGAASLDTIYSRGQQKGYDFDTGNSWRIRYDKSFELTDTSFSAASYQYSNEGYHELSDILDTYRSGANFVFNDTDRKRRRITININQSLGPWGFIGLSGGRDEYKGGDRQDYIGASYSMSWKDISFSVNWTRNRNVGDYFSNRTFNEDTVGMWMSIPLKHWLGKNDNDVNATAQIQHSTRQNTRYEMGLNGRAFDQKLYWDIREQIVPGSKYDADTSRLNMRWSGSYGELVGMYSYNSHTRQMNAGMSGSIAMHSEGITFGQRFGDTMALIAAPGVRGASVGGWPGVSTDSRGYALVSYITPYQENIITLDPTTFPENAEVLQTDTRVVPTKGAVVRAKFKTRVGNRAVVRLARADGTPLPFGTVVTLEGKTEVSNSTGVVDDKGMVYLSGLSEAGKLKAQWGMNSHCYANYRLPVKKGPAGLYLTSAVCI

SEQ ID NO: 6357 - protein, 250 aa, Escherichia coli; identical to SEQ ID NO: 6203
  strain 55989 / EAEC

SEQ ID NO: 6358 - protein, 518 aa, Escherichia coli
  strain ATCC 33849 / DSM 4235 / NCIB 12045 / K12 / DH1
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKETKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 6359 - protein, 867 aa, Escherichia coli
  strain ATCC 33849 / DSM 4235 / NCIB 12045 / K12 / DH1
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADASRHEGDSIRFLYAKSMNTFGTNFQLMGYRYSTQGFYTLDDVAYRRMEGYEYDYDGEHRDEPIIVNYHNLRFSRKDRLQLNVSQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGGGYNYDRDQHDVNWQLSGGVVGHENGITLSQPLGDTNVLIKAPGAGGVRIENQTGILTDWRGYAVMLYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 6360 - protein, 230 aa, Escherichia coli
  strain ATCC 33849 / DSM 4235 / NCIB 12045 / K12 / DH1
MMTKIKLLMLIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 6361 - protein, 250 aa, Escherichia coli
  strain ATCC 33849 / DSM 4235 / NCIB 12045 / K12 / DH1
MSDLLCSAKLGAMTLALLLSATSLSALASVTPDRTRLIFNESDKSISVTLRNNDPKLPYLAQSWIEDEKGNKITSPLTVLPPVQRIDSMMNGQVKVQGMPDINKLPADRESMFYFNVREIPPKSNKPNTLQIALQTRIKLFWRPKALEKVSMKSPWQHKVTLTRSGQAFTVNNPTPYYVIISNASAQKNGNPAAGFSPLVIEPKTTVPLNVKMDSVPVLTYVNDFGARMPLFFQCNGNSCQVDEEQSRKG

SEQ ID NO: 6362 - protein, 274 aa, Escherichia coli
  strain ATCC 33849 / DSM 4235 / NCIB 12045 / K12 / DH1
MNKTAIALLALLASSASLAATPWQKITQPVPGSAQSIGSFSNGCIVGADTLPIQSEHYQVMRTDQRRYFGHPDLVMFIQRLSSQVSNLGMGTVLIGDMGMPAGGRFNGGHASHQTGLDVDIFLQLPKTRWTSAQLLRPQALDLVSRDGKHVVSTLWKPEIFSLIKLAAQDKDVTRIFVNPAIKQQLCLDAGTDRDWLRKVRPWFQHRAHMHVRLRCPADSLECEDQPLPPSGDGCGAELQSWFEPPKPGTTKPEKKTPPPLPPSCQALLDEHVI

SEQ ID NO: 6363 - protein, 200 aa, Escherichia coli
  strain ATCC 33849 / DSM 4235 / NCIB 12045 / K12 / DH1
MLAFCRSSLKSKKYIIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRLLQCGNEIYSAIKDLQSKAPDKNIVIFTHNHCLTYIAKDKRDATFKPDYLDGLVMHVEKGKVYLDGEFVNH

SEQ ID NO: 6364 - protein, 367 aa, Escherichia coli; identical to SEQ ID NO: 5789
  strain ATCC 33849 / DSM 4235 / NCIB 12045 / K12 / DH1

SEQ ID NO: 6365 - protein, 162 aa, Escherichia coli
  strain ATCC 33849 / DSM 4235 / NCIB 12045 / K12 / DH1
MKTILPAVLFAAFATTSAWAAESVQPLEKIAPYPQAEKGMKRQVIQLTPQEDESTLKVELLIGQTLEVDCNLHRLGGKLENKTLEGWGYDYYVFDKVSSPVSTMMACPDGKKEKKFVTAYLGDAGMLRYNSKLPIVVYTPDNVDVKYRVWKAEEKIDNAVVR

SEQ ID NO: 6366 - protein, 828 aa, Escherichia coli
  strain ATCC 33849 / DSM 4235 / NCIB 12045 / K12 / DH1
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEDLLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 6367 - protein, 351 aa, Escherichia coli
  strain ATCC 33849 / DSM 4235 / NCIB 12045 / K12 / DH1
MKKSTLALVVMGIVASASVQAAEIYNKDGNKLDVYGKVKAMHYMSDNASKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 6368 - protein, 161 aa, Escherichia coli; identical to SEQ ID NO: 5769
  strain ATCC 33849 / DSM 4235 / NCIB 12045 / K12 / DH1

SEQ ID NO: 6369 - protein, 266 aa, Escherichia coli; identical to SEQ ID NO: 5772
  strain ATCC 33849 / DSM 4235 / NCIB 12045 / K12 / DH1

SEQ ID NO: 6370 - protein, 747 aa, Escherichia coli; identical to SEQ ID NO: 6343
  strain ATCC 33849 / DSM 4235 / NCIB 12045 / K12 / DH1

SEQ ID NO: 6371 - protein, 663 aa, Escherichia coli; identical to SEQ ID NO: 6307
  strain ATCC 33849 / DSM 4235 / NCIB 12045 / K12 / DH1

SEQ ID NO: 6372 - protein, 224 aa, Escherichia coli
  strain ATCC 33849 / DSM 4235 / NCIB 12045 / K12 / DH1
MKGLLSLLIFSMVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKSNNANNWHLTIIDDHGNYISDKI

SEQ ID NO: 6373 - protein, 826 aa, Escherichia coli
  strain ATCC 33849 / DSM 4235 / NCIB 12045 / K12 / DH1
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYLSQYYSDYKASGNNKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDLAAGRSHIEGASKQSDFVQAGYQYGFNNLLTLYGGSMVANNYYAFTLGAGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQSLTFGYEVNDIHGHNIGVVGQGSQLFIRTNEVPPSVNVAIDKQQGLSCTITFGKEIDESRNYICQ

SEQ ID NO: 6374 - protein, 246 aa, Escherichia coli
  strain ATCC 33849 / DSM 4235 / NCIB 12045 / K12 / DH1
MFFNTKHTTALCFVTCMAFSSSSIADIVISGTRVIYKSDQKSVNARLENKGNNPLLVQSWLDTGDDNAEPGSITVPFTATPPVSRIDAKRGQTIKLMYTASTSLPKDRESVFWFNVLEVPPKPDAEKVANQSLLQLAFRTRIKLFYRPDGLKGNPSEAPLALKWFWSGSEGKASLRVTNPTPYYVSFSSGDLEASGKRYPIDVKMIAPFSDEVMKVNGLNGKANSAKVHFYAINDFGGAIEGNARL

SEQ ID NO: 6375 - protein, 865 aa, Escherichia coli
  strain ATCC 33849 / DSM 4235 / NCIB 12045 / K12 / DH1
MTIEYTKNYHHLTRIATFCALLYCNTAFSAELVEYDHTFLMGQNASNIDLSRYSEGNPAIPGVYDVSVYVNDQPIINQSITFVAIEGKKNAQACITLKNLLQFHINSPDINNEKAVLLARDETLGNCLNLTEIIPQASVRYDVNDQRLDIDVPQAWVMKNYQNYVDPSLWENGINAAMLSYNLNGYHSETPGRKNESIYAAFNGGMNLGAWRLRASGNYNWMTDSGSNYDFKNRYVQRDIASLRSQLILGESYTTGETFDSVSIRGIRLYSDSRMLPPTLASFAPIIHGVANTNAKVTITQGGYKIYETTVPPGAFVIDDLSPSGYGSDLIVTIEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSTSWGSYSVSAQRSWNEDGDTDDSVYLSFTIPIEKLLGTEQRTSGFQSIDTQISSDFKGNNQLNVSSSGYSDNARVSYSVNTGYTMNKASKDLSYVGGYASYESPWGTLAGSISANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEQSKPVSCLAHYQQSPEAEKIAQSIILNGIRCQIQ

SEQ ID NO: 6376 - protein, 784 aa, Escherichia coli; identical to SEQ ID NO: 6283
  strain ATCC 33849 / DSM 4235 / NCIB 12045 / K12 / DH1

SEQ ID NO: 6377 - protein, 334 aa, Escherichia coli
  strain ATCC 33849 / DSM 4235 / NCIB 12045 / K12 / DH1
MKKNQFLKESDVTAESVFFMKRRQVLKALGISATALSLPHAAHADLLSWFKGNDRPPAPAGKALEFSKPAAWQNNLPLTPADKVSGYNNFYEFGLDKADPAANAGSLKTDPWTLKISGEVAKPLTLDHDDLTRRFPLEERIYRMRCVEAWSMVVPWIGFPLHKLLALAEPTSNAKYVAFETIYAPEQMPGQQDRFIGGGLKYPYVEGLRLDEAMHPLTLMTVGVYGKALPPQNGAPVRLIVPWKYGFKGIKSIVSIKLTRERPPTTWNLAAPDEYGFYANVNPYVDHPRWSQATERFIGSGGILDVQRQPTLLFNGYADQVASLYRGLDLRENF

SEQ ID NO: 6378 - protein, 878 aa, Escherichia coli
  strain ATCC 33849 / DSM 4235 / NCIB 12045 / K12 / DH1
MSYLNLRLYQRNTQCLHIRKHRLAGFFVRLVVACAFAAQAPLSSADLYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKTRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 6379 - protein, 241 aa, Escherichia coli
  strain ATCC 33849 / DSM 4235 / NCIB 12045 / K12 / DH1
MSNKNVNVRKSQEITFCLLAGILMFMAMMVAGRAEAGVALGATRVIYPAGQKQEQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 6380 - protein, 368 aa, Escherichia coli
  strain ATCC 33849 / DSM 4235 / NCIB 12045 / K12 / DH1
MNKTITALAIMMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLITVKDNKVTVQN

SEQ ID NO: 6381 - protein, 118 aa, Escherichia coli
  strain ATCC 33849 / DSM 4235 / NCIB 12045 / K12 / DH1
MKKRGAFLGLLLVSACASVFAANNETSKSVTFPKCEDLDAAGIAASVKRDYQQNRVARWADDQKIVGQADPVAWVSLQDIQGKDDKWSVPLTVRGKSADIHYQVSVDCKAGMAEYQRR

SEQ ID NO: 6382 - protein, 774 aa, Escherichia coli
  strain ATCC 33849 / DSM 4235 / NCIB 12045 / K12 / DH1
MTPLRVFRKTTPLVNTIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 6383 - protein, 478 aa, Escherichia coli; identical to SEQ ID NO: 5711
  strain ATCC 33849 / DSM 4235 / NCIB 12045 / K12 / DH1

SEQ ID NO: 6384 - protein, 237 aa, Escherichia coli
  strain ATCC 33849 / DSM 4235 / NCIB 12045 / K12 / DH1
MRKITQAISAVCLLFALNSSAVALASSPSPLNPGTNVARLAEQAPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPATNMNPVIFAGDKPGQNTKSQWLQDKNIRIFYGDSDNDITAARDVGARGIRILRASNSTYKPLPQAGAFGEEVIVNSEY

SEQ ID NO: 6385 - protein, 102 aa, Escherichia coli
  strain ATCC 33849 / DSM 4235 / NCIB 12045 / K12 / DH1
MKKVLALVVAAAMGLSSAAFAAETTTTPAPTATTTKAAPAKTTHHKKQHKAAPAQKAQAAKKHHKNTKAEQKAPEQKAQAAKKHAKKHSHQQPAKPAAQPAA

SEQ ID NO: 6386 - protein, 446 aa, Escherichia coli [sequence omitted]

SEQ ID NO: 6387 - protein, 614 aa, Escherichia coli
  strain ATCC 33849 / DSM 4235 / NCIB 12045 / K12 / DH1
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 6388 - protein, 700 aa, Escherichia coli
  strain ATCC 33849 / DSM 4235 / NCIB 12045 / K12 / DH1
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSSRDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNLGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 6389 - protein, 208 aa, Escherichia coli; identical to SEQ ID NO: 5717
  strain ATCC 33849 / DSM 4235 / NCIB 12045 / K12 / DH1

SEQ ID NO: 6390 - protein, 412 aa, Escherichia coli
  strain ATCC 33849 / DSM 4235 / NCIB 12045 / K12 / DH1
MKQWIAALLLMLIPGVQAAKPQKVTLMVDDVPVAQVLQALAEQEKLNLVVSPDVSGTVSLHLTDVPWKQALQTVVKSAGLITRQEGNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 6391 - protein, 539 aa, Escherichia coli
  strain ATCC 33849 / DSM 4235 / NCIB 12045 / K12 / DH1
MAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFSEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 6392 - protein, 897 aa, Escherichia coli
  strain ATCC 33849 / DSM 4235 / NCIB 12045 / K12 / DH1
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKSNDASNPWRYVRAATATEISETSNPQSCTSAPQPSPDVKPAPDVKPAPDVQPAPADKSNDNYAVVAWKGQEGSSTWYVIYNGGIYKNAWWVGAANCPGDAKENDASNPWRYVRAATATEISQYGNPGSCSVKPDNNGGAVTPVDPTPETPVTPTPDNSEPSTPADSVNDYSLQAWSGQEGSEIYHVIFNGNVYKNAWWVGSKDCPRGTSAENSNNPWRLERTATAAELSQYGNPTTCEIDNGGVIVADGFQASKAYSADSIVDYNDAHYKTSVDQDAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLIRFNGVNYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLKVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 6393 - protein, 650 aa, Escherichia coli
  strain ATCC 33849 / DSM 4235 / NCIB 12045 / K12 / DH1
MKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNARKPSSSGAMDNVAITADEQTNSLVITADQSVQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQQRIDGKSKALVGSEDLPVLDENTFNSHAPAPSSR

SEQ ID NO: 6394 - protein, 207 aa, Escherichia coli; identical to SEQ ID NO: 5743
  strain ATCC 33849 / DSM 4235 / NCIB 12045 / K12 / DH1

SEQ ID NO: 6395 - protein, 565 aa, Escherichia coli
  strain ATCC 33849 / DSM 4235 / NCIB 12045 / K12 / DH1
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 6396 - protein, 203 aa, Escherichia coli
  strain ATCC 33849 / DSM 4235 / NCIB 12045 / K12 / DH1
MKLRWFAFLIVLLAGCSSKHDYTNPPWNAKVPVQRAMQWMPISQKAGAAWGVDPQLITAIIAIESGGNPNAVSKSNAIGLMQLKASTSGRDVYRRMGWSGEPTTSELKNPERNISMGAAYLNILETGPLAGIEDPKVLQYALVVSYANGAGALLRTFSSDRKKAISKINDLDADEFLEHVARNHPAPQAPRYIYKLEQALDAM

SEQ ID NO: 6397 - protein, 793 aa, Escherichia coli
  strain ATCC 33849 / DSM 4235 / NCIB 12045 / K12 / DH1
MLKKTLLAYTIGFAFSPPANADGIEIAAVDFDRETLKSLGVDPNISHYFSRSARFLPGEYSLIVSVNGEKKGNIATRFDENGDICLDQAFLQQAGLKIPSEEKNGCYDYILSYPGTTITPLPNQEALDIIVSPQAIIPIGLDLTNAATGGTAALLNYSLMSSRAEFSNGSSDYSQAALEGGININDWMLRSHQFLTQTNGTFSNQNSSTYLQRTFTDLKTLMRAGEVNLNNSVLEGASIYGIEIAPDNALQTSGSGVQVTGIANTSQARVEIRQQGVLIHSILVPAGAFTIPDVPVRNGNSDLNVTVVETDGSSHNYIVPSTLFNQHVESFQGYRFAIGRVDDDYDESPWVISASSGWNLTRWSAMNGGVIVAENYQAASIRSSLVPLPDLTVSSQISTSQDTKDSLQGQKYRLDANYNLPFSLGLTTSLTRSDRHYRELSEAIDDDYTDPTKSTYALGLNWSNSILGGFNISGYKTYSYDGDNDSSNLNINWNKAFKHATVSVNWQHQLSASENNEDDGDLFYVNISIPFGRSNTATLYTRHDDHKTHYGTGVMGVVSDEMSYYVNAERDHDERETSLNGSISSNLHYTQVSLAAGASGSDSRTYNGTMSGGIAVHDQGVTFSPWTINDTFAIAKMDNNIAGVRITSQAGPVWTDFRGNAVIPSIQPWRTSGVEIDTASLPKNVDIGNGTKMIKQGRGAVGKVGFSAITQRRALLNITLSDGKKLPRGVAIEDSEGNYLTTSVDDGVVFLNNIKPDMVLDIKDEQQSCRIHLTFPEDAPKDVFYETATGECQ

SEQ ID NO: 6398 - protein, 678 aa, Escherichia coli
  strain ATCC 33849 / DSM 4235 / NCIB 12045 / K12 / DH1
MVPSTFSRLKAARCLPVVLAALIFAGCGTHTPDQSTAYMQGTAQADSAFYLQQMQQSSDDTRINWQLLAIRALVKEGKTGQAVELFNQLPQELNDAQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITLRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRNLSWLQYQQGQVVPVS

SEQ ID NO: 6399 - protein, 838 aa, Escherichia coli
  strain ATCC 33849 / DSM 4235 / NCIB 12045 / K12 / DH1
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQQLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVSAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWDYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 6400 - protein, 231 aa, Escherichia coli
  strain ATCC 33849 / DSM 4235 / NCIB 12045 / K12 / DH1
MSKRTFAVILTLLCSFCIGQALAGGIVLQRTRVIYDASRKEAALPVANKGAETPYLLQSWVDNIDGKSRAPFIITPPLFRLEAGDDSSLRIIKTADNLPENKESLFYINVRAIPAKKKSDDVNANELTLVFKTRIKMFYRPAHLKGRVNDAWKSLEFKRSDHSLNIYNPTEYYVVFAGLAVDKTDLTSKIEYIAPGEHKQLPLPASGGKNVKWAAINDYGGSSGTETRPLQ

SEQ ID NO: 6401 - protein, 213 aa, Escherichia coli; identical to SEQ ID NO: 5744
  strain ATCC 33849 / DSM 4235 / NCIB 12045 / K12 / DH1

SEQ ID NO: 6402 - protein, 729 aa, Escherichia coli
  strain ATCC 33849 / DSM 4235 / NCIB 12045 / K12 / DH1
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQQFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGTPRNFSITGTYQF

SEQ ID NO: 6403 - protein, 365 aa, Escherichia coli; identical to SEQ ID NO: 6335
  strain ATCC 33849 / DSM 4235 / NCIB 12045 / K12 / DH1

SEQ ID NO: 6404 - protein, 235 aa, Escherichia coli
  strain ATCC 33849 / DSM 4235 / NCIB 12045 / K12 / DH1
MIAMQKNAAHTYAISSLLVLSLTGCAWIPSTPLVQGATSAQPVPGPTPVANGSIFQSAQPINYGYQPLFEDRRPRNIGDTLTIVLQENVSASKSSSANASRDGKTNFGFDTVPRYLQGLFGNARADVEASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 6405 - protein, 191 aa, Escherichia coli; identical to SEQ ID NO: 5748
  strain ATCC 33849 / DSM 4235 / NCIB 12045 / K12 / DH1

SEQ ID NO: 6406 - protein, 517 aa, Escherichia coli
  strain ATCC 33849 / DSM 4235 / NCIB 12045 / K12 / DH1
MKHKLQMMKMRWLSAAVMLTLYTSSSWAFSIDDVAKQAQSLAGKGYETPKSNLPSVFRDMKYADYQQIQFNHDKAYWNNLKTPFKLEFYHQGMYFDTPVKINEVTATAVKRIKYSPDYFTFGDVQHDKDTVKDLGFAGFKVLYPINSKDKNDEIVSMLGASYFRVIGAGQVYGLSARGLAIDTALPSGEEFPRFKEFWIERPKPTDKRLTIYALLDSPRATGAYKFVVMPGRDTVVDVQSKIYLRDKVGKLGVAPLTSMFLFGPNQPSPANNYRPELHDSNGLSIHAGNGEWIWRPLNNPKHLAVSSFSMENPQGFGLLQRGRDFSRFEDLDDRYDLRPSAWVTPKGEWGKGSVELVEIPTNDETNDNIVAYWTPDQLPEPGKEMNFKYTITFSRDEDKLHAPDNAWVQQTRRSTGDVKQSNLIRQPDGTIAFVVDFTGAEMKKLPEDTPVTAQTSIGDNGEIVESTVRYNPVTKGWRLVMRVKVKDAKKTTEMRAALVNADQTLSETWSYQLPANE

SEQ ID NO: 6407 - protein, 249 aa, Escherichia coli
  strain ATCC 33849 / DSM 4235 / NCIB 12045 / K12 / DH1
MRYLNTKNIIAAGVLLSCMSSIAWGAIIPDRTRIIMNESDKGEALKLTNQSKNLPYLAQTWIEDTKGNKSRDFIVTVPPMVRLNPSEQIQIRMITQEKIAQLPKDRETLFYFNVREIPPKTDKKNVMQVTMQHALKLFWRPKAIELEDDGVMTYEKVEIIRRNDGSIRFNNKMPYHVTLGYIGTNGVTMLPQTQSLMVTPFSYANTQFKNVPSTFQVGYINDFGGLSFYEINCPVVNNICNISVANRDQ

SEQ ID NO: 6408 - protein, 821 aa, Escherichia coli
  strain ATCC 33849 / DSM 4235 / NCIB 12045 / K12 / DH1
MSGNIGANPVIIIGCASAYAVEFNKDLIEAEDRENVNLSQFETDGQLPVGKYSLSTLINNKRTPIHLDLQWVLIDNQTAVCVTPEQLTLLGFTDEFIEKTQQNLIDGCYPIEKEKQITTYLDKGKMQLSISAPQAWLKYKDANWTPPELWNHGIAGAFLDYNLYASHYAPHQGDNSQNISSYGQAGVNLGAWRLRTDYQYDQSFNNGKSQATNLDFPRIYLFRPIPAMNAKLTIGQYDTESSIFDSFHFSGISLKSDENMLPPDLRGYAPQITGVAQTNAKVTVSQNNRIIYQENVPPGPFAITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNEISHTASWYDSSDRNNSWSVSASGDNDEFKDMKASLRASYQHNTENGRLYLSGTSQRDSYYSLNASWNGSFTATRHGAAFHDYSGSADSRFMIDADGTEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTAILPCISQN

SEQ ID NO: 6409 - protein, 236 aa, Escherichia coli
  strain ATCC 33849 / DSM 4235 / NCIB 12045 / K12 / DH1
MTNTWNRLALLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNVGVVPPKSQRQTSWCQAIAPCHVAWRAINDYGGLSAKKEQNLP

SEQ ID NO: 6410 - protein, 866 aa, Escherichia coli
  strain ATCC 33849 / DSM 4235 / NCIB 12045 / K12 / DH1
MYRTHRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNHLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGISWNYSKSRGQPDADQVFALNFSLPLNLLLPRSNDSYTRKKNYAWMTSNTSIDNEGHTTQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGVQANSGIIDDDGSLYMAGLPAKGTISVRWGEAPDQICHINYELTEQQINSAITRMDAICR

SEQ ID NO: 6411 - protein, 233 aa, Escherichia coli
  strain ATCC 33849 / DSM 4235 / NCIB 12045 / K12 / DH1
MKTCITKGIVTVSLTAILLSCSSAWAAGKGGIGLAATRLVYSEGEEQISLGVRNTSPDVPYLIQSWVMTPDNKKSADFIITPPLFVLNPANENLLRIMYIGAPLAKDRETLFFTSVRAVPSTTKRKEGNTLKIATQSVIKLFWRPKGLAYPLGEAPAKLRCTSSADMVTVSNPTPYFITLTDLKIGGKVVKNQMISPFDKYQFSLPKGAKNSSVTYRTINDYGAETPQLNCKS

SEQ ID NO: 6412 - protein, 362 aa, Escherichia coli; identical to SEQ ID NO: 5809
  strain ATCC 33849 / DSM 4235 / NCIB 12045 / K12 / DH1

SEQ ID NO: 6413 - protein, 360 aa, Escherichia coli
  strain ATCC 33849 / DSM 4235 / NCIB 12045 / K12 / DH1
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRANNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 6414 - protein, 203 aa, Escherichia coli
  strain ATCC 33849 / DSM 4235 / NCIB 12045 / K12 / DH1
MKKIAITCALLSSLVASSVWADAASDLKSRLDKVSSFHASFTQKVTDGSGAAVQEGQGDLWVKRPNLFNWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKSQQNGAVDAAKFTFTPPQGVTVDDQRK

SEQ ID NO: 6415 - protein, 760 aa, Escherichia coli
  strain ATCC 33849 / DSM 4235 / NCIB 12045 / K12 / DH1
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPTGVAKGSPVTTVDTAKSGNLMNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 6416 - protein, 432 aa, Escherichia coli; identical to SEQ ID NO: 5727
  strain ATCC 33849 / DSM 4235 / NCIB 12045 / K12 / DH1

SEQ ID NO: 6417 - protein, 331 aa, Escherichia coli
  strain ATCC 33849 / DSM 4235 / NCIB 12045 / K12 / DH1
MKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRNEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGDEAGHE

SEQ ID NO: 6418 - protein, 430 aa, Escherichia coli; identical to SEQ ID NO: 5758
  strain ATCC 33849 / DSM 4235 / NCIB 12045 / K12 / DH1

SEQ ID NO: 6419 - protein, 818 aa, Escherichia coli
  strain ATCC 33849 / DSM 4235 / NCIB 12045 / K12 / DH1
MDTVNIYRLSFVSCLVMAMPCAMAVEFNLNVLDKSMRDRIDISLLKEKGVIAPGEYFVSVAVNNNKISNGQKINWQKKGDKTIPCINDSLVDKFGLKPDIRQSLPQIDRCIDFSSRPEMLFNFDQANQQLNISIPQAWLAWHSENWAPPSTWKEGVAGVLMDYNLFASSYRPQDGSSSTNLNAYGTAGINAGAWRLRSDYQLNKTDSEDNHDQSGGISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLISDDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTIHRMSWNDTLDERNSWGMSAGLQSDRPDNGAQVSGNYQHLSSAGEWDISGTYAASDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQLFTVVWGEQSCIIHLPERLEDTTKRLILPCH

SEQ ID NO: 6420 - protein, 242 aa, Escherichia coli
  strain ATCC 33849 / DSM 4235 / NCIB 12045 / K12 / DH1
MTFIKGLPLMLLTISLGCNAAVQPDRTRIVFNANDKATSLRIENQSDKLPYLAYSWIENEKGEKSDALLVALPPIQRLEPKATSQVRVVKQASTTQLPGDRETLFFYNMREIPPAPDKSSDHAILQVAIQSRIKLFWRPAALRKKAGEKVELQLQVSQQGNQLTLKNPTAYYLTIAYLGRNEKGVLPGFKTVMVAPFSTVNTNTGSYSGSQFYLGYMDDYGALRMTTLNCSGQCRLQAVEAK

SEQ ID NO: 6421 - protein, 193 aa, Escherichia coli; identical to SEQ ID NO: 6300
  strain ATCC 33849 / DSM 4235 / NCIB 12045 / K12 / DH1

SEQ ID NO: 6422 - protein, 746 aa, Escherichia coli
  strain ATCC 33849 / DSM 4235 / NCIB 12045 / K12 / DH1
MNKKIHSLALLVNLGIYGVAQAQEPTDTPVSHDDTIVVTAAEQNLQAPGVSTITADEIRKNPVARDVSKIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSTTDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 6423 - protein, 672 aa, Escherichia coli
  strain ATCC 33849 / DSM 4235 / NCIB 12045 / K12 / DH1
MIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSSRDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNLGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 6424 - protein, 813 aa, Escherichia coli
  strain ATCC 33849 / DSM 4235 / NCIB 12045 / K12 / DH1
MVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQQLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVSAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWDYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 6425 - protein, 654 aa, Escherichia coli
  strain ATCC 33849 / DSM 4235 / NCIB 12045 / K12 / DH1
MDCVMKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNARKPSSSGAMDNVAITADEQTNSLVITADQSVQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQQRIDGKSKALVGSEDLPVLDENTFNSHAPAPSSR

SEQ ID NO: 6426 - protein, 134 aa, Escherichia coli
  strain ATCC 33849 / DSM 4235 / NCIB 12045 / K12 / DH1
MYLAAMYAETRNMTPYGGGEFDNGESRSAIANKTQNFEVVAQYQFDFGLRPSIAYLQSKGKDLGGWAHDGNGDPRYTNKDLVKYVDIGATYYFNKNMSTYVDYKINLLDNDDDFYEANGIATDDIVAVGLVYQF

SEQ ID NO: 6427 - protein, 796 aa, Escherichia coli
  strain ATCC 33849 / DSM 4235 / NCIB 12045 / K12 / DH1
MAVEFNLNVLDKSMRDRIDISLLKEKGVIAPGEYFVSVAVNNNKISNGQKINWQKKGDKTIPCINDSLVDKFGLKPDIRQSLPQIDRCIDFSSRPEMLFNFDQANQQLNISIPQAWLAWHSENWAPPSTWKEGVAGVLMDYNLFASSYRPQDGSSSTNLNAYGTAGINAGAWRLRSDYQLNKTDSEDNHDQSGGISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLISDDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTIHRMSWNDTLDERNSWGMSAGLQSDRPDNGAQVSGNYQHLSSAGEWDISGTYAASDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQLFTVVWGEQSCIIHLPERLEDTTKRLILPCH

SEQ ID NO: 6428 - protein, 239 aa, Escherichia coli
  strain ATCC 33849 / DSM 4235 / NCIB 12045 / K12 / DH1
MAAIPWRPFNLRGIKMKGLLSLLIFSMVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKSNNANNWHLTIIDDHGNYISDKI

SEQ ID NO: 6429 - protein, 332 aa, Escherichia coli
  strain ATCC 33849 / DSM 4235 / NCIB 12045 / K12 / DH1
MMKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRNEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGDEAGHE

SEQ ID NO: 6430 - protein, 631 aa, Escherichia coli
  strain ATCC 33849 / DSM 4235 / NCIB 12045 / K12 / DH1
MVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 6431 - protein, 204 aa, Escherichia coli; identical to SEQ ID NO: 5755
  strain ATCC 33849 / DSM 4235 / NCIB 12045 / K12 / DH1

SEQ ID NO: 6432 - protein, 226 aa, Escherichia coli
  strain ATCC 33849 / DSM 4235 / NCIB 12045 / K12 / DH1
MIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNVGVVPPKSQRQTSWCQAIAPCHVAWRAINDYGGLSAKKEQNLP

SEQ ID NO: 6433 - protein, 559 aa, Escherichia coli
  strain ATCC 33849 / DSM 4235 / NCIB 12045 / K12 / DH1
MSGSYSSVWAEDDIQFDSRFLELKGDTKIDLKRFSSQGYVEPGKYNLQVQLNKQPLAEEYDIYWYAGEDDVSKSYACLTPELVAQFGLKEDVAKNLQWSHDGKCLKPGQLEGVEIKADLSQSALVISLPQAYLEYTWPDWDPPSRWDDGISGIIADYSITAQTRHEENGGDDSNEISGNGTVGVNLGPWRMRADWQTNYQHTRSNDDDDEFGGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGGFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSEMVRTGNDKEMYTATYNQNFRDAGVSVYLNYTRHTYWDREEQTNYNIMLSHYFNMGSIRNMSVSLTGYRYEYDNRADKGM

SEQ ID NO: 6434 - protein, 663 aa, Escherichia coli; identical to SEQ ID NO: 6307
  strain ATCC 55124 / KO11

SEQ ID NO: 6435 - protein, 224 aa, Escherichia coli
  strain ATCC 55124 / KO11
MKGLLSLLIFSMVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKSNNANNWYLTIIDDHGNYISDKI

SEQ ID NO: 6436 - protein, 826 aa, Escherichia coli
  strain ATCC 55124 / KO11
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKHSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 6437 - protein, 191 aa, Escherichia coli
  strain ATCC 55124 / KO11
MKKSLLGLAFASLMFSAGSAVAADYKIDKEGQHAFVNFRIQHLGYSWLYGTFKDFDGTFTFDEKNPAADKVNVKINTTSVDTNHAERDKHLRSADFLNTEKYPQATFTSTSVKKDGDELDITGDLTLNGVTKPVTLEAKLIGQGDDPWGGKRAGFEAEGKIKLKDFNIKTDLGPASQEVDLIISVEGVQQK

SEQ ID NO: 6438 - protein, 511 aa, Escherichia coli; identical to SEQ ID NO: 5749
  strain ATCC 55124 / KO11

SEQ ID NO: 6439 - protein, 878 aa, Escherichia coli
  strain ATCC 55124 / KO11
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAVGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCIANYQLPPESQQQLLTQLSAECR

SEQ ID NO: 6440 - protein, 241 aa, Escherichia coli; identical to SEQ ID NO: 6138
  strain ATCC 55124 / KO11

SEQ ID NO: 6441 - protein, 368 aa, Escherichia coli
  strain ATCC 55124 / KO11
MNKTITALAIMMASFAANASVLPETPVPFKSGTGAIDNDTVYIGLGSAGTAWYKLDTQAKDKKWTALAAFPGGPRDQATSAFIDGNLYVFGGIGKNSKGLTQVFNDVHKYNPKTNSWVKLMSHAPMGMAGHVTFVHNGKAYVTGGVNQNIFNGYFEDLNEAGKDSATIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGESAGGKAVTDSVLISVKDNKVTVQN

SEQ ID NO: 6442 - protein, 229 aa, Escherichia coli
  strain ATCC 55124 / KO11
MALLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAIRSVFKLFWRPEGLPGDPLEAYQQLRWTWNSQGVQLTNPTPYYINLIQVSVNGKALSNAGVVPPKSQRQTSWCQAIAPCHVAWRAINDYGGLSAKKEQNLP

SEQ ID NO: 6443 - protein, 866 aa, Escherichia coli; identical to SEQ ID NO: 6328
  strain ATCC 55124 / KO11

SEQ ID NO: 6444 - protein, 233 aa, Escherichia coli; identical to SEQ ID NO: 6327
  strain ATCC 55124 / KO11

SEQ ID NO: 6445 - protein, 362 aa, Escherichia coli; identical to SEQ ID NO: 5809
  strain ATCC 55124 / KO11

SEQ ID NO: 6446 - protein, 678 aa, Escherichia coli; identical to SEQ ID NO: 6353
  strain ATCC 55124 / KO11

SEQ ID NO: 6447 - protein, 838 aa, Escherichia coli
  strain ATCC 55124 / KO11
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDAKGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 6448 - protein, 231 aa, Escherichia coli; identical to SEQ ID NO: 6351
  strain ATCC 55124 / KO11

SEQ ID NO: 6449 - protein, 203 aa, Escherichia coli; identical to SEQ ID NO: 6414
  strain ATCC 55124 / KO11

SEQ ID NO: 6450 - protein, 249 aa, Escherichia coli
  strain ATCC 55124 / KO11
MRYLNTKNLIAAGVLLACMSSIAWGAIIPDRTRIIMNESDKGEALKLTNQSKNLPYLAQTWIEDTKGNKSRDFIVTVPPMVRLNPSEQIQIRMISQEKIAQLPNDRETLFYFNVREIPPKTDKKNVMQVTMQHALKLFWRPKAIELEDDGVMSYEKVEIIRRNDGSIRFNNKMPYHVTLGYIGTNGITMLPQTQSLMVTPYSHADTQFKNVPSAFQVGYINDFGGLSFYEINCPTVNNSCNVSVAKRDK

SEQ ID NO: 6451 - protein, 834 aa, Escherichia coli
  strain ATCC 55124 / KO11
MYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEEAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSGRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 6452 - protein, 334 aa, Escherichia coli
  strain ATCC 55124 / KO11
MKKNQFLKESDVTAESVFFMKRRQVLKALGISAAALSLPHAAHADLLSWFKGNDRPPAPAGKPLEFSKPAAWQNNLPLTPVDKVSGYNNFYEFGLDKADPAANAGSLKTDPWTLKISGEVAKPLTLDHDDLTRRFPLEERIYRMRCVEAWSMVVPWIGFPLHKLLALAEPTSNAKYVAFETIYAPEQMPGQQDRFIGGGLKYPYVEGLRLDEAMHPLTLMTVGVYGKALPPQNGAPVRLIVPWKYGFKGIKSIVSIKLTRERPPTTWNLAAPDEYGFYANVNPHVDHPRWSQATERFIGSGGILDVQRQPTLLFNGYADQVASLYRGLDLRENF

SEQ ID NO: 6453 - protein, 686 aa, Escherichia coli
  strain ATCC 55124 / KO11
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 6454 - protein, 118 aa, Escherichia coli [sequence omitted]

SEQ ID NO: 6455 - protein, 760 aa, Escherichia coli
  strain ATCC 55124 / KO11
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 6456 - protein, 331 aa, Escherichia coli
  strain ATCC 55124 / KO11
MKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGNEAGHE

SEQ ID NO: 6457 - protein, 478 aa, Escherichia coli; identical to SEQ ID NO: 5711
  strain ATCC 55124 / KO11

SEQ ID NO: 6458 - protein, 237 aa, Escherichia coli
  strain ATCC 55124 / KO11
MRKITQAISAVCLLFALNSSAVALASSPSPLNPGTNVARLAEQAPIHWVSVAQIENSLAGRPPMAVGFDIDDTVLFSSPGFWRGKKNFSPESEDYLKNPVFWEKMNNGWDEFSIPKEVARQLIDMHVRRGDAIFFVTGRSPTKTETVSKTLADNFHIPATNMNPVIFAGDKPGQNTKSQWLQDKNIRIFYGDSDNDITAARDVGARGIRILRASNSTYKPLPQAGAFGEEVIVNSEY

SEQ ID NO: 6459 - protein, 446 aa, Escherichia coli
  strain ATCC 55124 / KO11
MMITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYNGDSKVNPNYGKAVPADFNGGSFGRGDSDEWTFGAQMEIWW

SEQ ID NO: 6460 - protein, 359 aa, Escherichia coli; identical to SEQ ID NO: 6332
  strain ATCC 55124 / KO11

SEQ ID NO: 6461 - protein, 430 aa, Escherichia coli; identical to SEQ ID NO: 5758
  strain ATCC 55124 / KO11

SEQ ID NO: 6462 - protein, 816 aa, Escherichia coli
  strain ATCC 55124 / KO11
MNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGVLMDYNLFASSYRPQDGSSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAIGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 6463 - protein, 243 aa, Escherichia coli
  strain ATCC 55124 / KO11
MTFMKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPAPEKNSDHAVLQVAIQSRIKVFWRPAALRKKAGEKVELQLQVSQQGNQLTLKNPTAYYLTIAYLGRNEKGVLPGFKTVMVAPFSTVNTNTGNYSGSQFYLGYMDDYGALRMTTLNCSGQCHLQAVEAKK

SEQ ID NO: 6464 - protein, 614 aa, Escherichia coli; identical to SEQ ID NO: 6387
  strain ATCC 55124 / KO11

SEQ ID NO: 6465 - protein, 193 aa, Escherichia coli; identical to SEQ ID NO: 6300
  strain ATCC 55124 / KO11

SEQ ID NO: 6466 - protein, 186 aa, Escherichia coli
  strain ATCC 55124 / KO11
MNVSKYVAIFSFVFIQLISVGKVFANADEWMTTFRENIAQTRQQPEHYDLYIPAITWHARFAYDKEKTDRYNERPWGGGFGLSRWDEKGNWHGLYAMAFKDSWNKWEPIAGYGWESTWRPLADENFHLGLGFTAGVTARDNWNYIPLPVLLPLASVGYGPVTFQMTYIPGTYNNGNVYFAWMRFQF

SEQ ID NO: 6467 - protein, 432 aa, Escherichia coli; identical to SEQ ID NO: 5727
  strain ATCC 55124 / KO11

SEQ ID NO: 6468 - protein, 746 aa, Escherichia coli; identical to SEQ ID NO: 6296
  strain ATCC 55124 / KO11

SEQ ID NO: 6469 - protein, 230 aa, Escherichia coli; identical to SEQ ID NO: 6294
  strain ATCC 55124 / KO11

SEQ ID NO: 6470 - protein, 208 aa, Escherichia coli; identical to SEQ ID NO: 5717
  strain ATCC 55124 / KO11

SEQ ID NO: 6471 - protein, 102 aa, Escherichia coli; identical to SEQ ID NO: 6285
  strain ATCC 55124 / KO11

SEQ ID NO: 6472 - protein, 236 aa, Escherichia coli
  strain ATCC 55124 / KO11
MQTTRTPYSISFMATVLLLLLFACHSTVANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDITHAATGDISFQTINDYGALTPRIKATMQ

SEQ ID NO: 6473 - protein, 883 aa, Escherichia coli
  strain ATCC 55124 / KO11
MTAFRAAFKAYRMHQVLIMPRFARLTIALGLATAVFPVDAEYYFNPRFLSNDLAESVDLSAFTKGREAPPGTYRVDIYLNDEFMTSRDITFIADDNNAELIPCLSTDLLVSLGIKKIALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYYSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDSNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELNETVVTVIPTHGAIARATFNAQIGGKVLMTLKYGNKSVPFGAIVTHGENKNGSIVAENGQVYLTGLPQSGQLQVSWGKDKNSNCIVEYKLPEVSPGTLLNQQTAICR

SEQ ID NO: 6474 - protein, 243 aa, Escherichia coli; identical to SEQ ID NO: 6145
  strain ATCC 55124 / KO11

SEQ ID NO: 6475 - protein, 518 aa, Escherichia coli; identical to SEQ ID NO: 6358
  strain ATCC 55124 / KO11

SEQ ID NO: 6476 - protein, 700 aa, Escherichia coli
  strain ATCC 55124 / KO11
MKIFSVRQTVLPALLALSPVVFAADEQTMIVSAAPQVVSELDTPAAVSVVDGEEMRLATPRINLSESLTGVPGLQVQNRQNYAQDLQLSIRGFGSRSTYGIRGIRLYMDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNLGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 6477 - protein, 551 aa, Escherichia coli; identical to SEQ ID NO: 5742
  strain ATCC 55124 / KO11

SEQ ID NO: 6478 - protein, 351 aa, Escherichia coli; identical to SEQ ID NO: 5767
  strain ATCC 55124 / KO11

SEQ ID NO: 6479 - protein, 366 aa, Escherichia coli
  strain ATCC 55124 / KO11
MQNWIKAAAIAVSLALPGVVLAQSLESLVNVQGVRENQLVGYSLVVGLDGTGDKNQVKFTNQTITNMLRQFGVQLPNKIDPKVKNVAAVAVSATLPPMYSRGQTIDVTVSSIGDAKSIRGGTLLLTQLHGADGEVYALAQGSVVVGGMNATGASGSSVTVNTPTAGLIPNGATVEREIPSDFQMGDTITLNLKRPSFKDANNIAAAINASFGGIATAQSSTNVTVRAPTSPGARVAFMSQLDDVQVQAEKIRARVVFNSRTGTVVMGDGVALHAAAVSHGSLTVSINETSNVSQPNAFAGGRTAVTPQSNIAVNHARPGVVSLPESSSLKTLVNALNSLGATPDDIMSILQALHEAGALDADLEVI

SEQ ID NO: 6480 - protein, 228 aa, Escherichia coli; identical to SEQ ID NO: 6185
  strain ATCC 55124 / KO11

SEQ ID NO: 6481 - protein, 843 aa, Escherichia coli; identical to SEQ ID NO: 6288
  strain ATCC 55124 / KO11

SEQ ID NO: 6482 - protein, 880 aa, Escherichia coli
  strain ATCC 55124 / KO11
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVANNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 6483 - protein, 250 aa, Escherichia coli; identical to SEQ ID NO: 6317
  strain ATCC 55124 / KO11

SEQ ID NO: 6484 - protein, 161 aa, Escherichia coli; identical to SEQ ID NO: 5769
  strain ATCC 55124 / KO11

SEQ ID NO: 6485 - protein, 266 aa, Escherichia coli; identical to SEQ ID NO: 5772
  strain ATCC 55124 / KO11

SEQ ID NO: 6486 - protein, 747 aa, Escherichia coli
  strain ATCC 55124 / KO11
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPMKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 6487 - protein, 246 aa, Escherichia coli; identical to SEQ ID NO: 6342
  strain ATCC 55124 / KO11

SEQ ID NO: 6488 - protein, 866 aa, Escherichia coli
  strain ATCC 55124 / KO11
MTIKPTKNYHNHLTRIATFCALLYCNSAFCAELVEYDHTFLMGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTIMQGGYKIYETTVPPGAFVIDDMSPSGYGSDLIVTVEESDGSKRTFSQPFSSVVQMLRPGVGRWDISGGQVLKDDIQDEPNLFQASYYYGLNNCLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEKGNVIGNVGQGGQAFVRGIEQQGNISIKWLEESKPVSCLAHYQQSSEAEKIAQSIILNGIRCQIQ

SEQ ID NO: 6489 - protein, 274 aa, Escherichia coli
  strain ATCC 55124 / KO11
MNKTAIALLALLASSASLAATPWQKITQPVPGSAQSIGSFSNGCIVGADTLPIQSEHYQVMRTDQRRYFGHPDLVMFIQRLSSQVSNLGMGTVLIGDMGMPAGGRFNGGHASHQTGLDVDIFLQLPKTRWTSAQLLRPQALDLVSRDGKHVVSTLWKPEIFSLIKLAAQDKDVTRIFVNPAIKQQLCLDAGTDRDWLRKVRPWFQHRAHMHVRLRCPADSLECEDQPLPPPGDGCGAELQSWFAPPKPGTTKPEKKTPPPLPPSCQALLDEHVI

SEQ ID NO: 6490 - protein, 219 aa, Escherichia coli
  strain ATCC 55124 / KO11
MSLNFTVIVWLRLSIGGVYVLAFCRSSLKSKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRLLQCGNEIYSAIKDLQSKAPDKNIVIFTHNHCLTYIAKNKRDATFKPDYLDGLVMHVEKGKVYLDGEFVNH

SEQ ID NO: 6491 - protein, 229 aa, Escherichia coli
  strain ATCC 55124 / KO11
MADGNASIKGYNCNVSQGLVITMPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTADDAEEMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 6492 - protein, 565 aa, Escherichia coli
  strain ATCC 55124 / KO11
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPHQLNTLRTTSIVPVDLNSLMFKMEKILARASKAAGDNAMANQYETLANARQKGIEKYMWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 6493 - protein, 203 aa, Escherichia coli; identical to SEQ ID NO: 6347
  strain ATCC 55124 / KO11

SEQ ID NO: 6494 - protein, 784 aa, Escherichia coli
  strain ATCC 55124 / KO11
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWKGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYEDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLDESVNRVMPQFKVDGKMVFERDMEMLAPGYTQTLEPRAQYLYVPYRDQSNIYNYDSSLLQSDYSGLFRDRTYGGLDRIASANQVTTGVTSRIYDDAAVERFNISVGQIYYFTESRTGDDNITWENDDKTGSLVWAGDTYWRISERWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 6495 - protein, 412 aa, Escherichia coli
  strain ATCC 55124 / KO11
MKQWIAALLLMLIPGVQAAKPQKVTLMVDDVPVAQVLQALAEQEKLNLVVSPDVSGTVSLHLTDVPWKQALQTVVKSAGLITRQEDNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 6496 - protein, 367 aa, Escherichia coli; identical to SEQ ID NO: 5784
  strain ATCC 55124 / KO11

SEQ ID NO: 6497 - protein, 162 aa, Escherichia coli; identical to SEQ ID NO: 5896
  strain ATCC 55124 / KO11

SEQ ID NO: 6498 - protein, 828 aa, Escherichia coli; identical to SEQ ID NO: 6308
  strain ATCC 55124 / KO11

SEQ ID NO: 6499 - protein, 213 aa, Escherichia coli; identical to SEQ ID NO: 5744
  strain ATCC 55124 / KO11

SEQ ID NO: 6500 - protein, 729 aa, Escherichia coli
  strain ATCC 55124 / KO11
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTQGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 6501 - protein, 365 aa, Escherichia coli; identical to SEQ ID NO: 6335
  strain ATCC 55124 / KO11

SEQ ID NO: 6502 - protein, 232 aa, Escherichia coli; identical to SEQ ID NO: 5747
  strain ATCC 55124 / KO11

SEQ ID NO: 6503 - protein, 814 aa, Escherichia coli
  strain ATCC 55124 / KO11
MCAGKKAVAEPVSSVFFRRAALALAVSAAFASATGIAGEKLDMSFIQGGAGVNPEVWAALNGSYAPGRYLVDLSLNGKEAGKQILDVTPQDSNELCLTEAWLTKAGVYVSADYFREGYDATRQCYVLTKAPSVKVDFDVSTQSLALSIPQKGLVKMPENVDWDYGTSAFRVNYNANANTGRNNTSAFGSADLKANIGHWVVSSSATASGGDSGDNSTTINMFTATRAIRALSADLAVGKTSTGDSLLGSTGTYGVSLSRNNSMKPGNLGYTPVFSGIANGPSRVTLTQNGRLLHSEMVPAGPFSITDVPLYTSGDVTMKITGEDGREQVQNFPLSVMAGQLSPGQHEFSVAAGLPDDDSDLKGGVFAASYGYGLDGLTLRAGGVFNQDWQGASAGVVAGLGYLGAVSADGAYATAKYRDGSHSGNKVQLSWSKQLETTNTGLRVSWSRQSEEYEGMSSFDPTELWSQSNHGRRTKDEWNAGISQPVGGLFSLSVSGWQRSYYPASMTGSYRYSDDNGKETGITGSLSTQIKGVSLNLGWSGSRNSRGENNWSASASVSVPFTLFDRRYSSSASVSTSKGGGTGFSTGVSGSLNDRFSYGLGGGRDGDGGTSSYLNASYSGDRAYLNGVLNHSQSGGTSGSVSVSGSVLAVPAAKDIMFSRTTGDTVAVVNVKDTPGVKVTSGDGQTDSDGNLVVPLNSYDWNTVTIDAGTLPLSTELTNTSQKVVPTDKAVVWMPFDALKVKRYLLQVKQRDGEFVPGGTWARDSKNTPLGFVANNGVLMINTVDAPGDITLGQCRIPAARLQDTEKLQEITCE

SEQ ID NO: 6504 - protein, 258 aa, Escherichia coli
  strain ATCC 55124 / KO11
MSKRNAVTTFFTNRVTKALGMTLALMMTCQSAMASLAADQTRYIFRGDKDALTITVTNNDKERTFGGQAWVDNIVEKDTRPTFVVTPSFFKVKPNGQQTLRIIMASDHLPKDKESVYWLNLQDIPPALEGSGIAVALRTKLKLFYRPKALLEGRKGAEEGISLQSRPDGRTMLVNTTPYIFAIGSLLDGNGKKIATDNGTTQKLLMFMPGDEVQVKGNVVKVDSLNDYGELQTWTINKKKPAAPEAAKAEKADTAEQK

SEQ ID NO: 6505 - protein, 386 aa, Escherichia coli
  strain ATCC 8739 / DSM 1576 / Crooks
MVDDVPVAQVLQALAEQEKLNLVVSPDVSGTVSLHLTDVPWKQALQTVVKSAGLITRQEGNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPLFGQLFRHDGKEDERRELVVFITPRLVSSE

SEQ ID NO: 6506 - protein, 897 aa, Escherichia coli
  strain ATCC 8739 / DSM 1576 / Crooks
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEISQYGNPGSCSVKPDNNGGAVTPVDPTPETPVTPTPDNSEPSTPADSGNDYSLQAWSGQEGSEIYHVIFNGNVYKNAWWVGSKDCPRGTSAENSNNPWRLERTATAAELSQYGNPTTCEIDNGGVIVADGFQASKAYSANSIVDYNDAHYKTSVDQDAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLIRFNGVNYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALRKAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 6507 - protein, 654 aa, Escherichia coli
  strain ATCC 8739 / DSM 1576 / Crooks
MDCVMKGLNKITCCLLAALLMPCAGHAENEQYGANFNNADIRQFVEIVGQHLGKTILIDPSVQGTISVRSNDTFSQQEYYQFFLSILDLYGYSVITLDNGFLRVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNARKPSSSGAMDNVAITADEQTNSLVITADQSVQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQQRIDGKSKALVGSEDLPVLDENTFNSHAPAPSSR

SEQ ID NO: 6508 - protein, 161 aa, Escherichia coli; identical to SEQ ID NO: 5769
  strain ATCC 8739 / DSM 1576 / Crooks

SEQ ID NO: 6509 - protein, 810 aa, Escherichia coli; identical to SEQ ID NO: 6345
  strain ATCC 8739 / DSM 1576 / Crooks

SEQ ID NO: 6510 - protein, 266 aa, Escherichia coli; identical to SEQ ID NO: 5772
  strain ATCC 8739 / DSM 1576 / Crooks

SEQ ID NO: 6511 - protein, 747 aa, Escherichia coli
  strain ATCC 8739 / DSM 1576 / Crooks
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 6512 - protein, 241 aa, Escherichia coli
  strain ATCC 8739 / DSM 1576 / Crooks
MFPIIKKTVSALFISTLLTSAPAFADIIISGTRIIYNADKKDVNVRLENKGNRPLLIQNWLDTGDDNADPSQIKVPFTSTPPVSRIESKRGQTVKVMFTGTTQLPADRESVFWFNVLEVPPKPKDAESDKNLLQLAFRTRIKLFYRPSGLKGEPAEAPAKLTWKLNNAQLQVNNPTPYYVSFNDVAIESGGKSYKVDSSMVAPFGQVSFAVTDIASSVSSGKVIYKAINDYGGNIDGSTSL

SEQ ID NO: 6513 - protein, 678 aa, Escherichia coli
  strain ATCC 8739 / DSM 1576 / Crooks
MVPSTFSRLKAARCLPVVLAALIFAGCGTHTPDQSTAYMQGTAQADSAFYLQQMQQSSDDTRINWQLLAIRALVKEGKTGQAVELFNQLPQELNDAQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQSENIENRVNICYFALSPEDEARDAARHIRDQGKQAPLVLIPRSSLGDRVANAFAQEWQKLGGGTVLQQKFGSTSELRAGVNGGSGIALTGSPITLRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPVS

SEQ ID NO: 6514 - protein, 838 aa, Escherichia coli
  strain ATCC 8739 / DSM 1576 / Crooks
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWNYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSVNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 6515 - protein, 231 aa, Escherichia coli
  strain ATCC 8739 / DSM 1576 / Crooks
MSKRTFAVILTLLCSFCIGQALAGGIVLQRTRVIYDASRKEAALPVANKGAETPYLLQSWVDNIDGKSRAPFIITPPLFRLEAGDDSSLRIIKTADNLPENKESLFYINVRAIPAKKKSDDVNANELTLVFKTRIKMFYRPAHLKGRVNDAWKSLEFKRSDHSLNIYNPTEYYVVFAGLAVDKIDLTSKIEYIAPGEHKQLPLPASGGKNVKWAAINDYGGSSGTETRPLQ

SEQ ID NO: 6516 - protein, 102 aa, Escherichia coli; identical to SEQ ID NO: 6385
  strain ATCC 8739 / DSM 1576 / Crooks

SEQ ID NO: 6517 - protein, 170 aa, Escherichia coli [sequence omitted]

SEQ ID NO: 6518 - protein, 784 aa, Escherichia coli; identical to SEQ ID NO: 6283
  strain ATCC 8739 / DSM 1576 / Crooks

SEQ ID NO: 6519 - protein, 249 aa, Escherichia coli
  strain ATCC 8739 / DSM 1576 / Crooks
MRYLNTKNIIAAGVLLSCMNSIAWGAIIPDRTRIIMNESDKGEALKLTNQSKKLPYLAQTWIEDTKGNKSRDFIVTVPPMVRLNPNEQIQIRMITQEKIAQLPKDRETLFYFNVREIPPKTDKKNVMQVTMQHALKLFWRPKAIELEDDGVMTYEKVEIIRRNDGSIRFNNKMPYHVTLGYIGTNGVTMLPQTQSLMVLPFSHADTQFKNVPSNFQVGYINDFGGLSFYEINCPTVNNSCNVSVAKRDK

SEQ ID NO: 6520 - protein, 832 aa, Escherichia coli
  strain ATCC 8739 / DSM 1576 / Crooks
MYKKLKLTTISELIKNIYCSLSVIIIGCASAYAVEFNKDLIEAEDRENVNLSQFETDGQLPVGKYSLSTLINNKRTPIHLDLQWVLIDNLTAVCVTPEQLTLLGFTDEIIEEAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFSITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLATGVGFNLNSLGSLSFDVTRSDAQLHNQNKETGYSYRANYSKRFESTGSQLTFAGYRFSDKNFVSMNEYINDTNHYTNYQNEKESYIVTFNQYLESLRLNTYVSLARNTYWDASSNVNYSLSLSRDFDIGPLKNVSTSLTFSRINWEDDNQDQLYLNISIPWGTSRTLSYGMQRNQDNNISHTASWYDSSDRNNSWSVSASGDNDEFKDMEASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDETSHKELGLVADGGFVYLNGIQDDSKLTLRWGDKSCFIQPPKSSNLTTGTVILPCIS

SEQ ID NO: 6521 - protein, 340 aa, Escherichia coli
  strain ATCC 8739 / DSM 1576 / Crooks
MTLHRFKKIALLSVLGIAAISMNVQAAERIAFIPKLVGVGFFTSGGNGAQQAGKELGVDVTYDGPTEPSVSGQVQLINNFVNQGYNAIIVSAVSPDGLCPALKRAMQRGVRVLTWDSDTKPECRSYYINQGTPAQLGGMLVDMAARQVNKDKAKVAFFYSSPTVTDQNQWVKEAKAKIAKEHPGWEIVTTQFGYNDATKSLQTAEGILKAYSDLDAIIAPDANALPAAAQAAENLKNDKVAIVGFSTPNVMRPYVERGTVKEFGLWDVVQQGKISVYVADALLKKGSMKTGDKLDIQGVGQVEVSPNSVQGYDYEADGNGIVLLPERVIFNKENIGKYDF

SEQ ID NO: 6522 - protein, 700 aa, Escherichia coli
  strain ATCC 8739 / DSM 1576 / Crooks
MKIFSVRQTVLPALLALSPVVFAADEQTMIVSAAPQVVSELDTPAAVSVVDGEEMRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTKAEWKANPQQAPRAEQYDTRKTIKQTQAGLRYERSLSSRDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYITPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLIGLFTGYKYNYHNLTVDLFGRVDNLFDKEYVGSVIVNESNGRYYEPAPGRNYGVGVNIAWRFE

SEQ ID NO: 6523 - protein, 774 aa, Escherichia coli
  strain ATCC 8739 / DSM 1576 / Crooks
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGVRDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVGGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 6524 - protein, 359 aa, Escherichia coli; identical to SEQ ID NO: 6332
  strain ATCC 8739 / DSM 1576 / Crooks

SEQ ID NO: 6525 - protein, 539 aa, Escherichia coli
  strain ATCC 8739 / DSM 1576 / Crooks
MAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 6526 - protein, 432 aa, Escherichia coli; identical to SEQ ID NO: 5727
  strain ATCC 8739 / DSM 1576 / Crooks

SEQ ID NO: 6527 - protein, 207 aa, Escherichia coli; identical to SEQ ID NO: 5743
  strain ATCC 8739 / DSM 1576 / Crooks

SEQ ID NO: 6528 - protein, 565 aa, Escherichia coli; identical to SEQ ID NO: 6395
  strain ATCC 8739 / DSM 1576 / Crooks

SEQ ID NO: 6529 - protein, 203 aa, Escherichia coli; identical to SEQ ID NO: 6396
  strain ATCC 8739 / DSM 1576 / Crooks

SEQ ID NO: 6530 - protein, 213 aa, Escherichia coli; identical to SEQ ID NO: 5744
  strain ATCC 8739 / DSM 1576 / Crooks

SEQ ID NO: 6531 - protein, 729 aa, Escherichia coli
  strain ATCC 8739 / DSM 1576 / Crooks
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGIYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 6532 - protein, 478 aa, Escherichia coli; identical to SEQ ID NO: 5711
  strain ATCC 8739 / DSM 1576 / Crooks

SEQ ID NO: 6533 - protein, 237 aa, Escherichia coli
  strain ATCC 8739 / DSM 1576 / Crooks
MRKITQAISAVCLLFALNSSAVALASSPSPLNPGTNVARLAEQAPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPATNMNPVIFAGDKPGQNTKSQWLQDKNIRIFYGDSDNDITAARDIGARGIRILRASNSTYKPLPQAGAFGEEVIVNSEY

SEQ ID NO: 6534 - protein, 446 aa, Escherichia coli; identical to SEQ ID NO: 6459
  strain ATCC 8739 / DSM 1576 / Crooks

SEQ ID NO: 6535 - protein, 365 aa, Escherichia coli
  strain ATCC 8739 / DSM 1576 / Crooks
MIKFLSALILLLVTTAAQAERIRDLTSVQGVRQNSLIGYGLVVGLDGTGDQTTQTPFTTQTLNNMLSQLGITVPTGTNMQLKNVAAVMVTASLPPFGRQGQTIDVVVSSMGNAKSLRGGTLLMTPLKGVDSQVYALAQGNILVGGAGASAGGSSVQVNQLNGGRITNGAVIERELPSQFGVGNTLNLQLNDEDFSMAQQIADTINRVRGYGSATALDARTIQVRVPSGNSSQVRFLADIQNMHVNVTPQDAKVVINSRTGSVVMNREVTLDSCAVAQGNLSVTVNRQANVSQPDTPFGGGQTVVTPQTQIDLRQSGGSLQSVRSSASLNNVVRALNALGATPMDLMSILQSMQSAGCLRAKLEII

SEQ ID NO: 6536 - protein, 235 aa, Escherichia coli; identical to SEQ ID NO: 6404
  strain ATCC 8739 / DSM 1576 / Crooks

SEQ ID NO: 6537 - protein, 191 aa, Escherichia coli
  strain ATCC 8739 / DSM 1576 / Crooks
MKKSLLGLTFASLMFSAGSAVAADYKIDKEGQHAFVNFRIQHLGYSWLYGTFKDFDGTFTFDEKNPAADKVNVTINTTSVDTNHAERDKHLRSADFLNTAKYPQATFTSTSVKKDGDELDITGDLTLNGVTKPVTLEAKLIGQGDDPWGGKRAGFEAEGKIKLKDFNIKTDLGPASQDVDLIISVEGVQQK

SEQ ID NO: 6538 - protein, 511 aa, Escherichia coli; identical to SEQ ID NO: 5749
  strain ATCC 8739 / DSM 1576 / Crooks

SEQ ID NO: 6539 - protein, 614 aa, Escherichia coli; identical to SEQ ID NO: 6387
  strain ATCC 8739 / DSM 1576 / Crooks

SEQ ID NO: 6540 - protein, 518 aa, Escherichia coli; identical to SEQ ID NO: 6358
  strain ATCC 8739 / DSM 1576 / Crooks

SEQ ID NO: 6541 - protein, 236 aa, Escherichia coli
  strain ATCC 8739 / DSM 1576 / Crooks
MTNTWNRLALLIFAVLSLLVAGELQAGVVVGGTRFIFPADRESISILLTNTSQESWFINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNVGVVPPKSQRQTSWCQAIAPCHVAWRAINDYGGLSAKKEQNLP

SEQ ID NO: 6542 - protein, 233 aa, Escherichia coli; identical to SEQ ID NO: 6411
  strain ATCC 8739 / DSM 1576 / Crooks

SEQ ID NO: 6543 - protein, 362 aa, Escherichia coli
  strain ATCC 8739 / DSM 1576 / Crooks
MMKRNILAVIVPALLVAGTANAAEIYNKDGNKVDLYGKAVGLHYFSKDNGVNSYGGNGDKTYARLGFKGETQINSDLTGYGQWEYNFQGNNSEGADAQTGNKTRLAFAGLKYADIGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGNGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 6544 - protein, 208 aa, Escherichia coli; identical to SEQ ID NO: 5717
  strain ATCC 8739 / DSM 1576 / Crooks

SEQ ID NO: 6545 - protein, 203 aa, Escherichia coli; identical to SEQ ID NO: 6414
  strain ATCC 8739 / DSM 1576 / Crooks

SEQ ID NO: 6546 - protein, 538 aa, Escherichia coli
  strain ATCC 8739 / DSM 1576 / Crooks
MFRRNLITSAILLMAPLAFSAQSLAESLTVEQRLELLEKALRETQSELKKYKDEEKKKYTPATVNRSVSTNDQGYAANPFPTSSAAKPDAVLVKNEEKNASETGSIYSSMTLKDFSKFVKDEIGFSYNGYYRSGWGTASHGSPKSWAIGSLGRFGNEYSGWFDLQLKQRVYNENGKRVDAVVMMDGNVGQQYSTGWFGDNAGGENYMQFSDMYVTTKGFLPFAPEADFWVGKHGAPKIEIQMLDWKTQRTDAAAGVGLENWKVGPGKIDIALVREDVDDYDRSLQNKQQINTNTIDLRYKDIPLWDKATLMVSGRYVTANESASEKDNQDNNGYYDWKDTWMFGTSLTQKFDKGGFNEFSFLVANNSIASNFGRYAGASPFTTFNGRYYGDHTGGTAVRLTSQGEAYIGDHFIVANAIVYSFGNDIYSYETGAHSDFESIRAVVRPAYIWDQYNQTGVELGYFTQQNKDANSNKFNESGYKTTLFHTFKVNTSMLTSRPEIRFYATYIKALENELDGFTFEDNKDDQFAVGAQAEIWW

SEQ ID NO: 6547 - protein, 881 aa, Escherichia coli
  strain ATCC 8739 / DSM 1576 / Crooks
MPDHSLFRLRILPWCIALAISGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEEFSGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNMSVSLTGYRYEYDNRADKGMYISLSMPWGDNSTVSYNGNYGSGTDSSQVGYFSRVDDATHYQLNVGTSDKHTSVDGYYSHDGSLAQVDLCANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMRVFWSGVAHCDINLPDPLPADLFNGLLLPCQHKGNVAPVTSPAVKPAIQEQTQRVTPTEPPTSISVNQ

SEQ ID NO: 6548 - protein, 250 aa, Escherichia coli
  strain ATCC 8739 / DSM 1576 / Crooks
MFNLTNTAKIVVPALALLATAVSFSSHASVTPDRTRLVFNESDKSISVTLRNNDPKLPYLAQSWIEDAKGNKISSPLAVLPPVQRIDAMMNGQVKVQGLPDINKLPADRESVFYFNVREIPPKSNKPNTLQIALQTRIKLFWRPKALENTSMKSPWQHKVTLIRNGQDFTVNNPTPYYVIISNASAKKGGNPPAGFTPLMMEPKTSAPLNAKMDSVPVLTYINDYGARMPLYFKCTGNNCQVDEEQSRKG

SEQ ID NO: 6549 - protein, 274 aa, Escherichia coli
  strain ATCC 8739 / DSM 1576 / Crooks
MNKTAIALLALLASSASLAATPWQKITQPVPGSAQSIGSFSNGCIVGADTLPIQSEHYQVMRTDQRRYFGHPDLVMFIQRLSSQVSNLGMGTVLIGDMGMPAGGRFNGGHASHQTGLDVDIFLQLPKTRWTSAQLLRPQALDLVSRDGKHVVSTLWKPEIFSLIKLAAQDKDVTRIFVNPAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 6550 - protein, 760 aa, Escherichia coli; identical to SEQ ID NO: 6415
  strain ATCC 8739 / DSM 1576 / Crooks

SEQ ID NO: 6551 - protein, 331 aa, Escherichia coli
  strain ATCC 8739 / DSM 1576 / Crooks
MKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGDEAGHE

SEQ ID NO: 6552 - protein, 200 aa, Escherichia coli; identical to SEQ ID NO: 6363
  strain ATCC 8739 / DSM 1576 / Crooks

SEQ ID NO: 6553 - protein, 430 aa, Escherichia coli; identical to SEQ ID NO: 5758
  strain ATCC 8739 / DSM 1576 / Crooks

SEQ ID NO: 6554 - protein, 819 aa, Escherichia coli
  strain ATCC 8739 / DSM 1576 / Crooks
MDTVNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGILMDYNLFASSYRPQDGSSSTNLNAYGTTGINAGAWRLRSDYQLNQTDSDDNHEQSGGISRTYLFRPLPQLGSKLTLGETDFSSNIFDGFSYTGAALASDERMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVTENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 6555 - protein, 243 aa, Escherichia coli
  strain ATCC 8739 / DSM 1576 / Crooks
MTFMKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPAPEKNSDHAVLQVAIQSRIKVFWRPAALRKKAGEKVELQLQVSQQGNQLTLKNPTAYYLTIAYLGRNEKGVLPGFKTVMVAPFSTVNTNTGSYSGSQFYLGYMDDYGALRMTMLNCSGQCHLQAVEAKK

SEQ ID NO: 6556 - protein, 376 aa, Escherichia coli
  strain ATCC 8739 / DSM 1576 / Crooks
MKVKVLSLLVPALLVAGAANAAEVYNKDGNKLDLYGKVDGLHYFSDNKSEDGDQTYVRLGFKGETQVTDQLTGYGQWEYQIQGNTSEDNKENSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGAAVSSSKRTDDQNGSYTSNGVVRNYIGTGDRAETYTGGLKYDANNIYLAAQYTQTYNATRVGSLGWANKAQNFEAVAQYQFDFGLRPSLAYLQSKGKNLGVINSRNYDDEDILKYVDVGATYYFNKNMSTYVDYKINLLDDNQFTRDAGINTDNIVALGLVYQF

SEQ ID NO: 6557 - protein, 162 aa, Escherichia coli; identical to SEQ ID NO: 6365
  strain ATCC 8739 / DSM 1576 / Crooks

SEQ ID NO: 6558 - protein, 828 aa, Escherichia coli
  strain ATCC 8739 / DSM 1576 / Crooks
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 6559 - protein, 663 aa, Escherichia coli; identical to SEQ ID NO: 6307
  strain ATCC 8739 / DSM 1576 / Crooks

SEQ ID NO: 6560 - protein, 193 aa, Escherichia coli
  strain ATCC 8739 / DSM 1576 / Crooks
MRYLATLLLSLAVLITAGCGWHLRDTTQVPSTMKVMILDSGDPNGPLSRAVRNQLRLNGVELLDKETTRKDVPSLRLGAVSISQDTASVFRNGQTAEYQMVMTVSASVLIPGRDIYPISAKVFRSFFDNPQMALAKDNEQEMIIKEMYDRAAEQLIRKLPSIRAADIRSDEEQTSTTTDTPATPARVSTTLGN

SEQ ID NO: 6561 - protein, 746 aa, Escherichia coli
  strain ATCC 8739 / DSM 1576 / Crooks
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 6562 - protein, 224 aa, Escherichia coli; identical to SEQ ID NO: 6372
  strain ATCC 8739 / DSM 1576 / Crooks

SEQ ID NO: 6563 - protein, 826 aa, Escherichia coli
  strain ATCC 8739 / DSM 1576 / Crooks
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYLSQYYSDYKASGNNKSTYVRFNSGLNLLGWQLHSDASFSKTNNNPGGWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDLAAGRSHIEGASKQSDFVQAGYQYGFNNLLTLYGGSMVANNYYAFTLGAGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQSLTFGYEVNDIHGHNIGVVGQGSQLFIRTNEVPPSVNVAIDKQQGLSCTITFGKEIDESRNYICQ

SEQ ID NO: 6564 - protein, 869 aa, Escherichia coli
  strain ATCC 8739 / DSM 1576 / Crooks
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGRKPVPFGSLVRENSTGITSMVGDDGQVYLSGAPLSGELLVQWGDGANSRCIAHYVLPKQSLQQAVTVISAVCTHPGS

SEQ ID NO: 6565 - protein, 230 aa, Escherichia coli; identical to SEQ ID NO: 6360
  strain ATCC 8739 / DSM 1576 / Crooks

SEQ ID NO: 6566 - protein, 334 aa, Escherichia coli
  strain ATCC 8739 / DSM 1576 / Crooks
MKKNQFLKESDVTAESVFFMKRRQVLKALGISAAALSLPHAAHADLLSWFKGNDRPPAPAGKPLEFSKPAAWQNNLPLTPADKVSGYNNFYEFGLDKADPAANAGSLKTDPWTLKISGEVAKPLTLDHDDLTRRFPLEERIYRMRCVEAWSMVVPWIGFPLHKLLALAEPTSNAKYVAFETIYAPEQMPGQQDRFIGGGLKYPYVEGLRLDEAMHPLTLMTVGVYGKALPPQNGAPVRLIVPWKYGFKGIKSIVSIKLTRERPPTTWNLAAPDEYGFYANVNPHVDHPRWSQATERFIGSGGILDVQRQPTLLFNGYADQVASLYRGLDLRENF

SEQ ID NO: 6567 - protein, 118 aa, Escherichia coli [sequence omitted]

SEQ ID NO: 6568 - protein, 351 aa, Escherichia coli
  strain ATCC 8739 / DSM 1576 / Crooks
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLIYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 6569 - protein, 366 aa, Escherichia coli
  strain ATCC 8739 / DSM 1576 / Crooks
MQNWIKTVVVAVSLALPGVVLAQSLESLVNVQGVRENQLVGYSLVVGLDGTGDKNQVKFTNQTITNMLRQFGVQLPNKIDPKVKNVAAVAVSAMLPPMYSRGQTIDVTVSSIGDAKSIRGGTLLLTQLHGADGEVYALAQGSVVVGGMNATGASGSSVTVNTPTAGLIPNGATVEREIPSDFQMGDTITLNLKRPSFKDANNIAAAINASFGGIATAQSSTNVTVRAPTSPGARVAFMSQLDDVQVQAEKIRARVVFNSRTGTVVMGDGVALHAAAVSHGSLTVSINETSNVSQPNAFAGGRTAVTPQSNIAVNHARPGVVSLPESSSLKTLVNALNSLGATPDDIMSILQALHEAGALDADLEVI

SEQ ID NO: 6570 - protein, 221 aa, Escherichia coli
  strain ATCC 8739 / DSM 1576 / Crooks
MKNYLWLVALLPLLSGCESQAILVKKDDAYFAPPKTEAPPPADGRAGGVFETGYNWSLTADRRAYRVGDILTVILEESTQSSKQAKTNFGKSNTVDIGAPTIFGHTKDKLSGSIDANRDFDGSATSQQQNSLRGEITVSVHAVQPNGILEIRGEKWLTLNQGDEYIRLSGLVRADDIQNDNSVSSQRIADARISYAGRGALSDANAAGWLARLFNHPLFPI

SEQ ID NO: 6571 - protein, 207 aa, Escherichia coli; identical to SEQ ID NO: 5743
  strain ATCC 9637 / CCM 2024 / DSM 1116 / NCIMB 8666 / NRRL B-766 / W

SEQ ID NO: 6572 - protein, 565 aa, Escherichia coli; identical to SEQ ID NO: 6492
  strain ATCC 9637 / CCM 2024 / DSM 1116 / NCIMB 8666 / NRRL B-766 / W

SEQ ID NO: 6573 - protein, 203 aa, Escherichia coli; identical to SEQ ID NO: 6347
  strain ATCC 9637 / CCM 2024 / DSM 1116 / NCIMB 8666 / NRRL B-766 / W

SEQ ID NO: 6574 - protein, 213 aa, Escherichia coli; identical to SEQ ID NO: 5744
  strain ATCC 9637 / CCM 2024 / DSM 1116 / NCIMB 8666 / NRRL B-766 / W

SEQ ID NO: 6575 - protein, 729 aa, Escherichia coli; identical to SEQ ID NO: 6500
  strain ATCC 9637 / CCM 2024 / DSM 1116 / NCIMB 8666 / NRRL B-766 / W

SEQ ID NO: 6576 - protein, 365 aa, Escherichia coli; identical to SEQ ID NO: 6335
  strain ATCC 9637 / CCM 2024 / DSM 1116 / NCIMB 8666 / NRRL B-766 / W

SEQ ID NO: 6577 - protein, 232 aa, Escherichia coli; identical to SEQ ID NO: 5747
  strain ATCC 9637 / CCM 2024 / DSM 1116 / NCIMB 8666 / NRRL B-766 / W

SEQ ID NO: 6578 - protein, 191 aa, Escherichia coli; identical to SEQ ID NO: 6437
  strain ATCC 9637 / CCM 2024 / DSM 1116 / NCIMB 8666 / NRRL B-766 / W

SEQ ID NO: 6579 - protein, 700 aa, Escherichia coli; identical to SEQ ID NO: 6476
  strain ATCC 9637 / CCM 2024 / DSM 1116 / NCIMB 8666 / NRRL B-766 / W

SEQ ID NO: 6580 - protein, 539 aa, Escherichia coli; identical to SEQ ID NO: 6525
  strain ATCC 9637 / CCM 2024 / DSM 1116 / NCIMB 8666 / NRRL B-766 / W

SEQ ID NO: 6581 - protein, 249 aa, Escherichia coli; identical to SEQ ID NO: 6450
  strain ATCC 9637 / CCM 2024 / DSM 1116 / NCIMB 8666 / NRRL B-766 / W

SEQ ID NO: 6582 - protein, 834 aa, Escherichia coli; identical to SEQ ID NO: 6451
  strain ATCC 9637 / CCM 2024 / DSM 1116 / NCIMB 8666 / NRRL B-766 / W

SEQ ID NO: 6583 - protein, 686 aa, Escherichia coli; identical to SEQ ID NO: 6453
  strain ATCC 9637 / CCM 2024 / DSM 1116 / NCIMB 8666 / NRRL B-766 / W

SEQ ID NO: 6584 - protein, 359 aa, Escherichia coli; identical to SEQ ID NO: 6332
  strain ATCC 9637 / CCM 2024 / DSM 1116 / NCIMB 8666 / NRRL B-766 / W

SEQ ID NO: 6585 - protein, 102 aa, Escherichia coli; identical to SEQ ID NO: 6285
  strain ATCC 9637 / CCM 2024 / DSM 1116 / NCIMB 8666 / NRRL B-766 / W

SEQ ID NO: 6586 - protein, 236 aa, Escherichia coli; identical to SEQ ID NO: 6472
  strain ATCC 9637 / CCM 2024 / DSM 1116 / NCIMB 8666 / NRRL B-766 / W

SEQ ID NO: 6587 - protein, 883 aa, Escherichia coli; identical to SEQ ID NO: 6473
  strain ATCC 9637 / CCM 2024 / DSM 1116 / NCIMB 8666 / NRRL B-766 / W

SEQ ID NO: 6588 - protein, 880 aa, Escherichia coli; identical to SEQ ID NO: 6482
  strain ATCC 9637 / CCM 2024 / DSM 1116 / NCIMB 8666 / NRRL B-766 / W

SEQ ID NO: 6589 - protein, 250 aa, Escherichia coli; identical to SEQ ID NO: 6317
  strain ATCC 9637 / CCM 2024 / DSM 1116 / NCIMB 8666 / NRRL B-766 / W

SEQ ID NO: 6590 - protein, 274 aa, Escherichia coli; identical to SEQ ID NO: 6489
  strain ATCC 9637 / CCM 2024 / DSM 1116 / NCIMB 8666 / NRRL B-766 / W

SEQ ID NO: 6591 - protein, 200 aa, Escherichia coli; identical to SEQ ID NO: 6311
  strain ATCC 9637 / CCM 2024 / DSM 1116 / NCIMB 8666 / NRRL B-766 / W

SEQ ID NO: 6592 - protein, 367 aa, Escherichia coli; identical to SEQ ID NO: 5784
  strain ATCC 9637 / CCM 2024 / DSM 1116 / NCIMB 8666 / NRRL B-766 / W

SEQ ID NO: 6593 - protein, 162 aa, Escherichia coli; identical to SEQ ID NO: 5896
  strain ATCC 9637 / CCM 2024 / DSM 1116 / NCIMB 8666 / NRRL B-766 / W

SEQ ID NO: 6594 - protein, 828 aa, Escherichia coli; identical to SEQ ID NO: 6308
  strain ATCC 9637 / CCM 2024 / DSM 1116 / NCIMB 8666 / NRRL B-766 / W

SEQ ID NO: 6595 - protein, 663 aa, Escherichia coli; identical to SEQ ID NO: 6307
  strain ATCC 9637 / CCM 2024 / DSM 1116 / NCIMB 8666 / NRRL B-766 / W

SEQ ID NO: 6596 - protein, 161 aa, Escherichia coli; identical to SEQ ID NO: 5769
  strain ATCC 9637 / CCM 2024 / DSM 1116 / NCIMB 8666 / NRRL B-766 / W

SEQ ID NO: 6597 - protein, 266 aa, Escherichia coli; identical to SEQ ID NO: 5772
  strain ATCC 9637 / CCM 2024 / DSM 1116 / NCIMB 8666 / NRRL B-766 / W

SEQ ID NO: 6598 - protein, 747 aa, Escherichia coli; identical to SEQ ID NO: 6486
  strain ATCC 9637 / CCM 2024 / DSM 1116 / NCIMB 8666 / NRRL B-766 / W

SEQ ID NO: 6599 - protein, 246 aa, Escherichia coli; identical to SEQ ID NO: 6342
  strain ATCC 9637 / CCM 2024 / DSM 1116 / NCIMB 8666 / NRRL B-766 / W

SEQ ID NO: 6600 - protein, 866 aa, Escherichia coli; identical to SEQ ID NO: 6488
  strain ATCC 9637 / CCM 2024 / DSM 1116 / NCIMB 8666 / NRRL B-766 / W

SEQ ID NO: 6601 - protein, 784 aa, Escherichia coli; identical to SEQ ID NO: 6494
  strain ATCC 9637 / CCM 2024 / DSM 1116 / NCIMB 8666 / NRRL B-766 / W

SEQ ID NO: 6602 - protein, 229 aa, Escherichia coli; identical to SEQ ID NO: 6442
  strain ATCC 9637 / CCM 2024 / DSM 1116 / NCIMB 8666 / NRRL B-766 / W

SEQ ID NO: 6603 - protein, 866 aa, Escherichia coli; identical to SEQ ID NO: 6328
  strain ATCC 9637 / CCM 2024 / DSM 1116 / NCIMB 8666 / NRRL B-766 / W

SEQ ID NO: 6604 - protein, 233 aa, Escherichia coli; identical to SEQ ID NO: 6327
  strain ATCC 9637 / CCM 2024 / DSM 1116 / NCIMB 8666 / NRRL B-766 / W

SEQ ID NO: 6605 - protein, 362 aa, Escherichia coli; identical to SEQ ID NO: 5809
  strain ATCC 9637 / CCM 2024 / DSM 1116 / NCIMB 8666 / NRRL B-766 / W

SEQ ID NO: 6606 - protein, 203 aa, Escherichia coli; identical to SEQ ID NO: 6414
  strain ATCC 9637 / CCM 2024 / DSM 1116 / NCIMB 8666 / NRRL B-766 / W

SEQ ID NO: 6607 - protein, 402 aa, Escherichia coli
  strain ATCC 9637 / CCM 2024 / DSM 1116 / NCIMB 8666 / NRRL B-766 / W
MLIPGVQAAKPQKVTLMVDDVPVAQVLQALAEQEKLNLVVSPDVSGTVSLHLTDVPWKQALQTVVKSAGLITRQEDNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 6608 - protein, 478 aa, Escherichia coli; identical to SEQ ID NO: 5711
  strain ATCC 9637 / CCM 2024 / DSM 1116 / NCIMB 8666 / NRRL B-766 / W

SEQ ID NO: 6609 - protein, 237 aa, Escherichia coli; identical to SEQ ID NO: 6458
  strain ATCC 9637 / CCM 2024 / DSM 1116 / NCIMB 8666 / NRRL B-766 / W

SEQ ID NO: 6610 - protein, 446 aa, Escherichia coli; identical to SEQ ID NO: 6459
  strain ATCC 9637 / CCM 2024 / DSM 1116 / NCIMB 8666 / NRRL B-766 / W

SEQ ID NO: 6611 - protein, 334 aa, Escherichia coli; identical to SEQ ID NO: 6452
  strain ATCC 9637 / CCM 2024 / DSM 1116 / NCIMB 8666 / NRRL B-766 / W

SEQ ID NO: 6612 - protein, 186 aa, Escherichia coli; identical to SEQ ID NO: 6466
  strain ATCC 9637 / CCM 2024 / DSM 1116 / NCIMB 8666 / NRRL B-766 / W

SEQ ID NO: 6613 - protein, 193 aa, Escherichia coli; identical to SEQ ID NO: 6300
  strain ATCC 9637 / CCM 2024 / DSM 1116 / NCIMB 8666 / NRRL B-766 / W

SEQ ID NO: 6614 - protein, 746 aa, Escherichia coli; identical to SEQ ID NO: 6296
  strain ATCC 9637 / CCM 2024 / DSM 1116 / NCIMB 8666 / NRRL B-766 / W

SEQ ID NO: 6615 - protein, 432 aa, Escherichia coli; identical to SEQ ID NO: 5727
  strain ATCC 9637 / CCM 2024 / DSM 1116 / NCIMB 8666 / NRRL B-766 / W

SEQ ID NO: 6616 - protein, 368 aa, Escherichia coli; identical to SEQ ID NO: 6441
  strain ATCC 9637 / CCM 2024 / DSM 1116 / NCIMB 8666 / NRRL B-766 / W

SEQ ID NO: 6617 - protein, 678 aa, Escherichia coli; identical to SEQ ID NO: 6353
  strain ATCC 9637 / CCM 2024 / DSM 1116 / NCIMB 8666 / NRRL B-766 / W

SEQ ID NO: 6618 - protein, 838 aa, Escherichia coli; identical to SEQ ID NO: 6447
  strain ATCC 9637 / CCM 2024 / DSM 1116 / NCIMB 8666 / NRRL B-766 / W

SEQ ID NO: 6619 - protein, 231 aa, Escherichia coli; identical to SEQ ID NO: 6351
  strain ATCC 9637 / CCM 2024 / DSM 1116 / NCIMB 8666 / NRRL B-766 / W

SEQ ID NO: 6620 - protein, 243 aa, Escherichia coli; identical to SEQ ID NO: 6145
  strain ATCC 9637 / CCM 2024 / DSM 1116 / NCIMB 8666 / NRRL B-766 / W

SEQ ID NO: 6621 - protein, 258 aa, Escherichia coli; identical to SEQ ID NO: 6504
  strain ATCC 9637 / CCM 2024 / DSM 1116 / NCIMB 8666 / NRRL B-766 / W

SEQ ID NO: 6622 - protein, 814 aa, Escherichia coli; identical to SEQ ID NO: 6503
  strain ATCC 9637 / CCM 2024 / DSM 1116 / NCIMB 8666 / NRRL B-766 / W

SEQ ID NO: 6623 - protein, 351 aa, Escherichia coli; identical to SEQ ID NO: 5767
  strain ATCC 9637 / CCM 2024 / DSM 1116 / NCIMB 8666 / NRRL B-766 / W

SEQ ID NO: 6624 - protein, 366 aa, Escherichia coli; identical to SEQ ID NO: 6479
  strain ATCC 9637 / CCM 2024 / DSM 1116 / NCIMB 8666 / NRRL B-766 / W

SEQ ID NO: 6625 - protein, 760 aa, Escherichia coli; identical to SEQ ID NO: 6455
  strain ATCC 9637 / CCM 2024 / DSM 1116 / NCIMB 8666 / NRRL B-766 / W

SEQ ID NO: 6626 - protein, 331 aa, Escherichia coli; identical to SEQ ID NO: 6456
  strain ATCC 9637 / CCM 2024 / DSM 1116 / NCIMB 8666 / NRRL B-766 / W

SEQ ID NO: 6627 - protein, 518 aa, Escherichia coli; identical to SEQ ID NO: 6358
  strain ATCC 9637 / CCM 2024 / DSM 1116 / NCIMB 8666 / NRRL B-766 / W

SEQ ID NO: 6628 - protein, 208 aa, Escherichia coli; identical to SEQ ID NO: 5717
  strain ATCC 9637 / CCM 2024 / DSM 1116 / NCIMB 8666 / NRRL B-766 / W

SEQ ID NO: 6629 - protein, 118 aa, Escherichia coli [sequence omitted]

SEQ ID NO: 6630 - protein, 228 aa, Escherichia coli; identical to SEQ ID NO: 6185
  strain ATCC 9637 / CCM 2024 / DSM 1116 / NCIMB 8666 / NRRL B-766 / W

SEQ ID NO: 6631 - protein, 843 aa, Escherichia coli; identical to SEQ ID NO: 6288
  strain ATCC 9637 / CCM 2024 / DSM 1116 / NCIMB 8666 / NRRL B-766 / W

SEQ ID NO: 6632 - protein, 820 aa, Escherichia coli
  strain ATCC 9637 / CCM 2024 / DSM 1116 / NCIMB 8666 / NRRL B-766 / W
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGIRLYSSDNMYPDSQQGFAPTVRGIARTAAQLTIRQNGLIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQATYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSIGITSMWVMTGKFI

SEQ ID NO: 6633 - protein, 230 aa, Escherichia coli; identical to SEQ ID NO: 6294
  strain ATCC 9637 / CCM 2024 / DSM 1116 / NCIMB 8666 / NRRL B-766 / W

SEQ ID NO: 6634 - protein, 614 aa, Escherichia coli; identical to SEQ ID NO: 6387
  strain ATCC 9637 / CCM 2024 / DSM 1116 / NCIMB 8666 / NRRL B-766 / W

SEQ ID NO: 6635 - protein, 430 aa, Escherichia coli; identical to SEQ ID NO: 5758
  strain ATCC 9637 / CCM 2024 / DSM 1116 / NCIMB 8666 / NRRL B-766 / W

SEQ ID NO: 6636 - protein, 816 aa, Escherichia coli; identical to SEQ ID NO: 6462
  strain ATCC 9637 / CCM 2024 / DSM 1116 / NCIMB 8666 / NRRL B-766 / W

SEQ ID NO: 6637 - protein, 243 aa, Escherichia coli; identical to SEQ ID NO: 6463
  strain ATCC 9637 / CCM 2024 / DSM 1116 / NCIMB 8666 / NRRL B-766 / W

SEQ ID NO: 6638 - protein, 224 aa, Escherichia coli; identical to SEQ ID NO: 6435
  strain ATCC 9637 / CCM 2024 / DSM 1116 / NCIMB 8666 / NRRL B-766 / W

SEQ ID NO: 6639 - protein, 826 aa, Escherichia coli; identical to SEQ ID NO: 6436
  strain ATCC 9637 / CCM 2024 / DSM 1116 / NCIMB 8666 / NRRL B-766 / W

SEQ ID NO: 6640 - protein, 878 aa, Escherichia coli; identical to SEQ ID NO: 6439
  strain ATCC 9637 / CCM 2024 / DSM 1116 / NCIMB 8666 / NRRL B-766 / W

SEQ ID NO: 6641 - protein, 241 aa, Escherichia coli; identical to SEQ ID NO: 6138
  strain ATCC 9637 / CCM 2024 / DSM 1116 / NCIMB 8666 / NRRL B-766 / W

SEQ ID NO: 6642 - protein, 819 aa, Escherichia coli
  strain ATCC 9637 / CCM 2024 / DSM 1116 / NCIMB 8666 / NRRL B-766 / W
MDTVNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGVLMDYNLFASSYRPQDGSSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAIGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 6643 - protein, 236 aa, Escherichia coli
  strain ATCC 9637 / CCM 2024 / DSM 1116 / NCIMB 8666 / NRRL B-766 / W
MTNTWNRLALLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAIRSVFKLFWRPEGLPGDPLEAYQQLRWTWNSQGVQLTNPTPYYINLIQVSVNGKALSNAGVVPPKSQRQTSWCQAIAPCHVAWRAINDYGGLSAKKEQNLP

SEQ ID NO: 6644 - protein, 235 aa, Escherichia coli; identical to SEQ ID NO: 6404
  strain ATCC 9637 / CCM 2024 / DSM 1116 / NCIMB 8666 / NRRL B-766 / W

SEQ ID NO: 6645 - protein, 360 aa, Escherichia coli
  strain ATCC 9637 / CCM 2024 / DSM 1116 / NCIMB 8666 / NRRL B-766 / W
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLQSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 6646 - protein, 837 aa, Escherichia coli
  strain ATCC 9637 / CCM 2024 / DSM 1116 / NCIMB 8666 / NRRL B-766 / W
MEQMYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEEAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSGRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 6647 - protein, 104 aa, Escherichia coli
  strain B / BL21-DE3
MGKNAEVWAAGLKYDANNIYLATTYSETQNMTVFGNNHIANKAQNFEAVAQYQFDFGLRPSVAYLQSKGKDLGVHGDRDLVKYVDVGATYYFNKNMSTFVDYKI

SEQ ID NO: 6648 - protein, 745 aa, Escherichia coli
  strain B / BL21-DE3
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAAIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 6649 - protein, 816 aa, Escherichia coli
  strain B / BL21-DE3
MNIYRLSFVSCLVMAMPCALAVEFNLNVLDKSMRDRIDISLLKEKGVIAPGEYFVSVAVNNNQISNGQKINWQKKGDKTIPCINDSLVDKFGLKPDIRQSLPQIDRCIDFSSRPEMLFNFDQANQQLNISIPQAWLAWHSENWAPPSTWKEGVAGVLMDYNLFASNYRPQDGSSSTNLNAYGTTGINAGSWRLRSDYQLNNTDSEDSHEQSGGISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 6650 - protein, 332 aa, Escherichia coli; identical to SEQ ID NO: 5757
  strain B / BL21-DE3

SEQ ID NO: 6651 - protein, 204 aa, Escherichia coli; identical to SEQ ID NO: 5755
  strain B / BL21-DE3

SEQ ID NO: 6652 - protein, 329 aa, Escherichia coli
  strain B / BL21-DE3
MGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGNPSGEGFTSGVTNNGRDALRQNGDGVGGSITYDYEGFGIGGAISSSKRTDAQNTAAYIGNGDRAETYTGGLKYDANNIYRAAQYTQTYNATRVGSLGWANKAQNFEAVAQYQFDFGLRPSLAYLQSKGKNLGRGYDDEDILKYVDVGATYYFNKNMSTYVDYKINLLDDNQFTRDAGINTDNIVALGLVYQF

SEQ ID NO: 6653 - protein, 510 aa, Escherichia coli
  strain B / BL21-DE3
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKETKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPVMLPTY

SEQ ID NO: 6654 - protein, 359 aa, Escherichia coli; identical to SEQ ID NO: 6332
  strain B / BL21-DE3

SEQ ID NO: 6655 - protein, 686 aa, Escherichia coli; identical to SEQ ID NO: 6339
  strain B / BL21-DE3

SEQ ID NO: 6656 - protein, 834 aa, Escherichia coli
  strain B / BL21-DE3
MYKKLKLTTISELIKNIYCSLSVIIIGCASAYAVEFNKDLIEAEDRENVNLSQFETDGQLPVGKYSLSTLINNKRTPIHLDLQWVLIDNQTAVCVTPEQLTLLGFTDEFIEKTQQNLIDGCYPIEKEKQITTYLDKGKMQLSISAPQAWLKYKDANWTPPELWNHGIAGAFLDYNLYASHYAPHQGDNSQNISSYGQAGVNLGAWRLRTDYQYDQSFNNGKSQATNLDFPRIYLFRPIPAMNAKLTIGQYDTESSIFDSFHFSGISLKSDENMLPPDLRGYAPQITGVAQTNAKVTVSQNNRIIYQENVPPGPFAITNLFNTLQGQLDVKVEEEDGRVTQWQVASNSIPYLTRKGQIRYTTAMGKPTNVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNEISHTASWYDSSDRNNSWSVSASGDNDEFKDMKASLRASYQHNTENGRLYLSGTSQRDSYYSLNASWNGSFTATRHGAAFHDYSGSADSRFMIDADGTEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTAILPCISQN

SEQ ID NO: 6657 - protein, 208 aa, Escherichia coli; identical to SEQ ID NO: 5717
  strain B / BL21-DE3

SEQ ID NO: 6658 - protein, 200 aa, Escherichia coli
  strain B / BL21-DE3
MLAFCRSSLKSKKYIIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRLLQCGNGIYSAIKDLQSKAPDKNIVIFTHNHCLTYIAKDKRDATFKPDYLDGLVMHVEKGKVYLDGEFVNH

SEQ ID NO: 6659 - protein, 162 aa, Escherichia coli; identical to SEQ ID NO: 6365
  strain B / BL21-DE3

SEQ ID NO: 6660 - protein, 828 aa, Escherichia coli
  strain B / BL21-DE3
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGTESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 6661 - protein, 345 aa, Escherichia coli
  strain B / BL21-DE3
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAG

SEQ ID NO: 6662 - protein, 161 aa, Escherichia coli; identical to SEQ ID NO: 5769
  strain B / BL21-DE3

SEQ ID NO: 6663 - protein, 266 aa, Escherichia coli
  strain B / BL21-DE3
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLLDQYAQLKTQYADKPKKRVFLQFGINPPFTSGKESIQNQVLEVCGGENIFKDSRVPWPQVSREQVLARSPQAIVITGGPDQIPKIKQYWGEQLKIPVIPLTSDWFERASPRIILAAQQLCNALSQVD

SEQ ID NO: 6664 - protein, 246 aa, Escherichia coli; identical to SEQ ID NO: 6342
  strain B / BL21-DE3

SEQ ID NO: 6665 - protein, 866 aa, Escherichia coli
  strain B / BL21-DE3
MTIKPTKNYHNHLTRIATFCALLYCNSAFCAELVEYDHTFLMGQNASNIDLSRYSEGNPAIPGMYDLSVYVNDQPIINQSITFIEIEGKKNAQACITLKNLLQFHINSPDINNEKAVLLARDETLGNCLNLTKIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 6666 - protein, 663 aa, Escherichia coli
  strain B / BL21-DE3
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFSAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 6667 - protein, 784 aa, Escherichia coli; identical to SEQ ID NO: 6283
  strain B / BL21-DE3

SEQ ID NO: 6668 - protein, 334 aa, Escherichia coli; identical to SEQ ID NO: 6377
  strain B / BL21-DE3

SEQ ID NO: 6669 - protein, 878 aa, Escherichia coli
  strain B / BL21-DE3
MSYLNLRLYQRNTQCLHIRKHRLAGFFVRLVVACAFAAQAPLSSADLYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 6670 - protein, 241 aa, Escherichia coli; identical to SEQ ID NO: 6143
  strain B / BL21-DE3

SEQ ID NO: 6671 - protein, 368 aa, Escherichia coli; identical to SEQ ID NO: 6380
  strain B / BL21-DE3

SEQ ID NO: 6672 - protein, 118 aa, Escherichia coli [sequence omitted]

SEQ ID NO: 6673 - protein, 774 aa, Escherichia coli
  strain B / BL21-DE3
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLTSRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 6674 - protein, 478 aa, Escherichia coli; identical to SEQ ID NO: 5711
  strain B / BL21-DE3

SEQ ID NO: 6675 - protein, 237 aa, Escherichia coli
  strain B / BL21-DE3
MRKITQAISAVCLLFALNSSAVALASSPSPLNPGTNVARLAEQAPIHWVSVAQIENSLAGRPPMAVGVDIDDTVLFSSPGFWRGKKTFSPESEDYLKNPVFWEKMNNGWDEFSIPKEVARQLIDMHVRRGDAIFFVTGRSPTKTETVSKTLADNFHIPATNMNPVIFAGDKPGQNTKSQWLQDKNIRIFYGDSDNDITAARDVGARGIRILRASNSTYKPLPQAGAFGEEVIVNSEY

SEQ ID NO: 6676 - protein, 102 aa, Escherichia coli
  strain B / BL21-DE3
MKKVLALVVAAAMGLSSAAFAAETATTPAPTATTTKAAPAKTTHHKKQHKAAPAQKAQAAKKHHKNAKAEQKAPEQKAQAAKKHAGKHSHQQPAKPAAQPAA

SEQ ID NO: 6677 - protein, 446 aa, Escherichia coli [sequence omitted]

SEQ ID NO: 6678 - protein, 700 aa, Escherichia coli
  strain B / BL21-DE3
MKIFSVRQTVLPALLALSPVVFAADEQTMIVSAAPQVVSELDTPAAVSVVDGEEMRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSSRDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDADVRYSSVWFDSNDHYVTPGNGDDSGDASYHKWLPAGSLKYAMTDAWNIYLAAGRGFETPTINELSYRADGQSGMNLGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 6679 - protein, 539 aa, Escherichia coli; identical to SEQ ID NO: 6391
  strain B / BL21-DE3

SEQ ID NO: 6680 - protein, 412 aa, Escherichia coli; identical to SEQ ID NO: 6495
  strain B / BL21-DE3

SEQ ID NO: 6681 - protein, 686 aa, Escherichia coli
  strain B / BL21-DE3
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANSEPSTPADSGNDYSLQAWSGQEGSEIYHVIFNGNVYKNAWWVGSKDCPRGTSAENSNNPWRLERTATAAELSQYGNPTTCEIDNGGVIVADGFQASKAYSADSIVDYNDAHYKTSVDQDAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLIRFNGVNYISQSKVQKVSPSDSNPWRVFVDWTGTKERVGTPKKAWPKHVYAPYVDFTLNTIPDLAALAKNHNVNHFTLAFVVSKDANTCLPTWGTAYGMHNYAQYSKIKALREAGGDVMLSIGGANNAPLAASCKNVDDLMQHYYDIVDNLNLKVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 6682 - protein, 338 aa, Escherichia coli
  strain B / BL21-DE3
MKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQQRIDGKSKALVGSEDLPVLDENTFNSHAPAPSSR

SEQ ID NO: 6683 - protein, 207 aa, Escherichia coli; identical to SEQ ID NO: 5743
  strain B / BL21-DE3

SEQ ID NO: 6684 - protein, 565 aa, Escherichia coli; identical to SEQ ID NO: 6395
  strain B / BL21-DE3

SEQ ID NO: 6685 - protein, 203 aa, Escherichia coli; identical to SEQ ID NO: 6396
  strain B / BL21-DE3

SEQ ID NO: 6686 - protein, 213 aa, Escherichia coli; identical to SEQ ID NO: 5744
  strain B / BL21-DE3

SEQ ID NO: 6687 - protein, 729 aa, Escherichia coli; identical to SEQ ID NO: 6531
  strain B / BL21-DE3

SEQ ID NO: 6688 - protein, 678 aa, Escherichia coli
  strain B / BL21-DE3
MVPSTFSRLKAARCLPVVLAALIFAGCGTHTPDQSTAYMQGTAQADSAFYLQQMQQSSDDTRINWQLLAIRALVKEGKTGQAVELFNQLPQELNDAQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQIAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITLRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRNLSWLQYQQGQVVPVS

SEQ ID NO: 6689 - protein, 838 aa, Escherichia coli
  strain B / BL21-DE3
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWDYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 6690 - protein, 231 aa, Escherichia coli
  strain B / BL21-DE3
MSKRTFAVILTLLCSFCIGQALAGGIVLQRTRVIYDASRKEAALPVANKGAETPYLLQSWVDNIDGKSRAPFIITPPLFRLEAGDDSSLRIIKTADNLPENKESLFYINVRTIPAKKKSDDVNANELTLVFKTRIKMFYRPAHLKGRVNDAWKSLEFKRSDHSLNIYNPTEYYVVFAGLAVDKIDLTSKIEYIAPGEHKQLPLPASGGKNVKWAAINDYGGSSGTETRPLQ

SEQ ID NO: 6691 - protein, 365 aa, Escherichia coli; identical to SEQ ID NO: 6335
  strain B / BL21-DE3

SEQ ID NO: 6692 - protein, 235 aa, Escherichia coli; identical to SEQ ID NO: 6404
  strain B / BL21-DE3

SEQ ID NO: 6693 - protein, 191 aa, Escherichia coli; identical to SEQ ID NO: 5748
  strain B / BL21-DE3

SEQ ID NO: 6694 - protein, 511 aa, Escherichia coli
  strain B / BL21-DE3
MMKMRWLSAAVMLTLYTSSSWAFSIDDVAKQAQSLAGKGYETPKSNLPSVFRDMKYADYQQIQFNHDKAYWNNLKTPFKLEFYHQGMYFDTPVKINEVTATAVKRIKYSPDYFTFGDVQHDKDTVKDLGFAGFKVLYPINSKDKNDEIVSMLGASYFRVIGAGQVYGLSARGLAIDTALPSGEEFPRFKEFWIERPKPTDKRLTIYALLDSPRATGAYKFVVMPGRDTVVDVQSKIYLRDKVGKLGVAPLTSMFLFGPNQPSPANNYRPELHDSNGLSIHAGNGEWIWRPLNNPKHLAVSSFSMENPQGFGLLQRGRDFSRFEDLDDRYDLRPSAWVTPKGEWGKGSVELVEIPTNDETNDNIVAYWTPDQLPEPGKEMNFKYTITFSRDEDKLHAPDNAWVQQTRRSTGDVKQSNLIRQPDGTIAFVVDFTGAEMKKLPEDTPVTAQTSIGDNGEIVESTVRYNPVTKGWRLVMRVKVKDAKKTTEMRAALVNADQTLSETWSYQLPANE

SEQ ID NO: 6695 - protein, 249 aa, Escherichia coli; identical to SEQ ID NO: 6407
  strain B / BL21-DE3

SEQ ID NO: 6696 - protein, 837 aa, Escherichia coli
  strain B / BL21-DE3
MDQMYKKLKLTTISELIKNIYCSLSVIIIGCASAYAVEFNKDLIEAEDRENVNLSQFETDGQLPVGKYSLSTLINNKRTPIHLDLQWVLIDNQTAVCVTPEQLTLLGFTDEFIEKTQQNLIDGCYPIEKEKQITTYLDKGKMQLSISAPQAWLKYKDANWTPPELWNHGIAGAFLDYNLYASHYAPHQGDNSQNISSYGQAGVNLGAWRLRTDYQYDQSFNNGKSQATNLDFPRIYLFRPIPAMNAKLTIGQYDTESSIFDSFHFSGISLKSDENMLPPDLRGYAPQITGVAQTNAKVTVSQNNRIIYQENVPPGPFAITNLFNTLQGQLDVKVEEEDGRVTQWQVASNSIPYLTRKGQIRYTTAMGKPTNVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNEISHTASWYDSSDRNNSWSVSASGDNDEFKDMKASLRASYQHNTENGRLYLSGTSQRDSYYSLNASWNGSFTATRHGAAFHDYSGSADSRFMIDADGTEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTAILPCISQN

SEQ ID NO: 6697 - protein, 236 aa, Escherichia coli; identical to SEQ ID NO: 6409
  strain B / BL21-DE3

SEQ ID NO: 6698 - protein, 866 aa, Escherichia coli
  strain B / BL21-DE3
MYRTHRQHSLLSSGGVPSFIGGLVVFVSAAFNAQAETWFDPAFFKDDPSMVADLSRFEKGQKITPGGYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNFGDFGAISFDATQAKSTLADQSEHKGQSYRFLYAKTLNHLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGISWNYSKSRGQPDADQVFALNFSLPLNLLLPRSNDSYTRKKNYAWMTSNTSIDNEGHTTQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGVQANSGIIDDDGSLYMAGLPAKGTISVRWGEAPDQICHINYELTEQQINSAITRMDAICR

SEQ ID NO: 6699 - protein, 233 aa, Escherichia coli; identical to SEQ ID NO: 6411
  strain B / BL21-DE3

SEQ ID NO: 6700 - protein, 362 aa, Escherichia coli; identical to SEQ ID NO: 5809
  strain B / BL21-DE3

SEQ ID NO: 6701 - protein, 203 aa, Escherichia coli; identical to SEQ ID NO: 6414
  strain B / BL21-DE3

SEQ ID NO: 6702 - protein, 360 aa, Escherichia coli
  strain B / BL21-DE3
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 6703 - protein, 760 aa, Escherichia coli
  strain B / BL21-DE3
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPVGVAKGSPVTTVDTARSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 6704 - protein, 331 aa, Escherichia coli; identical to SEQ ID NO: 6551
  strain B / BL21-DE3

SEQ ID NO: 6705 - protein, 432 aa, Escherichia coli; identical to SEQ ID NO: 5727
  strain B / BL21-DE3

SEQ ID NO: 6706 - protein, 430 aa, Escherichia coli; identical to SEQ ID NO: 5758
  strain B / BL21-DE3

SEQ ID NO: 6707 - protein, 819 aa, Escherichia coli
  strain B / BL21-DE3
MDTVNIYRLSFVSCLVMAMPCALAVEFNLNVLDKSMRDRIDISLLKEKGVIAPGEYFVSVAVNNNQISNGQKINWQKKGDKTIPCINDSLVDKFGLKPDIRQSLPQIDRCIDFSSRPEMLFNFDQANQQLNISIPQAWLAWHSENWAPPSTWKEGVAGVLMDYNLFASNYRPQDGSSSTNLNAYGTTGINAGSWRLRSDYQLNNTDSEDSHEQSGGISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 6708 - protein, 243 aa, Escherichia coli
  strain B / BL21-DE3
MTFMKGLPLLLLVASLCSHAALQPDRTRIVFNANDKATSLRVDNRSDKLPYLAYSWLENEKGEKSDDLLVALPPIQRLEPKATTQVRIVKQASTAKLPGDRETLFFYNMREIPPAPEKNSDHAVLQVAIQSRIKVFWRPAALRKKAGEKVELQLQVSQQGNQLTLKNPTAYYLTIAYLGRNEKGVFPGFKTVMIAPFSTVNTNTGSYSGSQFYLGYMDDYGALRMTTLNCSGECRLQAVEAKK

SEQ ID NO: 6709 - protein, 193 aa, Escherichia coli; identical to SEQ ID NO: 6300
  strain B / BL21-DE3

SEQ ID NO: 6710 - protein, 746 aa, Escherichia coli
  strain B / BL21-DE3
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSTTDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 6711 - protein, 869 aa, Escherichia coli
  strain B / BL21-DE3
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVHGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 6712 - protein, 230 aa, Escherichia coli; identical to SEQ ID NO: 6360
  strain B / BL21-DE3

SEQ ID NO: 6713 - protein, 881 aa, Escherichia coli
  strain B / BL21-DE3
MPDHSLFRLRILPWCIALAMSGSYSSVWAEDDIQFDSRFLELKGDTKIDLKRFSSQGYVEPGKYNLQVQLNKQPLAEEHDIYWYAGEDDASKTYACLTPELVAQFGLKEDVAKNLQWSHDGKCLKPGQLEGMEIKADLSQSALVISLPQAYLEYTWPDWDPPSRWDDGISGIIADYSITAQTRHEENGGDDSNEISGNGTVGVNLGPWRVRADWQTDYQHTRSNDDDDEFSGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRIQDLGDSISGTLHVRIEEQNGQVQEYDISTASMPYLTRPGQVRYKVMMGRPQEWGHHVEGGFFSGAEASWGIANGWSLYGGALGDKNYQSAALGIGRDLSTFGAVAFDVTHSHTKLDKDTAYGKGSLDGNSFRVSYSKDFDQLNSRVTFAGYRFSEENFMTMSEYLDASDSEMVRTGNDKEMYTATYNQNFRDAGVSVYLNYTRHTYWDREEQTNYNIMLSHYFNMGSIRNMSVSLTGYRYEYDNRADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAQGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNQQTVGLVDDDGNVYLAGVKPGEHMSVFWSGVAHCDINLPDPLPADLFNGLLLPCQHKGNVAPVVPDDIKPVIQEQTQQVTPGNPPVSISANQ

SEQ ID NO: 6714 - protein, 250 aa, Escherichia coli
  strain B / BL21-DE3
MSDLLCSAKLGATTLALLLSAASLSAQASVTPDRTRLIFNESDKSISVTLRNNDPKLPYLAQSWIEDEKGNKISSPLTVLPPVQRIDSMMNGQVKVQGMPDINKLPADRESMFYFNVREIPPKSDKPNTLQIALQTRIKLFWRPKALENTSMKSPWQHKVTLTRSGQAFTVNNPTPYYVIISNASAQKNGNPATGFSPLVIEPKTTVPLNVKMDSVPVLTYVNDFGARMPLFFRCDGNTCQVDKVQSLKG

SEQ ID NO: 6715 - protein, 274 aa, Escherichia coli
  strain B / BL21-DE3
MNKTAIALLALLASSASLAATPWQKITQPVPGSAQSIGSFSNGCIVGADMLPIQSEHYQVMRTDQRRYFGHPDLVMFIQRLSSQVSNLGMGTVLIGDMGMPAGGRFNGGHASHQTGLDVDIFLQLPKTRWTSAQLLRPQALDLVSRDGKHVVSTLWKPEIFSLIKLAAQDKDVTRIFVNPAIKQQLCLDAGTDRDWLRKVRPWFQHRAHMHVRLRCPADSLECEDQPLPPSGDGCGAELQSWFEPPKPGTTKPEKKTPPPLPPSCQALLDEHVI

SEQ ID NO: 6716 - protein, 822 aa, Escherichia coli
  strain B / BL21-DE3
MIKNIYCSLSVIIIGCASAYAVEFNKDLIEAEDRENVNLSQFETDGQLPVGKYSLSTLINNKRTPIHLDLQWVLIDNQTAVCVTPEQLTLLGFTDEFIEKTQQNLIDGCYPIEKEKQITTYLDKGKMQLSISAPQAWLKYKDANWTPPELWNHGIAGAFLDYNLYASHYAPHQGDNSQNISSYGQAGVNLGAWRLRTDYQYDQSFNNGKSQATNLDFPRIYLFRPIPAMNAKLTIGQYDTESSIFDSFHFSGISLKSDENMLPPDLRGYAPQITGVAQTNAKVTVSQNNRIIYQENVPPGPFAITNLFNTLQGQLDVKVEEEDGRVTQWQVASNSIPYLTRKGQIRYTTAMGKPTNVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNEISHTASWYDSSDRNNSWSVSASGDNDEFKDMKASLRASYQHNTENGRLYLSGTSQRDSYYSLNASWNGSFTATRHGAAFHDYSGSADSRFMIDADGTEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTAILPCISQN

SEQ ID NO: 6717 - protein, 311 aa, Escherichia coli
  strain B / BL21-DE3
MRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGNPSGEGFTSGVTNNGRDALRQNGDGVGGSITYDYEGFGIGGAISSSKRTDAQNTAAYIGNGDRAETYTGGLKYDANNIYRAAQYTQTYNATRVGSLGWANKAQNFEAVAQYQFDFGLRPSLAYLQSKGKNLGRGYDDEDILKYVDVGATYYFNKNMSTYVDYKINLLDDNQFTRDAGINTDNIVALGLVYQF

SEQ ID NO: 6718 - protein, 747 aa, Escherichia coli
  strain B / BL21-DE3
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAAIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 6719 - protein, 345 aa, Escherichia coli; identical to SEQ ID NO: 6661
  strain B / REL606

SEQ ID NO: 6720 - protein, 230 aa, Escherichia coli; identical to SEQ ID NO: 6360
  strain B / REL606

SEQ ID NO: 6721 - protein, 869 aa, Escherichia coli; identical to SEQ ID NO: 6711
  strain B / REL606

SEQ ID NO: 6722 - protein, 746 aa, Escherichia coli; identical to SEQ ID NO: 6710
  strain B / REL606

SEQ ID NO: 6723 - protein, 432 aa, Escherichia coli; identical to SEQ ID NO: 5727
  strain B / REL606

SEQ ID NO: 6724 - protein, 193 aa, Escherichia coli; identical to SEQ ID NO: 6300
  strain B / REL606

SEQ ID NO: 6725 - protein, 243 aa, Escherichia coli; identical to SEQ ID NO: 6708
  strain B / REL606

SEQ ID NO: 6726 - protein, 816 aa, Escherichia coli; identical to SEQ ID NO: 6649
  strain B / REL606

SEQ ID NO: 6727 - protein, 430 aa, Escherichia coli; identical to SEQ ID NO: 5758
  strain B / REL606

SEQ ID NO: 6728 - protein, 359 aa, Escherichia coli; identical to SEQ ID NO: 6332
  strain B / REL606

SEQ ID NO: 6729 - protein, 686 aa, Escherichia coli; identical to SEQ ID NO: 6339
  strain B / REL606

SEQ ID NO: 6730 - protein, 332 aa, Escherichia coli; identical to SEQ ID NO: 5757
  strain B / REL606

SEQ ID NO: 6731 - protein, 760 aa, Escherichia coli; identical to SEQ ID NO: 6703
  strain B / REL606

SEQ ID NO: 6732 - protein, 822 aa, Escherichia coli; identical to SEQ ID NO: 6716
  strain B / REL606

SEQ ID NO: 6733 - protein, 249 aa, Escherichia coli; identical to SEQ ID NO: 6407
  strain B / REL606

SEQ ID NO: 6734 - protein, 204 aa, Escherichia coli; identical to SEQ ID NO: 5755
  strain B / REL606

SEQ ID NO: 6735 - protein, 362 aa, Escherichia coli; identical to SEQ ID NO: 5809
  strain B / REL606

SEQ ID NO: 6736 - protein, 233 aa, Escherichia coli; identical to SEQ ID NO: 6411
  strain B / REL606

SEQ ID NO: 6737 - protein, 866 aa, Escherichia coli; identical to SEQ ID NO: 6698
  strain B / REL606

SEQ ID NO: 6738 - protein, 236 aa, Escherichia coli; identical to SEQ ID NO: 6409
  strain B / REL606

SEQ ID NO: 6739 - protein, 231 aa, Escherichia coli; identical to SEQ ID NO: 6690
  strain B / REL606

SEQ ID NO: 6740 - protein, 838 aa, Escherichia coli; identical to SEQ ID NO: 6689
  strain B / REL606

SEQ ID NO: 6741 - protein, 678 aa, Escherichia coli; identical to SEQ ID NO: 6688
  strain B / REL606

SEQ ID NO: 6742 - protein, 511 aa, Escherichia coli; identical to SEQ ID NO: 6694
  strain B / REL606

SEQ ID NO: 6743 - protein, 191 aa, Escherichia coli; identical to SEQ ID NO: 5748
  strain B / REL606

SEQ ID NO: 6744 - protein, 232 aa, Escherichia coli; identical to SEQ ID NO: 5747
  strain B / REL606

SEQ ID NO: 6745 - protein, 365 aa, Escherichia coli; identical to SEQ ID NO: 6335
  strain B / REL606

SEQ ID NO: 6746 - protein, 729 aa, Escherichia coli; identical to SEQ ID NO: 6531
  strain B / REL606

SEQ ID NO: 6747 - protein, 213 aa, Escherichia coli; identical to SEQ ID NO: 5744
  strain B / REL606

SEQ ID NO: 6748 - protein, 650 aa, Escherichia coli
  strain B / REL606
MKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEEIEEGNTRVYYLKYAKATNLVEVLTGVSEKLKDEKGNARKPSSSGAMDNVAITADEQTNSLVITADQSVQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQQRIDGKSKALVGSEDLPVLDENTFNSHAPAPSSR

SEQ ID NO: 6749 - protein, 897 aa, Escherichia coli
  strain B / REL606
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEISQYGNPGSCSVKPDNNGGTVTPVDPTPETPVTPTPDNSEPSTPADSGNDYSLQAWSGQEGSEIYHVIFNGNVYKNAWWVGSKDCPRGTSAENSNNPWRLERTATAAELSQYGNPTTCEIDNGGVIVADGFQASKAYSADSIVDYNDAHYKTSVDQDAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLIRFNGVNYISQSKVQKVSPSDSNPWRVFVDWTGTKERVGTPKKAWPKHVYAPYVDFTLNTIPDLAALAKNHNVNHFTLAFVVSKDANTCLPTWGTAYGMHNYAQYSKIKALREAGGDVMLSIGGANNAPLAASCKNVDDLMQHYYDIVDNLNLKVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 6750 - protein, 412 aa, Escherichia coli; identical to SEQ ID NO: 6495
  strain B / REL606

SEQ ID NO: 6751 - protein, 203 aa, Escherichia coli; identical to SEQ ID NO: 6396
  strain B / REL606

SEQ ID NO: 6752 - protein, 565 aa, Escherichia coli; identical to SEQ ID NO: 6395
  strain B / REL606

SEQ ID NO: 6753 - protein, 207 aa, Escherichia coli; identical to SEQ ID NO: 5743
  strain B / REL606

SEQ ID NO: 6754 - protein, 541 aa, Escherichia coli
  strain B / REL606
MAMAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFSEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 6755 - protein, 700 aa, Escherichia coli; identical to SEQ ID NO: 6678
  strain B / REL606

SEQ ID NO: 6756 - protein, 102 aa, Escherichia coli; identical to SEQ ID NO: 6676
  strain B / REL606

SEQ ID NO: 6757 - protein, 208 aa, Escherichia coli; identical to SEQ ID NO: 5717
  strain B / REL606

SEQ ID NO: 6758 - protein, 614 aa, Escherichia coli
  strain B / REL606
MIKKASLLTACSVTAFSAWAQDTSPDTLVVTANRFEQPRSTVLAPTTVVTRQDIDRWLSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 6759 - protein, 446 aa, Escherichia coli [sequence omitted]

SEQ ID NO: 6760 - protein, 237 aa, Escherichia coli
  strain B / REL606
MRKITQAISAVCLLFALNSSAVALASSPSPLNPGTNVARLAEQAPIHWVSVAQIENSLAGRPPMAVEVDIDDTVLFSSPGFWRGKKTFSPESEDYLKNPVFWEKMNNGWDEFSIPKEVARQLIDMHVRRGDAIFFVTGRSPTKTETVSKTLADNFHIPATNMNPVIFAGDKPGQNTKSQWLQDKNIRIFYGDSDNDITAARDVGARGIRILRASNSTYKPLPQAGAFGEEVIVNSEY

SEQ ID NO: 6761 - protein, 122 aa, Escherichia coli; identical to SEQ ID NO: 5737
  strain B / REL606

SEQ ID NO: 6762 - protein, 334 aa, Escherichia coli; identical to SEQ ID NO: 6566
  strain B / REL606

SEQ ID NO: 6763 - protein, 478 aa, Escherichia coli; identical to SEQ ID NO: 5711
  strain B / REL606

SEQ ID NO: 6764 - protein, 774 aa, Escherichia coli; identical to SEQ ID NO: 6673
  strain B / REL606

SEQ ID NO: 6765 - protein, 368 aa, Escherichia coli; identical to SEQ ID NO: 6380
  strain B / REL606

SEQ ID NO: 6766 - protein, 241 aa, Escherichia coli; identical to SEQ ID NO: 6143
  strain B / REL606

SEQ ID NO: 6767 - protein, 878 aa, Escherichia coli; identical to SEQ ID NO: 6669
  strain B / REL606

SEQ ID NO: 6768 - protein, 784 aa, Escherichia coli; identical to SEQ ID NO: 6283
  strain B / REL606

SEQ ID NO: 6769 - protein, 663 aa, Escherichia coli; identical to SEQ ID NO: 6666
  strain B / REL606

SEQ ID NO: 6770 - protein, 828 aa, Escherichia coli; identical to SEQ ID NO: 6660
  strain B / REL606

SEQ ID NO: 6771 - protein, 162 aa, Escherichia coli; identical to SEQ ID NO: 6365
  strain B / REL606

SEQ ID NO: 6772 - protein, 311 aa, Escherichia coli; identical to SEQ ID NO: 6717
  strain B / REL606

SEQ ID NO: 6773 - protein, 200 aa, Escherichia coli; identical to SEQ ID NO: 6658
  strain B / REL606

SEQ ID NO: 6774 - protein, 170 aa, Escherichia coli [sequence omitted]

SEQ ID NO: 6775 - protein, 866 aa, Escherichia coli; identical to SEQ ID NO: 6665
  strain B / REL606

SEQ ID NO: 6776 - protein, 246 aa, Escherichia coli; identical to SEQ ID NO: 6342
  strain B / REL606

SEQ ID NO: 6777 - protein, 747 aa, Escherichia coli; identical to SEQ ID NO: 6718
  strain B / REL606

SEQ ID NO: 6778 - protein, 266 aa, Escherichia coli; identical to SEQ ID NO: 6663
  strain B / REL606

SEQ ID NO: 6779 - protein, 161 aa, Escherichia coli; identical to SEQ ID NO: 5769
  strain B / REL606

SEQ ID NO: 6780 - protein, 274 aa, Escherichia coli; identical to SEQ ID NO: 6715
  strain B / REL606

SEQ ID NO: 6781 - protein, 250 aa, Escherichia coli; identical to SEQ ID NO: 6714
  strain B / REL606

SEQ ID NO: 6782 - protein, 881 aa, Escherichia coli; identical to SEQ ID NO: 6713
  strain B / REL606

SEQ ID NO: 6783 - protein, 746 aa, Escherichia coli
  strain 'clone D i14'
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKAAQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 6784 - protein, 193 aa, Escherichia coli; identical to SEQ ID NO: 6300
  strain 'clone D i14'

SEQ ID NO: 6785 - protein, 360 aa, Escherichia coli; identical to SEQ ID NO: 6702
  strain 'clone D i14'

SEQ ID NO: 6786 - protein, 614 aa, Escherichia coli; identical to SEQ ID NO: 5872
  strain 'clone D i14'

SEQ ID NO: 6787 - protein, 696 aa, Escherichia coli
  strain 'clone D i14'
MRITTLASVVIPCLGFSASSIAAAEDVMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASAQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTVGSRYEHHEQFGGHFSPRAYLVWDVADAWTLKGGVTTGYKAPRMGQLHKGISGVSGQGKTNLLGNPDLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 6788 - protein, 733 aa, Escherichia coli; identical to SEQ ID NO: 6152
  strain 'clone D i14'

SEQ ID NO: 6789 - protein, 446 aa, Escherichia coli; identical to SEQ ID NO: 5873
  strain 'clone D i14'

SEQ ID NO: 6790 - protein, 260 aa, Escherichia coli
  strain 'clone D i14'
MVRWFFQQTHNNKFQLTDYLGKNMRKITQALSAVCLLFALNSSAVALASSPSPLNPGTNVAKLAEQAPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPATNMNPVIFAGDKPGQNTKSQWLQDKNIRIFYGDSDNDITAARDVGARGIRILRASNSTYKPLPQAGAFGEEVIVNSEY

SEQ ID NO: 6791 - protein, 431 aa, Escherichia coli
  strain 'clone D i14'
MMKQALRVAFGFLILWASVLHAEVRIVIDSGVDSGRPIGVVPFQWAGPGAAPEDIGGIVAADLRNSGKFNPLDRARLPQQPGSAQEVQPAAWSALGIDAVVVGQVTPNPDGSYNVAYQLVDTGGAPGTVLAQNSYKVNKQWLRYAGHTASDEVFEKLTGIKGAFRTRIAYVVQTNGGQFPYELRVSDYDGYNQFVVHRSPQPLMSPAWSPDGSKLAYVTFESGRSALVIQTLANGAVRQVASFPRHNGAPAFSPDGSKLAFALSKTGSLNLYVMDLASGQIRQVTDGRSNNTEPTWFPDSQNLAFTSDQAGRPQVYKVNINGGAPQRITWEGSQNQDADVSSDGKFMVMVSSNGGQQHIAKQDLATGGVQVLSSTFLDETPSLAPNGTMVIYSSSQGMGSVLNLVSTDGRFKARLPATDGQVKFPAWSPYL

SEQ ID NO: 6792 - protein, 332 aa, Escherichia coli
  strain 'clone D i14'
MMKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLVAPSDGTLLTRAVEPGTVLNEGGTVFTVSLTRPVWVRAYVDERNLDQAQPGRKVLLYTDGRPNKPYHGQIGFVSPTAEFTPKTVETPDLRTDLVYRLRIVVTDADDALRQGMPVTVQFGDEAGHE

SEQ ID NO: 6793 - protein, 760 aa, Escherichia coli
  strain 'clone D i14'
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDLSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 6794 - protein, 122 aa, Escherichia coli; identical to SEQ ID NO: 5737
  strain 'clone D i14'

SEQ ID NO: 6795 - protein, 686 aa, Escherichia coli
  strain 'clone D i14'
MFWRDMTLSVWRKKTTGLKTKKRLLALVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 6796 - protein, 478 aa, Escherichia coli
  strain 'clone D i14'
MTRIKINARRIFSLLIPFFFFTSVHAEQTAAPATPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 6797 - protein, 360 aa, Escherichia coli; identical to SEQ ID NO: 5891
  strain 'clone D i14'

SEQ ID NO: 6798 - protein, 334 aa, Escherichia coli
  strain 'clone D i14'
MKKNQFLKESDVTAESVFFMKRRQVLKALGISAAAFSLPHAAHADLLSWFKGNDRPPAPAGKPLEFSKPAAWQNNLPLTPADKVSGYNNFYEFGLDKADPAANAGSLKTDPWTLKISGEVAKPLTLDHDDLTRRFPLEERIYRMRCVEAWSMVVPWIGFPLHKLLALAEPTSNAKYVAFETIYAPEQMPGQQDRFIGGGLKYPYVEGLRLDEAMHPLTLMTVGVYGKALPPQNGAPVRLIVPWKYGFKGIKSIVSIKLTRERPPTTWNLVAPDEYGFYANVNPHVDHPRWSQATERFIGSGGILDVQRQPTLLFNGYADQVASLYRGLDLRENF

SEQ ID NO: 6799 - protein, 713 aa, Escherichia coli; identical to SEQ ID NO: 6056
  strain 'clone D i14'

SEQ ID NO: 6800 - protein, 222 aa, Escherichia coli; identical to SEQ ID NO: 5850
  strain 'clone D i14'

SEQ ID NO: 6801 - protein, 840 aa, Escherichia coli; identical to SEQ ID NO: 5851
  strain 'clone D i14'

SEQ ID NO: 6802 - protein, 249 aa, Escherichia coli; identical to SEQ ID NO: 5852
  strain 'clone D i14'

SEQ ID NO: 6803 - protein, 204 aa, Escherichia coli; identical to SEQ ID NO: 5755
  strain 'clone D i14'

SEQ ID NO: 6804 - protein, 362 aa, Escherichia coli; identical to SEQ ID NO: 5874
  strain 'clone D i14'

SEQ ID NO: 6805 - protein, 673 aa, Escherichia coli; identical to SEQ ID NO: 6170
  strain 'clone D i14'

SEQ ID NO: 6806 - protein, 715 aa, Escherichia coli
  strain 'clone D i14'
MLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWRFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 6807 - protein, 721 aa, Escherichia coli
  strain 'clone D i14'
MKTQITFAALLPALASFIPLHAHASSTSEDEMIVTGNTAADTTDSAAGAGFKTNDIDVGPLGTKSWIETPYSSTTVTKEMIENQQAQSVSEMLKYSPSTQMQARGGMDVGRPQSRGMQGSVVANSRLDGLNIVSTTAFPVEMLERMDVLNSLTGALYGPASPAGQFNFVAKRPTEETLRKVTLGYQSRSAFTGHADLGGHFDENKRFGYRVNLLDQEGEGNVDDSTLRRKLVSVALDWNIQPGTQLQLDASHYEFIQKGYVGSFNYGPNVKLPSAPNPKDKNLALSTAGNDLTTDTISTRLIHYFNDDWSMNAGVGWQQADRAMRSVSSKILNNQGDISRSMKDSTAAGRFRVLSNTAGLNGHIDTGSIGHDLSLSTTGYVWSLYSAKGTGSSYSWGTTNMYHPDAIDEQGDGKIRTGGPRYRSSVNTQQSVTLGDTVTFTPQWSAMFYLSQSWLQTKNYDKHGNQTNQVDENGLSPNAALMYKITPNTMAYVSYADSLEQGGTAPTDESVKNAGQTLNPYRSKQYEVGLKSDIGEMNLGAALFRLERPFAYLDTDNVYKEQGNQVNNGLELTAAGNVWQGLNIYSGVTFLDPKLKDTANASTSNKQVVGVPKVQANLLAEYSLPSIPEWVYSANVHYTGKRAANDTNTSYASSYTTWDLGTRYTTKVSNVPTTFRVVVNNVFDKHYWASIFPSGTDGDNGSPSAFIGGGREVRASVTFDF

SEQ ID NO: 6808 - protein, 241 aa, Escherichia coli; identical to SEQ ID NO: 6139
  strain 'clone D i14'

SEQ ID NO: 6809 - protein, 878 aa, Escherichia coli
  strain 'clone D i14'
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 6810 - protein, 231 aa, Escherichia coli; identical to SEQ ID NO: 6154
  strain 'clone D i14'

SEQ ID NO: 6811 - protein, 892 aa, Escherichia coli
  strain 'clone D i14'
MCLAADFIFSLSVGADMFFGDGGQLLSDKSLTGSAGGGNNRMKFNILPLAFFIGIIVSPARAELYFNPRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQLYMSNQARGYIAPEYWDNGITAALLNYDFSGNRVRDSYGGTSDYAYLNLKTGLNIGSWRLRDNTSWSYSAGKGYSQNNWQHINTWLERDIVSLRSRLTMGDSYTRGDIFDGVNFRGIQLASDDNMVPDSQRGYAPTIHGISRGTSRISIRQNGYEIYQSTLPPGPFEINDIYPAGSGGDLQVTLQEADGSVQRFNVPWSSVPVLQREGHLKYALSAGEFRSGGHQQDNPRFAEGTLKYGLPAGWTVYGGAWIAERYRAFNLGVGKNMGWLGAVSLDATRANARLPDESRHDGQSYRFLYNKSLTETGTNIQLIGYRYSTRGYFSFADTAWKKMSGYSVLTQDGVIQIQPKYTDYYNLAYNKRGRVQVSISQQTGESSTLYLSGSHQSYWGTDRTDRQLNAGFNSSVNDISWSLNYSLSRNAWQHETDRILSFDVSIPFSHWMRSDSTSAWRNASARYSQTLEAHGQAASTAGLYGTLLGDNNLGYSIQSGYTRGGYEGSSKTGYASLNYRGGYGNASAGYSHSGGYRQLYYGLSGGILAHANGLTLSQPLGDTLILVRAPGASDTRIENQTGVSTDWRGYAVLPYATDYRENRVALDTNTLADNVDIENTVVSVVPTHGAVVRADYKTRVGVKVLMTLMRNGKAVPFGSVVTARNGGSSIAGENGQVYLSGMPLSGQVSVKWGSQTTDQCTADYKLPKESAGQILSHVTASCR

SEQ ID NO: 6812 - protein, 725 aa, Escherichia coli; identical to SEQ ID NO: 6277
  strain 'clone D i14'

SEQ ID NO: 6813 - protein, 656 aa, Escherichia coli; identical to SEQ ID NO: 6178
  strain 'clone D i14'

SEQ ID NO: 6814 - protein, 831 aa, Escherichia coli
  strain 'clone D i14'
MQELPMLRMTPLASAIVALLIGIEAYAAEETFDTHFMIGGMKDQQVSNIRLEDNQPLPGPYDIDIYVNKQWRGKYEIIVKDNPQETCLSREMIKRLGINTDSFASGKQCLTFKQLIQGGSYTWDIGVFRLDFSVPQAWVEDLESGYVPPENWERGINAFYTSYYVSQYYSDYKASGNSKSTYVRFNSGLNLQGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSIQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESRNYICQ

SEQ ID NO: 6815 - protein, 224 aa, Escherichia coli; identical to SEQ ID NO: 5893
  strain 'clone D i14'

SEQ ID NO: 6816 - protein, 654 aa, Escherichia coli
  strain 'clone D i14'
MDSAMKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNSRKPSSTSAMDNVAITADEQTNSLVITADQSVQEKLATVIARLDIRRAQVLVEAIIVEVQDGNGLNLGVQWANKNVGAQQFTNTGLPVFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQLRIDGKSKALIGSEDLPVLDENTFNSHAPAPSSR

SEQ ID NO: 6817 - protein, 517 aa, Escherichia coli
  strain 'clone D i14'
MKHKLQMMKMRWLSAAVMLTLYTSSSWAFSIDDVAKQAQSLAGKGYEAPKSNLPSVFRDMKYADYQQIQFNHDKAYWNNLKTPFKLEFYHQGMYFDTPVKINEVTATAVKRIKYSPDYFTFGDVQHDKDTVKDLGFAGFKVLYPINSKDKNDEIVSMLGASYFRVIGAGQVYGLSARGLAIDTALPSGEEFPRFKEFWIERPKPTDKRLTIYALLDSPRATGAYKFVVMPGRDTVVDVQSKIYLRDKVGKLGVAPLTSMFLFGPNQPSPANNYRPELHDSNGLSIHAGNGEWIWRPLNNPKHLAVSSFSMENPQGFGLLQRGRDFSRFEDLDDRYDLRPSAWVTPKGEWGKGSVELVEIPTNDETNDNIVAYWTPDQLPEPGKEMNFKYTITFSRDEDKLHAPDNAWVQQTRRSTGDVKQSNLIRQPDGTIAFVVDFTGAEMKKLPEDTPVTAQTSIGDNGEIVESTVRYNPVTKGWRLVMRVKVKDAKKTTEMRAALVNADQTLSETWSYQLPANE

SEQ ID NO: 6818 - protein, 191 aa, Escherichia coli
  strain 'clone D i14'
MKKSLLGLTFASLMFSAGSAVAADYKIDKEGQHAFVNFRIQHLGYSWLYGTFKDFDGTFTFDEKNPAADKVNVTINTTSVDTNHTERDKHLRSADFLNTAKYPQATFTSTSVKKDGDELDITGDLTLNGVTKPVTLEAKLIGQGDDPWGGKRAGFEAEGKIKLKDFNIKTDLGPASQEVDLIISVEGVQQK

SEQ ID NO: 6819 - protein, 237 aa, Escherichia coli
  strain 'clone D i14'
MKMIAMQKNAAHTYAISSLLVLSLTGCAWIPSTPLVQGATSAQPVPGPTPVANGSIFQSAQPINYGYQPLFEDRRPRNIGDTLTIVLQENVSASKSSSANASRDGKTNFGFDTVPRYLQGVFGNARADVEASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 6820 - protein, 366 aa, Escherichia coli
  strain 'clone D i14'
MVIKFLSALILLLVTTAVQAERIRDLTSVQGVRQNSLIGYGLVVGLDGTGDQTTQTPFTTQTLNNMLSQLGITVPTGTNMQLKNVAAVMVTASLPPFGRQGQTIDVVVSSMGNAKSLRGGTLLMTPLKGVDSQVYALAQGNILVGGAGASAGGSSVQVNQLNGGRITNGAVIERELPSQFGVGNTLNLQLNDEDFSMAQQIADTINRVRGYGSATALDARTIQVRVPSGNSSQVRFLADIQNMQVNVTPQDAKVVINSRTGSVVMNREVTLDSCAVAQGNLSVTVNRQANVSQPDTPFGGGQTVVTPQTQIDLRQSGGSLQSVRSSASLNNVVRALNALGATPMDLMSILQSMQSAGCLRAKLEII

SEQ ID NO: 6821 - protein, 729 aa, Escherichia coli
  strain 'clone D i14'
MLSTQFNRDNQHQAIIKPSLLAGCIALALLPSAAFAAPVTEETVIVEGSATAPDDGENDYNVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLTPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 6822 - protein, 214 aa, Escherichia coli
  strain 'clone D i14'
MMTKMSRYALITALAMFLAGCVGQREPAPVEEVKPAPEQPAEPQQPVPTVPSVPTIPQQPGPIEHEDQTAPLAPHIRHYDWNGAMQPMVSKMLGADGVTAGSVLLVDSVNNRTNGSLNAAEATETLRNALANNGKFTLVSAQQLSMAKQQLGLSPQDSLGTRSKAIGIARNVGAHYVLYSSASGNVNAPTLQMQLMLVQTGEIIWSGKGAVSQQ

SEQ ID NO: 6823 - protein, 663 aa, Escherichia coli; identical to SEQ ID NO: 5894
  strain 'clone D i14'

SEQ ID NO: 6824 - protein, 828 aa, Escherichia coli; identical to SEQ ID NO: 6558
  strain 'clone D i14'

SEQ ID NO: 6825 - protein, 162 aa, Escherichia coli; identical to SEQ ID NO: 5896
  strain 'clone D i14'

SEQ ID NO: 6826 - protein, 375 aa, Escherichia coli; identical to SEQ ID NO: 5922
  strain 'clone D i14'

SEQ ID NO: 6827 - protein, 900 aa, Escherichia coli
  strain 'clone D i14'
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEITQYGNPGSCSVKPDNNGGAVTPVDPTPETPETPVTPTPDNNEPSTPADSSNDYSLQAWSGQEGSEIYHVIFNGNVYQNAWWVGSEDCPRGTSVENSNNPWRLVRTATAAEMSQYGNPTTCEIDNGGVIIANGFQASKAYSANSIVDYNDAHYKTSVDQDAWGFVPGGDNPWKKYEPAKAWSASTVYVKGDRVVVDGQAYEALFWTQSDNPALVANQNATGSNSRPWKPLGKTQSYSNEELNNAPQFNPETLYASDTLIRFNGENYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 6828 - protein, 412 aa, Escherichia coli
  strain 'clone D i14'
MKQWIAALLLMLIPGVQAAKPQKVTLMVDDVPVAQVLQALAEQEKLNLVVSPDVSGTVSLHLTDVPWKQALQTVVKSAGLITRQEGNILSVHSVAWQNDNIARQEAEQARAQANLPLENRNITLQYADAGELAKAGEKLLSAKGSMTVDKRTNRLLLRDNKTALSTLEQWVSQMDLPVGQVELSAHIVTINEKSLRELGVKWTLADAQQAGGVGQVTTLGSDLSVATATTHIGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 6829 - protein, 784 aa, Escherichia coli
  strain 'clone D i14'
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYKDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLAESANRVMPQFKVDGRMVFERDMEMLAPGYTQTLEPRAQYLYVPYRDQSKIYNYDSSLLQSDYSGLFRDRTYGGLDRIASANQVTTGVTSRIYDDAAVERFNISVGQIYYFTESRTGDDNITWENDDKTGSLVWAGDTYWRISDRWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 6830 - protein, 209 aa, Escherichia coli
  strain 'clone D i14'
MRLSTGGVYVLAFCRSSLKSKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRFLQCGNEIYSAIKDLQRKAPDKNIVIFTHNHCLTYIAKDKRDATFKPDYLDGLVMHVEKGKVYLDGEFVNH

SEQ ID NO: 6831 - protein, 265 aa, Escherichia coli
  strain 'clone D i14'
MSNQGMQMRQYRLLSPMIKVVIVLFSLLFSTAQAGLVIGGTRFAYPENQSSISVELKNTSDRDMLVKVAVSPDDARQLTGTVESLPSYSETVFIATPPLFILKPDKNTKIRINRVGGSLPADRESLFILNVAALPTLENSHSVKTDNQLQIAVRNRMKIFYRPSNLSEDPNMSYQKLRWARKNEIVTVYNPGPRYVTLYNLHVDGKVIDGGMVAPFSHRQQSWCKSQGVCEIAWQTLDIYNNVLPILKVKLNPSQLDVTGFAFSQ

SEQ ID NO: 6832 - protein, 259 aa, Escherichia coli
  strain 'clone D i14'
MLFHQQGCCMKCIIGNKKWVCGFRDELKVSQNIIRSGILFLLSILFINNASAGGFGLGVTRLIYPAESKQITLSVQNSGDNTSYLIQSWVDDSKTEKKSQDFVITPPLFMLPTRKEASLRIMFLGKTNLPTDRETLYWMNVKAIPPTDEKNTQKNTLQLALQNKIKLFYRPENLPVQPGKARNMLRFKYEGKQLKVINPSPYYLTLTGIKVQGSKLPNMFVPPKSDITVSSPVTLAGEITYQTINDFGATTERQKGIMQ

SEQ ID NO: 6833 - protein, 380 aa, Escherichia coli
  strain 'clone D i14'
MNICSAVTSFFNKSSKKGRTMKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTDGQVAYGKSKFNASGKNAEVWAAGLKYDANNIYLATTYSETQNMTVFDNNHIANKAQNFEAVAQYQFDFGLRPSVAYLQSKGKDLGVHGDRDLVKYVDVGATYYFNKNMSTFVDYKINLIDDSKFTKTAGIDTDDIVAVGLVYQF

SEQ ID NO: 6834 - protein, 274 aa, Escherichia coli; identical to SEQ ID NO: 5899
  strain 'clone D i14'

SEQ ID NO: 6835 - protein, 250 aa, Escherichia coli; identical to SEQ ID NO: 6150
  strain 'clone D i14'

SEQ ID NO: 6836 - protein, 884 aa, Escherichia coli; identical to SEQ ID NO: 6149
  strain 'clone D i14'

SEQ ID NO: 6837 - protein, 660 aa, Escherichia coli
  strain 'clone D i14'
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 6838 - protein, 862 aa, Escherichia coli
  strain 'clone D i14'
MTIKSTNHLTHIATFCALLYSNSALCAELVEYDHTFLMGKDASNIDLSRYTEGNPTLPGIYDVSVYVNDQPIMSQSIAFAVIEGKKNAQACITQKNLLQFHISSPDKNSEKAILLKRDDDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAIMNIVRSDGKNIPFAADIYDEQNNIIGNVGQGGQAFVRGIEQEGNIRITWIEEGKPVSCFAHYQQNTTSEKIAQSIILNGLRCQIQ

SEQ ID NO: 6839 - protein, 246 aa, Escherichia coli; identical to SEQ ID NO: 5857
  strain 'clone D i14'

SEQ ID NO: 6840 - protein, 752 aa, Escherichia coli
  strain 'clone D i14'
MAPSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVAVGTRGASNTYDYLIIRGFAADGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMIGYSFDHEFNDTFTVRQNLRFAQNKVSQKSIYGYGMCSDPLYTKDQEALKASPCLSIPQSQWGHTLTRQYVIDNEKLENFSVDTQLQSKFATGSVDHTLLTGVDFMRMRNDIDSWFGYAGSVAPSDIYNLDRSDFDFGAHPNPSGPYRVLLKQKQTGLYVQDQAQWDKVLVTLGGRYDWADQSSFNRDYGNKSERDDKEFTWRGGVNYLFDNGVTPYFSYSESFEPASQTDANGDLFAPSKGKQYEVGVKYVPEDRPIVVTGALYQLTKTNNLMADPNGSLFSVEGGEIRARGVELEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 6841 - protein, 266 aa, Escherichia coli
  strain 'clone D i14'
MAKSLFRALVALSFLAPLWLNAAPRVITLSPANTELAFAAGITPVGVSSYSDYPLQAQKIEQVSTWQGMNLERIVALKPDLVIAWRGGNAERQVDQLASLGIKVMWVDATSIEQIANALRQLAPWSPQPDKAEQAAQSLLDQYAQLKAQYADKPKKRVFLQFGINPPFTSGKESIQNQVLEVCGGENIFKDSRVPWPQVSREQVLARSPQAIVITGGPDQIPKIKQYWGEQLKIPVIPLTSDWFERASPRIILAAQQLCNALSQVD

SEQ ID NO: 6842 - protein, 161 aa, Escherichia coli; identical to SEQ ID NO: 5769
  strain 'clone D i14'

SEQ ID NO: 6843 - protein, 663 aa, Escherichia coli
  strain 'clone D i14'
MLNGIYSMRLKKRYLCTVLSLAFTQQSVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYHDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 6844 - protein, 565 aa, Escherichia coli
  strain 'clone D i14'
MKSPAPSRPQKMALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPKPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSATGTGGGGGEYPLQDGFGWTNGVTLKMLDLICPKEQPCDNVPATRPLSESTTQPVKQKEAEPTP

SEQ ID NO: 6845 - protein, 229 aa, Escherichia coli
  strain 'clone D i14'
MANGNASIKGYNCNVSQGLVIIMPLPDFRFIRLLPLAALVLTACSITTPKGPGKSPDSPQWRQHQQDVRNLNQYQTRGAFAYISDQQKVYARFFWQQTGQDRYRLLLTNPLGSTELELNAQPGNVQLVDNKGQRYTSDDAEEMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 6846 - protein, 353 aa, Escherichia coli
  strain 'clone D i14'
MKMKKSTLALVVMGIVASVSVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPISGGFANKTQNFEAVAQYQFDFGLRPSLGYVLSKGKDIEGIGDEDLVNYVDVGATYYFNKNMSAFVDYKINQLDSDNKLNINNDDIVAVGMTYQF

SEQ ID NO: 6847 - protein, 551 aa, Escherichia coli; identical to SEQ ID NO: 5885
  strain 'clone D i14'

SEQ ID NO: 6848 - protein, 700 aa, Escherichia coli
  strain 'clone D i14'
MKIFSVRQTVLPALLVLSPVVFAADEQTMIVSAAPQVVSELDTPAAVSVVNGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPLTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYIPEDGWYAGTEARYMGDIMADDENTAKAPSYTLVGLFTGYKYNYHNFTVDLFGRVDNLFDKEYVGSVIVNESNGRYYEPAPGRNYGVGINIAWRFE

SEQ ID NO: 6849 - protein, 883 aa, Escherichia coli
  strain 'clone D i14'
MTAFRAAFKAYRMHQVLILPRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDNKEHSADKHVPDNSACTPLQDRLADASSEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSTPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFHNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNVQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 6850 - protein, 239 aa, Escherichia coli; identical to SEQ ID NO: 5888
  strain 'clone D i14'

SEQ ID NO: 6851 - protein, 432 aa, Escherichia coli; identical to SEQ ID NO: 5727
  strain 'clone D i14'

SEQ ID NO: 6852 - protein, 208 aa, Escherichia coli; identical to SEQ ID NO: 5869
  strain 'clone D i14'

SEQ ID NO: 6853 - protein, 862 aa, Escherichia coli; identical to SEQ ID NO: 6838
  strain 'clone D i2'

SEQ ID NO: 6854 - protein, 246 aa, Escherichia coli; identical to SEQ ID NO: 5857
  strain 'clone D i2'

SEQ ID NO: 6855 - protein, 380 aa, Escherichia coli; identical to SEQ ID NO: 6833
  strain 'clone D i2'

SEQ ID NO: 6856 - protein, 884 aa, Escherichia coli; identical to SEQ ID NO: 6149
  strain 'clone D i2'

SEQ ID NO: 6857 - protein, 660 aa, Escherichia coli; identical to SEQ ID NO: 6837
  strain 'clone D i2'

SEQ ID NO: 6858 - protein, 752 aa, Escherichia coli; identical to SEQ ID NO: 6840
  strain 'clone D i2'

SEQ ID NO: 6859 - protein, 266 aa, Escherichia coli; identical to SEQ ID NO: 6841
  strain 'clone D i2'

SEQ ID NO: 6860 - protein, 161 aa, Escherichia coli; identical to SEQ ID NO: 5769
  strain 'clone D i2'

SEQ ID NO: 6861 - protein, 663 aa, Escherichia coli; identical to SEQ ID NO: 6843
  strain 'clone D i2'

SEQ ID NO: 6862 - protein, 565 aa, Escherichia coli; identical to SEQ ID NO: 6844
  strain 'clone D i2'

SEQ ID NO: 6863 - protein, 229 aa, Escherichia coli; identical to SEQ ID NO: 6845
  strain 'clone D i2'

SEQ ID NO: 6864 - protein, 721 aa, Escherichia coli; identical to SEQ ID NO: 6807
  strain 'clone D i2'

SEQ ID NO: 6865 - protein, 353 aa, Escherichia coli; identical to SEQ ID NO: 6846
  strain 'clone D i2'

SEQ ID NO: 6866 - protein, 551 aa, Escherichia coli; identical to SEQ ID NO: 5885
  strain 'clone D i2'

SEQ ID NO: 6867 - protein, 700 aa, Escherichia coli; identical to SEQ ID NO: 6848
  strain 'clone D i2'

SEQ ID NO: 6868 - protein, 883 aa, Escherichia coli; identical to SEQ ID NO: 6849
  strain 'clone D i2'

SEQ ID NO: 6869 - protein, 239 aa, Escherichia coli; identical to SEQ ID NO: 5888
  strain 'clone D i2'

SEQ ID NO: 6870 - protein, 432 aa, Escherichia coli; identical to SEQ ID NO: 5727
  strain 'clone D i2'

SEQ ID NO: 6871 - protein, 208 aa, Escherichia coli; identical to SEQ ID NO: 5869
  strain 'clone D i2'

SEQ ID NO: 6872 - protein, 746 aa, Escherichia coli; identical to SEQ ID NO: 6783
  strain 'clone D i2'

SEQ ID NO: 6873 - protein, 614 aa, Escherichia coli; identical to SEQ ID NO: 5872
  strain 'clone D i2'

SEQ ID NO: 6874 - protein, 193 aa, Escherichia coli; identical to SEQ ID NO: 6300
  strain 'clone D i2'

SEQ ID NO: 6875 - protein, 360 aa, Escherichia coli; identical to SEQ ID NO: 6702
  strain 'clone D i2'

SEQ ID NO: 6876 - protein, 696 aa, Escherichia coli; identical to SEQ ID NO: 6787
  strain 'clone D i2'

SEQ ID NO: 6877 - protein, 733 aa, Escherichia coli; identical to SEQ ID NO: 6152
  strain 'clone D i2'

SEQ ID NO: 6878 - protein, 446 aa, Escherichia coli; identical to SEQ ID NO: 5873
  strain 'clone D i2'

SEQ ID NO: 6879 - protein, 431 aa, Escherichia coli; identical to SEQ ID NO: 6791
  strain 'clone D i2'

SEQ ID NO: 6880 - protein, 122 aa, Escherichia coli; identical to SEQ ID NO: 5737
  strain 'clone D i2'

SEQ ID NO: 6881 - protein, 686 aa, Escherichia coli; identical to SEQ ID NO: 6795
  strain 'clone D i2'

SEQ ID NO: 6882 - protein, 260 aa, Escherichia coli; identical to SEQ ID NO: 6790
  strain 'clone D i2'

SEQ ID NO: 6883 - protein, 478 aa, Escherichia coli; identical to SEQ ID NO: 6796
  strain 'clone D i2'

SEQ ID NO: 6884 - protein, 332 aa, Escherichia coli; identical to SEQ ID NO: 6792
  strain 'clone D i2'

SEQ ID NO: 6885 - protein, 760 aa, Escherichia coli; identical to SEQ ID NO: 6793
  strain 'clone D i2'

SEQ ID NO: 6886 - protein, 360 aa, Escherichia coli; identical to SEQ ID NO: 5891
  strain 'clone D i2'

SEQ ID NO: 6887 - protein, 713 aa, Escherichia coli; identical to SEQ ID NO: 6056
  strain 'clone D i2'

SEQ ID NO: 6888 - protein, 222 aa, Escherichia coli; identical to SEQ ID NO: 5850
  strain 'clone D i2'

SEQ ID NO: 6889 - protein, 204 aa, Escherichia coli; identical to SEQ ID NO: 5755
  strain 'clone D i2'

SEQ ID NO: 6890 - protein, 334 aa, Escherichia coli; identical to SEQ ID NO: 6798
  strain 'clone D i2'

SEQ ID NO: 6891 - protein, 673 aa, Escherichia coli; identical to SEQ ID NO: 6170
  strain 'clone D i2'

SEQ ID NO: 6892 - protein, 840 aa, Escherichia coli; identical to SEQ ID NO: 5851
  strain 'clone D i2'

SEQ ID NO: 6893 - protein, 249 aa, Escherichia coli; identical to SEQ ID NO: 5852
  strain 'clone D i2'

SEQ ID NO: 6894 - protein, 362 aa, Escherichia coli; identical to SEQ ID NO: 5874
  strain 'clone D i2'

SEQ ID NO: 6895 - protein, 715 aa, Escherichia coli; identical to SEQ ID NO: 6806
  strain 'clone D i2'

SEQ ID NO: 6896 - protein, 241 aa, Escherichia coli; identical to SEQ ID NO: 6139
  strain 'clone D i2'

SEQ ID NO: 6897 - protein, 878 aa, Escherichia coli; identical to SEQ ID NO: 6809
  strain 'clone D i2'

SEQ ID NO: 6898 - protein, 231 aa, Escherichia coli; identical to SEQ ID NO: 6154
  strain 'clone D i2'

SEQ ID NO: 6899 - protein, 892 aa, Escherichia coli; identical to SEQ ID NO: 6811
  strain 'clone D i2'

SEQ ID NO: 6900 - protein, 725 aa, Escherichia coli; identical to SEQ ID NO: 6277
  strain 'clone D i2'

SEQ ID NO: 6901 - protein, 656 aa, Escherichia coli; identical to SEQ ID NO: 6178
  strain 'clone D i2'

SEQ ID NO: 6902 - protein, 517 aa, Escherichia coli; identical to SEQ ID NO: 6817
  strain 'clone D i2'

SEQ ID NO: 6903 - protein, 191 aa, Escherichia coli; identical to SEQ ID NO: 6818
  strain 'clone D i2'

SEQ ID NO: 6904 - protein, 831 aa, Escherichia coli; identical to SEQ ID NO: 6814
  strain 'clone D i2'

SEQ ID NO: 6905 - protein, 224 aa, Escherichia coli; identical to SEQ ID NO: 5893
  strain 'clone D i2'

SEQ ID NO: 6906 - protein, 663 aa, Escherichia coli; identical to SEQ ID NO: 5894
  strain 'clone D i2'

SEQ ID NO: 6907 - protein, 654 aa, Escherichia coli; identical to SEQ ID NO: 6816
  strain 'clone D i2'

SEQ ID NO: 6908 - protein, 900 aa, Escherichia coli; identical to SEQ ID NO: 6827
  strain 'clone D i2'

SEQ ID NO: 6909 - protein, 237 aa, Escherichia coli; identical to SEQ ID NO: 6819
  strain 'clone D i2'

SEQ ID NO: 6910 - protein, 366 aa, Escherichia coli; identical to SEQ ID NO: 6820
  strain 'clone D i2'

SEQ ID NO: 6911 - protein, 729 aa, Escherichia coli; identical to SEQ ID NO: 6821
  strain 'clone D i2'

SEQ ID NO: 6912 - protein, 214 aa, Escherichia coli; identical to SEQ ID NO: 6822
  strain 'clone D i2'

SEQ ID NO: 6913 - protein, 828 aa, Escherichia coli; identical to SEQ ID NO: 6558
  strain 'clone D i2'

SEQ ID NO: 6914 - protein, 162 aa, Escherichia coli; identical to SEQ ID NO: 5896
  strain 'clone D i2'

SEQ ID NO: 6915 - protein, 375 aa, Escherichia coli; identical to SEQ ID NO: 5922
  strain 'clone D i2'

SEQ ID NO: 6916 - protein, 209 aa, Escherichia coli; identical to SEQ ID NO: 6830
  strain 'clone D i2'

SEQ ID NO: 6917 - protein, 412 aa, Escherichia coli; identical to SEQ ID NO: 6828
  strain 'clone D i2'

SEQ ID NO: 6918 - protein, 265 aa, Escherichia coli; identical to SEQ ID NO: 6831
  strain 'clone D i2'

SEQ ID NO: 6919 - protein, 784 aa, Escherichia coli; identical to SEQ ID NO: 6829
  strain 'clone D i2'

SEQ ID NO: 6920 - protein, 274 aa, Escherichia coli; identical to SEQ ID NO: 5899
  strain 'clone D i2'

SEQ ID NO: 6921 - protein, 250 aa, Escherichia coli; identical to SEQ ID NO: 6150
  strain 'clone D i2'

SEQ ID NO: 6922 - protein, 259 aa, Escherichia coli; identical to SEQ ID NO: 6832
  strain 'clone D i2'

SEQ ID NO: 6923 - protein, 746 aa, Escherichia coli; identical to SEQ ID NO: 6422
  strain K12 / DH10B

SEQ ID NO: 6924 - protein, 193 aa, Escherichia coli; identical to SEQ ID NO: 6300
  strain K12 / DH10B

SEQ ID NO: 6925 - protein, 650 aa, Escherichia coli; identical to SEQ ID NO: 6393
  strain K12 / DH10B

SEQ ID NO: 6926 - protein, 242 aa, Escherichia coli; identical to SEQ ID NO: 6420
  strain K12 / DH10B

SEQ ID NO: 6927 - protein, 815 aa, Escherichia coli
  strain K12 / DH10B
MNIYRLSFVSCLVMAMPCAMAVEFNLNVLDKSMRDRIDISLLKEKGVIAPGEYFVSVAVNNNKISNGQKINWQKKGDKTIPCINDSLVDKFGLKPDIRQSLPQIDRCIDFSSRPEMLFNFDQANQQLNISIPQAWLAWHSENWAPPSTWKEGVAGVLMDYNLFASSYRPQDGSSSTNLNAYGTAGINAGAWRLRSDYQLNKTDSEDNHDQSGGISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLISDDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTIHRMSWNDTLDERNSWGMSAGLQSDRPDNGAQVSGNYQHLSSAGEWDISGTYAASDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQLFTVVWGEQSCIIHLPERLEDTTKRLILPCH

SEQ ID NO: 6928 - protein, 430 aa, Escherichia coli; identical to SEQ ID NO: 5758
  strain K12 / DH10B

SEQ ID NO: 6929 - protein, 412 aa, Escherichia coli; identical to SEQ ID NO: 6390
  strain K12 / DH10B

SEQ ID NO: 6930 - protein, 332 aa, Escherichia coli; identical to SEQ ID NO: 6429
  strain K12 / DH10B

SEQ ID NO: 6931 - protein, 760 aa, Escherichia coli; identical to SEQ ID NO: 6415
  strain K12 / DH10B

SEQ ID NO: 6932 - protein, 826 aa, Escherichia coli; identical to SEQ ID NO: 6373
  strain K12 / DH10B

SEQ ID NO: 6933 - protein, 239 aa, Escherichia coli; identical to SEQ ID NO: 6428
  strain K12 / DH10B

SEQ ID NO: 6934 - protein, 663 aa, Escherichia coli; identical to SEQ ID NO: 6307
  strain K12 / DH10B

SEQ ID NO: 6935 - protein, 203 aa, Escherichia coli; identical to SEQ ID NO: 6414
  strain K12 / DH10B

SEQ ID NO: 6936 - protein, 828 aa, Escherichia coli; identical to SEQ ID NO: 6366
  strain K12 / DH10B

SEQ ID NO: 6937 - protein, 162 aa, Escherichia coli; identical to SEQ ID NO: 6365
  strain K12 / DH10B

SEQ ID NO: 6938 - protein, 367 aa, Escherichia coli; identical to SEQ ID NO: 5789
  strain K12 / DH10B

SEQ ID NO: 6939 - protein, 362 aa, Escherichia coli; identical to SEQ ID NO: 5809
  strain K12 / DH10B

SEQ ID NO: 6940 - protein, 233 aa, Escherichia coli; identical to SEQ ID NO: 6411
  strain K12 / DH10B

SEQ ID NO: 6941 - protein, 866 aa, Escherichia coli; identical to SEQ ID NO: 6410
  strain K12 / DH10B

SEQ ID NO: 6942 - protein, 236 aa, Escherichia coli; identical to SEQ ID NO: 6409
  strain K12 / DH10B

SEQ ID NO: 6943 - protein, 200 aa, Escherichia coli; identical to SEQ ID NO: 6363
  strain K12 / DH10B

SEQ ID NO: 6944 - protein, 274 aa, Escherichia coli; identical to SEQ ID NO: 6362
  strain K12 / DH10B

SEQ ID NO: 6945 - protein, 511 aa, Escherichia coli; identical to SEQ ID NO: 6694
  strain K12 / DH10B

SEQ ID NO: 6946 - protein, 191 aa, Escherichia coli; identical to SEQ ID NO: 5748
  strain K12 / DH10B

SEQ ID NO: 6947 - protein, 232 aa, Escherichia coli; identical to SEQ ID NO: 5747
  strain K12 / DH10B

SEQ ID NO: 6948 - protein, 365 aa, Escherichia coli; identical to SEQ ID NO: 6335
  strain K12 / DH10B

SEQ ID NO: 6949 - protein, 250 aa, Escherichia coli; identical to SEQ ID NO: 6361
  strain K12 / DH10B

SEQ ID NO: 6950 - protein, 578 aa, Escherichia coli
  strain K12 / DH10B
MPDHSLFRLRILPWCIALAMSGSYSSVWAEDDIQFDSRFLELKGDTKIDLKRFSSQGYVEPGKYNLQVQLNKQPLAEEYDIYWYAGEDDVSKSYACLTPELVAQFGLKEDVAKNLQWSHDGKCLKPGQLEGVEIKADLSQSALVISLPQAYLEYTWPDWDPPSRWDDGISGIIADYSITAQTRHEENGGDDSNEISGNGTVGVNLGPWRMRADWQTNYQHTRSNDDDDEFGGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGGFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSEMVRTGNDKEMYTATYNQNFRDAGVSVYLNYTRHTYWDREEQTNYNIMLSHYFNMGSIRNMSVSLTGYRYEYDNRADKGM

SEQ ID NO: 6951 - protein, 538 aa, Escherichia coli; identical to SEQ ID NO: 6546
  strain K12 / DH10B

SEQ ID NO: 6952 - protein, 729 aa, Escherichia coli; identical to SEQ ID NO: 6402
  strain K12 / DH10B

SEQ ID NO: 6953 - protein, 213 aa, Escherichia coli; identical to SEQ ID NO: 5744
  strain K12 / DH10B

SEQ ID NO: 6954 - protein, 208 aa, Escherichia coli; identical to SEQ ID NO: 5717
  strain K12 / DH10B

SEQ ID NO: 6955 - protein, 203 aa, Escherichia coli; identical to SEQ ID NO: 6396
  strain K12 / DH10B

SEQ ID NO: 6956 - protein, 565 aa, Escherichia coli; identical to SEQ ID NO: 6395
  strain K12 / DH10B

SEQ ID NO: 6957 - protein, 207 aa, Escherichia coli; identical to SEQ ID NO: 5743
  strain K12 / DH10B

SEQ ID NO: 6958 - protein, 518 aa, Escherichia coli; identical to SEQ ID NO: 6358
  strain K12 / DH10B

SEQ ID NO: 6959 - protein, 614 aa, Escherichia coli; identical to SEQ ID NO: 6387
  strain K12 / DH10B

SEQ ID NO: 6960 - protein, 446 aa, Escherichia coli [sequence omitted]

SEQ ID NO: 6961 - protein, 784 aa, Escherichia coli; identical to SEQ ID NO: 6283
  strain K12 / DH10B

SEQ ID NO: 6962 - protein, 170 aa, Escherichia coli [sequence omitted]

SEQ ID NO: 6963 - protein, 865 aa, Escherichia coli; identical to SEQ ID NO: 6375
  strain K12 / DH10B

SEQ ID NO: 6964 - protein, 246 aa, Escherichia coli
  strain K12 / DH10B
MFFNTKHTTALCFVTCMAFSSSSIADIVISGTRVIYKSDQKSVNVRLENKGNNPLLVQSWLDTGDDNAEPGSITVPFTATPPVSRIDAKRGQTIKLMYTASTSLPKDRESVFWFNVLEVPPKPDAEKVANQSLLQLAFRTRIKLFYRPDGLKGNPSEAPLALKWFWSGSEGKASLRVTNPTPYYVSFSSGDLEASGKRYPIDVKMIAPFSDEVMKVNGLNGKANSAKVHFYAINDFGGAIEGNARL

SEQ ID NO: 6965 - protein, 747 aa, Escherichia coli
  strain K12 / DH10B
  MOD_RES (254)..(254): Any amino acid
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTXRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 6966 - protein, 237 aa, Escherichia coli; identical to SEQ ID NO: 6384
  strain K12 / DH10B

SEQ ID NO: 6967 - protein, 478 aa, Escherichia coli; identical to SEQ ID NO: 5711
  strain K12 / DH10B

SEQ ID NO: 6968 - protein, 266 aa, Escherichia coli; identical to SEQ ID NO: 5772
  strain K12 / DH10B

SEQ ID NO: 6969 - protein, 810 aa, Escherichia coli; identical to SEQ ID NO: 6345
  strain K12 / DH10B

SEQ ID NO: 6970 - protein, 161 aa, Escherichia coli; identical to SEQ ID NO: 5769
  strain K12 / DH10B

SEQ ID NO: 6971 - protein, 551 aa, Escherichia coli
  strain K12 / DH10B
MDRRRFIKGSMAMAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFSEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 6972 - protein, 700 aa, Escherichia coli; identical to SEQ ID NO: 6388
  strain K12 / DH10B

SEQ ID NO: 6973 - protein, 432 aa, Escherichia coli; identical to SEQ ID NO: 5727
  strain K12 / DH10B

SEQ ID NO: 6974 - protein, 351 aa, Escherichia coli; identical to SEQ ID NO: 6367
  strain K12 / DH10B

SEQ ID NO: 6975 - protein, 340 aa, Escherichia coli
  strain K12 / DH10B
MTLHRFKKIALLSALGIAAISMNVQAAERIAFIPKLVGVGFFTSGGNGAQQAGKELGVDVTYDGPTEPSVSGQVQLINNFVNQGYNAIIVSAVSPDGLCPALKRAMQRGVRVLTWDSDTKPECRSYYINQGTPAQLGGMLVDMAARQVNKDKAKVAFFYSSPTVTDQNQWVKEAKAKIAKEHPGWEIVTTQFGYNDATKSLQTAEGILKAYSDLDAIIAPDANALPAAAQAAENLKNDKVAIVGFSTPNVMRPYVERGTVKEFGLWDVVQQGKISVYVADALLKKGSMKTGDKLDIKGVGQVEVSPNSVQGYDYEADGNGIVLLPERVIFNKENIGKYDF

SEQ ID NO: 6976 - protein, 774 aa, Escherichia coli; identical to SEQ ID NO: 6382
  strain K12 / DH10B

SEQ ID NO: 6977 - protein, 368 aa, Escherichia coli; identical to SEQ ID NO: 6380
  strain K12 / DH10B

SEQ ID NO: 6978 - protein, 102 aa, Escherichia coli; identical to SEQ ID NO: 6385
  strain K12 / DH10B

SEQ ID NO: 6979 - protein, 359 aa, Escherichia coli; identical to SEQ ID NO: 5847
  strain K12 / DH10B

SEQ ID NO: 6980 - protein, 821 aa, Escherichia coli; identical to SEQ ID NO: 6408
  strain K12 / DH10B

SEQ ID NO: 6981 - protein, 249 aa, Escherichia coli; identical to SEQ ID NO: 6407
  strain K12 / DH10B

SEQ ID NO: 6982 - protein, 230 aa, Escherichia coli; identical to SEQ ID NO: 6360
  strain K12 / DH10B

SEQ ID NO: 6983 - protein, 867 aa, Escherichia coli; identical to SEQ ID NO: 6359
  strain K12 / DH10B

SEQ ID NO: 6984 - protein, 231 aa, Escherichia coli; identical to SEQ ID NO: 6400
  strain K12 / DH10B

SEQ ID NO: 6985 - protein, 838 aa, Escherichia coli; identical to SEQ ID NO: 6399
  strain K12 / DH10B

SEQ ID NO: 6986 - protein, 678 aa, Escherichia coli; identical to SEQ ID NO: 6398
  strain K12 / DH10B

SEQ ID NO: 6987 - protein, 122 aa, Escherichia coli
  strain K12 / DH10B
MEKNMKKRGAFLGLLLVSACASVFAANNETSKSVTFPKCEDLDAAGIAASVKRDYQQNRVARWADDQKIVGQADPVAWVSLQDIQGKDDKWSVPLTVRGKSADIHYQVSVDCKAGMAEYQRR

SEQ ID NO: 6988 - protein, 793 aa, Escherichia coli; identical to SEQ ID NO: 6397
  strain K12 / DH10B

SEQ ID NO: 6989 - protein, 784 aa, Escherichia coli; identical to SEQ ID NO: 6283
  strain K12 / MC4100 / BW2952

SEQ ID NO: 6990 - protein, 203 aa, Escherichia coli; identical to SEQ ID NO: 6414
  strain K12 / MC4100 / BW2952

SEQ ID NO: 6991 - protein, 362 aa, Escherichia coli; identical to SEQ ID NO: 5809
  strain K12 / MC4100 / BW2952

SEQ ID NO: 6992 - protein, 233 aa, Escherichia coli; identical to SEQ ID NO: 6411
  strain K12 / MC4100 / BW2952

SEQ ID NO: 6993 - protein, 866 aa, Escherichia coli; identical to SEQ ID NO: 6410
  strain K12 / MC4100 / BW2952

SEQ ID NO: 6994 - protein, 236 aa, Escherichia coli; identical to SEQ ID NO: 6409
  strain K12 / MC4100 / BW2952

SEQ ID NO: 6995 - protein, 334 aa, Escherichia coli; identical to SEQ ID NO: 6377
  strain K12 / MC4100 / BW2952

SEQ ID NO: 6996 - protein, 249 aa, Escherichia coli; identical to SEQ ID NO: 6407
  strain K12 / MC4100 / BW2952

SEQ ID NO: 6997 - protein, 774 aa, Escherichia coli; identical to SEQ ID NO: 6382
  strain K12 / MC4100 / BW2952

SEQ ID NO: 6998 - protein, 368 aa, Escherichia coli; identical to SEQ ID NO: 6380
  strain K12 / MC4100 / BW2952

SEQ ID NO: 6999 - protein, 241 aa, Escherichia coli; identical to SEQ ID NO: 6379
  strain K12 / MC4100 / BW2952

SEQ ID NO: 7000 - protein, 878 aa, Escherichia coli; identical to SEQ ID NO: 6378
  strain K12 / MC4100 / BW2952

SEQ ID NO: 7001 - protein, 170 aa, Escherichia coli [sequence omitted]

SEQ ID NO: 7002 - protein, 865 aa, Escherichia coli; identical to SEQ ID NO: 6375
  strain K12 / MC4100 / BW2952

SEQ ID NO: 7003 - protein, 246 aa, Escherichia coli; identical to SEQ ID NO: 6964
  strain K12 / MC4100 / BW2952

SEQ ID NO: 7004 - protein, 747 aa, Escherichia coli; identical to SEQ ID NO: 6343
  strain K12 / MC4100 / BW2952

SEQ ID NO: 7005 - protein, 266 aa, Escherichia coli; identical to SEQ ID NO: 5772
  strain K12 / MC4100 / BW2952

SEQ ID NO: 7006 - protein, 810 aa, Escherichia coli; identical to SEQ ID NO: 6345
  strain K12 / MC4100 / BW2952

SEQ ID NO: 7007 - protein, 161 aa, Escherichia coli; identical to SEQ ID NO: 5769
  strain K12 / MC4100 / BW2952

SEQ ID NO: 7008 - protein, 511 aa, Escherichia coli; identical to SEQ ID NO: 6694
  strain K12 / MC4100 / BW2952

SEQ ID NO: 7009 - protein, 191 aa, Escherichia coli; identical to SEQ ID NO: 5748
  strain K12 / MC4100 / BW2952

SEQ ID NO: 7010 - protein, 232 aa, Escherichia coli; identical to SEQ ID NO: 5747
  strain K12 / MC4100 / BW2952

SEQ ID NO: 7011 - protein, 365 aa, Escherichia coli; identical to SEQ ID NO: 6335
  strain K12 / MC4100 / BW2952

SEQ ID NO: 7012 - protein, 729 aa, Escherichia coli; identical to SEQ ID NO: 6402
  strain K12 / MC4100 / BW2952

SEQ ID NO: 7013 - protein, 213 aa, Escherichia coli; identical to SEQ ID NO: 5744
  strain K12 / MC4100 / BW2952

SEQ ID NO: 7014 - protein, 826 aa, Escherichia coli; identical to SEQ ID NO: 6373
  strain K12 / MC4100 / BW2952

SEQ ID NO: 7015 - protein, 239 aa, Escherichia coli; identical to SEQ ID NO: 6428
  strain K12 / MC4100 / BW2952

SEQ ID NO: 7016 - protein, 231 aa, Escherichia coli; identical to SEQ ID NO: 6400
  strain K12 / MC4100 / BW2952

SEQ ID NO: 7017 - protein, 838 aa, Escherichia coli; identical to SEQ ID NO: 6399
  strain K12 / MC4100 / BW2952

SEQ ID NO: 7018 - protein, 678 aa, Escherichia coli; identical to SEQ ID NO: 6398
  strain K12 / MC4100 / BW2952

SEQ ID NO: 7019 - protein, 331 aa, Escherichia coli [sequence omitted]

SEQ ID NO: 7020 - protein, 793 aa, Escherichia coli; identical to SEQ ID NO: 6397
  strain K12 / MC4100 / BW2952

SEQ ID NO: 7021 - protein, 351 aa, Escherichia coli; identical to SEQ ID NO: 6367
  strain K12 / MC4100 / BW2952

SEQ ID NO: 7022 - protein, 203 aa, Escherichia coli; identical to SEQ ID NO: 6396
  strain K12 / MC4100 / BW2952

SEQ ID NO: 7023 - protein, 565 aa, Escherichia coli; identical to SEQ ID NO: 6395
  strain K12 / MC4100 / BW2952

SEQ ID NO: 7024 - protein, 207 aa, Escherichia coli; identical to SEQ ID NO: 5743
  strain K12 / MC4100 / BW2952

SEQ ID NO: 7025 - protein, 663 aa, Escherichia coli; identical to SEQ ID NO: 6307
  strain K12 / MC4100 / BW2952

SEQ ID NO: 7026 - protein, 828 aa, Escherichia coli; identical to SEQ ID NO: 6366
  strain K12 / MC4100 / BW2952

SEQ ID NO: 7027 - protein, 162 aa, Escherichia coli; identical to SEQ ID NO: 6365
  strain K12 / MC4100 / BW2952

SEQ ID NO: 7028 - protein, 367 aa, Escherichia coli; identical to SEQ ID NO: 5789
  strain K12 / MC4100 / BW2952

SEQ ID NO: 7029 - protein, 200 aa, Escherichia coli; identical to SEQ ID NO: 6363
  strain K12 / MC4100 / BW2952

SEQ ID NO: 7030 - protein, 650 aa, Escherichia coli; identical to SEQ ID NO: 6393
  strain K12 / MC4100 / BW2952

SEQ ID NO: 7031 - protein, 897 aa, Escherichia coli; identical to SEQ ID NO: 6392
  strain K12 / MC4100 / BW2952

SEQ ID NO: 7032 - protein, 412 aa, Escherichia coli; identical to SEQ ID NO: 6390
  strain K12 / MC4100 / BW2952

SEQ ID NO: 7033 - protein, 230 aa, Escherichia coli; identical to SEQ ID NO: 6360
  strain K12 / MC4100 / BW2952

SEQ ID NO: 7034 - protein, 867 aa, Escherichia coli; identical to SEQ ID NO: 6359
  strain K12 / MC4100 / BW2952

SEQ ID NO: 7035 - protein, 746 aa, Escherichia coli; identical to SEQ ID NO: 6422
  strain K12 / MC4100 / BW2952

SEQ ID NO: 7036 - protein, 551 aa, Escherichia coli; identical to SEQ ID NO: 6971
  strain K12 / MC4100 / BW2952

SEQ ID NO: 7037 - protein, 274 aa, Escherichia coli; identical to SEQ ID NO: 6362
  strain K12 / MC4100 / BW2952

SEQ ID NO: 7038 - protein, 250 aa, Escherichia coli; identical to SEQ ID NO: 6361
  strain K12 / MC4100 / BW2952

SEQ ID NO: 7039 - protein, 193 aa, Escherichia coli; identical to SEQ ID NO: 6300
  strain K12 / MC4100 / BW2952

SEQ ID NO: 7040 - protein, 242 aa, Escherichia coli; identical to SEQ ID NO: 6420
  strain K12 / MC4100 / BW2952

SEQ ID NO: 7041 - protein, 815 aa, Escherichia coli; identical to SEQ ID NO: 6927
  strain K12 / MC4100 / BW2952

SEQ ID NO: 7042 - protein, 430 aa, Escherichia coli; identical to SEQ ID NO: 5758
  strain K12 / MC4100 / BW2952

SEQ ID NO: 7043 - protein, 700 aa, Escherichia coli; identical to SEQ ID NO: 6388
  strain K12 / MC4100 / BW2952

SEQ ID NO: 7044 - protein, 518 aa, Escherichia coli; identical to SEQ ID NO: 6358
  strain K12 / MC4100 / BW2952

SEQ ID NO: 7045 - protein, 332 aa, Escherichia coli; identical to SEQ ID NO: 6429
  strain K12 / MC4100 / BW2952

SEQ ID NO: 7046 - protein, 760 aa, Escherichia coli; identical to SEQ ID NO: 6415
  strain K12 / MC4100 / BW2952

SEQ ID NO: 7047 - protein, 102 aa, Escherichia coli; identical to SEQ ID NO: 6385
  strain K12 / MC4100 / BW2952

SEQ ID NO: 7048 - protein, 118 aa, Escherichia coli; identical to SEQ ID NO: 6381
  strain K12 / MC4100 / BW2952

SEQ ID NO: 7049 - protein, 432 aa, Escherichia coli; identical to SEQ ID NO: 5727
  strain K12 / MC4100 / BW2952

SEQ ID NO: 7050 - protein, 208 aa, Escherichia coli; identical to SEQ ID NO: 5717
  strain K12 / MC4100 / BW2952

SEQ ID NO: 7051 - protein, 359 aa, Escherichia coli; identical to SEQ ID NO: 5847
  strain K12 / MC4100 / BW2952

SEQ ID NO: 7052 - protein, 614 aa, Escherichia coli
  strain K12 / MC4100 / BW2952
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISGGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 7053 - protein, 446 aa, Escherichia coli [sequence omitted]

SEQ ID NO: 7054 - protein, 237 aa, Escherichia coli; identical to SEQ ID NO: 6384
  strain K12 / MC4100 / BW2952

SEQ ID NO: 7055 - protein, 478 aa, Escherichia coli; identical to SEQ ID NO: 5711
  strain K12 / MC4100 / BW2952

SEQ ID NO: 7056 - protein, 471 aa, Escherichia coli
  strain K12
MKQSTIALALLPLLFTPVTKARTPEMPVLENRAAQGDITAPGGARRLTGDQTAALRDSLSDKPAKNIILLIGDGMGDSEITAARNYAEGAGGFFKGIDALPLTGQYTHYALNKKTGKPDYVTDSAASATAWSTGVKTYNGALGVDIHEKDHPTILEMAKAAGLATGNVSTAELQDATPAALVAHVTSRKCYGPSATSEKCPGNALEKGGKGSITEQLLNARADVTLGGGAKTFAETATAGEWQGKTLREQAQARGYQLVSDAASLNSVTEANQQKPLLGLFADGNMPVRWLGPKATYHGNIDKPAVTCTPNPQRNDSVPTLAQMTDKAIELLSKNEKGFFLQVEGASIDKQDHAANPCGQIGETVDLDEAVQRALEFAKKEGNTLVIVTADHAHASQIVAPDTKAPGLTQALNTKDGAVMVMSYGNSEEDSQEHTGSQLRIAAYGPHAANVVGLTDQTDLFYTMKAALGLK

SEQ ID NO: 7057 - protein, 348 aa, Escherichia coli
  strain K12
MEFFKKTALAALVMGFSGAALALPNITILATGGTIAGGGDSATKSNYTVGKVGVENLVNAVPQLKDIANVKGEQVVNIGSQDMNDNVWLTLAKKINTDCDKTDGFVITHGTDTMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKSVFDTLATAAKTGTAVVRSSRVPTGATTQDAEVDDAKYGFVASGTLNPQKARVLLQLALTQTKDPQQIQQIFNQY

SEQ ID NO: 7058 - protein, 377 aa, Escherichia coli
  strain K12
MFKTTLCALLITASCSTFAAPQQINDIVHRTITPLIEQQKIPGMAVAVIYQGKPYYFTWGYADIAKKQPVTQQTLFELGSVSKTFTGVLGGDAIARGEIKLSDPTTKYWPELTAKQWNGITLLHLATYTAGGLPLQVPDEVKSSSDLLRFYQNWQPAWAPGTQRLYANSSIGLFGALAVKPSGLSFEQAMQTRVFQPLKLNHTWINVPPAEEKNYAWGYREGKAVHVSPGALDAEAYGVKSTIEDMARWVQSNLKPLDINEKTLQQGIQLAQSRYWQTGDMYQGLGWEMLDWPVNPDSIINGSDNKIALAARPVKAITPPTPAVRASWVHKTGATGGFGSYVAFIPEKELGIVMLANKNYPNPARVDAAWQILNALQ

SEQ ID NO: 7059 - protein, 329 aa, Escherichia coli
  strain K12
MHKFTKALAAIGLAAVMSQSAMAENLKLGFLVKQPEEPWFQTEWKFADKAGKDLGFEVIKIAVPDGEKTLNAIDSLAASGAKGFVICTPDPKLGSAIVAKARGYDMKVIAVDDQFVNAKGKPMDTVPLVMMAATKIGERQGQELYKEMQKRGWDVKESAVMAITANELDTARRRTTGSMDALKAAGFPEKQIYQVPTKSNDIPGAFDAANSMLVQHPEVKHWLIVGMNDSTVLGGVRATEGQGFKAADIIGIGINGVDAVSELSKAQATGFYGSLLPSPDVHGYKSSEMLYNWVAKDVEPPKFTEVTDVVLITRDNFKEELEKKGLGGK

SEQ ID NO: 7060 - protein, 296 aa, Escherichia coli
  strain K12
MNMKKLATLVSAVALSATVSANAMAKDTIALVVSTLNNPFFVSLKDGAQKEADKLGYNLVVLDSQNNPAKELANVQDLTVRGTKILLINPTDSDAVGNAVKMANQANIPVITLDRQATKGEVVSHIASDNVLGGKIAGDYIAKKAGEGAKVIELQGIAGTSAARERGEGFQQAVAAHKFNVLASQPADFDRIKGLNVMQNLLTAHPDVQAVFAQNDEMALGALRALQTAGKSDVMVVGFDGTPDGEKAVNDGKLAATIAQLPDQIGAKGVETADKVLKGEKVQAKYPVDLKLVVKQ

SEQ ID NO: 7061 - protein, 493 aa, Escherichia coli
  strain K12
MKKLLPILIGLSLSGFSSLSQAENLMQVYQQARLSNPELRKSAADRDAAFEKINEARSPLLPQLGLGADYTYSNGYRDANGINSNATSASLQLTQSIFDMSKWRALTLQEKAAGIQDVTYQTDQQTLILNTATAYFNVLNAIDVLSYTQAQKEAIYRQLDQTTQRFNVGLVAITDVQNARAQYDTVLANEVTARNNLDNAVEQLRQITGNYYPELAALNVENFKTDKPQPVNALLKEAEKRNLSLLQARLSQDLAREQIRQAQDGHLPTLDLTASTGISDTSYSGSKTRGAAGTQYDDSNMGQNKVGLSFSLPIYQGGMVNSQVKQAQYNFVGASEQLESAHRSVVQTVRSSFNNINASISSINAYKQAVVSAQSSLDAMEAGYSVGTRTIVDVLDATTTLYNAKQELANARYNYLINQLNIKSALGTLNEQDLLALNNALSKPVSTNPENVAPQTPEQNAIADGYAPDSPAPVVQQTSARTTTSNGHNPFRN

SEQ ID NO: 7062 - protein, 362 aa, Escherichia coli; identical to SEQ ID NO: 5809
  strain K12

SEQ ID NO: 7063 - protein, 351 aa, Escherichia coli; identical to SEQ ID NO: 6367
  strain K12

SEQ ID NO: 7064 - protein, 446 aa, Escherichia coli [sequence omitted]

SEQ ID NO: 7065 - protein, 306 aa, Escherichia coli
  strain K12
MKMNKSLIVLCLSAGLLASAPGISLADVNYVPQNTSDAPAIPSAALQQLTWTPVDQSKTQTTQLATGGQQLNVPGISGPVAAYSVPANIGELTLTLTSEVNKQTSVFAPNVLILDQNMTPSAFFPSSYFTYQEPGVMSADRLEGVMRLTPALGQQKLYVLVFTTEKDLQQTTQLLDPAKAYAKGVGNSIPDIPDPVARHTTDGLLKLKVKTNSSSSVLVGPLFGSSAPAPVTVGNTAAPAVAAPAPAPVKKSEPMLNDTESYFNTAIKNAVAKGDVDKALKLLDEAERLGSTSARSTFISSVKGKG

SEQ ID NO: 7066 - protein, 121 aa, Escherichia coli; identical to SEQ ID NO: 6175
  strain K12

SEQ ID NO: 7067 - protein, 369 aa, Escherichia coli
  strain K12
MKRNAKTIIAGMIALAISHTAMADDIKVAVVGAMSGPIAQWGDMEFNGARQAIKDINAKGGIKGDKLVGVEYDDACDPKQAVAVANKIVNDGIKYVIGHLCSSSTQPASDIYEDEGILMISPGATNPELTQRGYQHIMRTAGLDSSQGPTAAKYILETVKPQRIAIIHDKQQYGEGLARSVQDGLKAANANVVFFDGITAGEKDFSALIARLKKENIDFVYYGGYYPEMGQMLRQARSVGLKTQFMGPEGVGNASLSNIAGDAAEGMLVTMPKRYDQDPANQGIVDALKADKKDPSGPYVWITYAAVQSLATALERTGSDEPLALVKDLKANGANTVIGPLNWDEKGDLKGFDFGVFQWHADGSSTAAK

SEQ ID NO: 7068 - protein, 498 aa, Escherichia coli
  strain K12
MAQVINTNSLSLITQNNINKNQSALSSSIERLSSGLRINSAKDDAAGQAIANRFTSNIKGLTQAARNANDGISVAQTTEGALSEINNNLQRVRELTVQATTGTNSESDLSSIQDEIKSRLDEIDRVSGQTQFNGVNVLAKNGSMKIQVGANDNQTITIDLKQIDAKTLGLDGFSVKNNDTVTTSAPVTAFGATTTNNIKLTGITLSTEAATDTGGTNPASIEGVYTDNGNDYYAKITGGDNDGKYYAVTVANDGTVTMATGATANATVTDANTTKATTITSGGTPVQIDNTAGSATANLGAVSLVKLQDSKGNDTDTYALKDTNGNLYAADVNETTGAVSVKTITYTDSSGAASSPTAVKLGGDDGKTEVVDIDGKTYDSADLNGGNLQTGLTAGGEALTAVANGKTTDPLKALDDAIASVDKFRSSLGAVQNRLDSAVTNLNNTTTNLSEAQSRIQDADYATEVSNMSKAQIIQQAGNSVLAKANQVPQQVLSLLQG

SEQ ID NO: 7069 - protein, 962 aa, Escherichia coli
  strain K12
MPRSTWFKALLLLVALWAPLSQAETGWQPIQETIRKSDKDNRQYQAIRLDNGMVVLLVSDPQAVKSLSALVVPVGSLEDPEAYQGLAHYLEHMSLMGSKKYPQADSLAEYLKMHGGSHNASTAPYRTAFYLEVENDALPGAVDRLADAIAEPLLDKKYAERERNAVNAELTMARTRDGMRMAQVSAETINPAHPGSKFSGGNLETLSDKPGNPVQQALKDFHEKYYSANLMKAVIYSNKPLPELAKMAADTFGRVPNKESKKPEITVPVVTDAQKGIIIHYVPALPRKVLRVEFRIDNNSAKFRSKTDELITYLIGNRSPGTLSDWLQKQGLVEGISANSDPIVNGNSGVLAISASLTDKGLANRDQVVAAIFSYLNLLREKGIDKQYFDELANVLDIDFRYPSITRDMDYVEWLADTMIRVPVEHTLDAVNIADRYDAKAVKERLAMMTPQNARIWYISPKEPHNKTAYFVDAPYQVDKISAQTFADWQKKAADIALSLPELNPYIPDDFSLIKSEKKYDHPELIVDESNLRVVYAPSRYFASEPKADVSLILRNPKAMDSARNQVMFALNDYLAGLALDQLSNQASVGGISFSTNANNGLMVNANGYTQRLPQLFQALLEGYFSYTATEDQLEQAKSWYNQMMDSAEKGKAFEQAIMPAQMLSQVPYFSRDERRKILPSITLKEVLAYRDALKSGARPEFMVIGNMTEAQATTLARDVQKQLGADGSEWCRNKDVVVDKKQSVIFEKAGNSTDSALAAVFVPTGYDEYTSSAYSSLLGQIVQPWFYNQLRTEEQLGYAVFAFPMSVGRQWGMGFLLQSNDKQPSFLWERYKAFFPTAEAKLRAMKPDEFAQIQQAVITQMLQAPQTLGEEASKLSKDFDRGNMRFDSRDKIVAQIKLLTPQKLADFFHQAVVEPQGMAILSQISGSQNGKAEYVHPEGWKVWENVSALQQTMPLMSEKNE

SEQ ID NO: 7070 - protein, 746 aa, Escherichia coli; identical to SEQ ID NO: 6422
  strain K12

SEQ ID NO: 7071 - protein, 614 aa, Escherichia coli; identical to SEQ ID NO: 6387
  strain K12

SEQ ID NO: 7072 - protein, 183 aa, Escherichia coli
  strain K12
MQDSILTTVVKDIDGEVTTLEKFAGNVLLIVNVASKCGLTPQYEQLENIQKAWVDRGFMVLGFPCNQFLEQEPGSDEEIKTYCTTTWGVTFPMFSKIEVNGEGRHPLYQKLIAAAPTAVAPEESGFYARMVSKGRAPLYPDDILWNFEKFLVGRDGKVIQRFSPDMTPEDPIVMESIKLALAK

SEQ ID NO: 7073 - protein, 747 aa, Escherichia coli; identical to SEQ ID NO: 6343
  strain K12

SEQ ID NO: 7074 - protein, 367 aa, Escherichia coli; identical to SEQ ID NO: 5789
  strain K12

SEQ ID NO: 7075 - protein, 550 aa, Escherichia coli
  strain K12
MKLLQRGVALALLTTFTLASETALAYEQDKTYKITVLHTNDHHGHFWRNEYGEYGLAAQKTLVDGIRKEVAAEGGSVLLLSGGDINTGVPESDLQDAEPDFRGMNLVGYDAMAIGNHEFDNPLTVLRQQEKWAKFPLLSANIYQKSTGERLFKPWALFKRQDLKIAVIGLTTDDTAKIGNPEYFTDIEFRKPADEAKLVIQELQQTEKPDIIIAATHMGHYDNGEHGSNAPGDVEMARALPAGSLAMIVGGHSQDPVCMAAENKKQVDYVPGTPCKPDQQNGIWIVQAHEWGKYVGRADFEFRNGEMKMVNYQLIPVNLKKKVTWEDGKSERVLYTPEIAENQQMISLLSPFQNKGKAQLEVKIGETNGRLEGDRDKVRFVQTNMGRLILAAQMDRTGADFAVMSGGGIRDSIEAGDISYKNVLKVQPFGNVVVYADMTGKEVIDYLTAVAQMKPDSGAYPQFANVSFVAKDGKLNDLKIKGEPVDPAKTYRMATLNFNATGGDGYPRLDNKPGYVNTGFIDAEVLKAYIQKSSPLDVSVYEPKGEVSWQ

SEQ ID NO: 7076 - protein, 432 aa, Escherichia coli
  strain K12
MKAILIPFLSLLIPLTPQSAFAQSEPELKLESVVIVSRHGVRAPTKATQLMQDVTPDAWPTWPVKLGWLTPRGGELIAYLGHYQRQRLVADGLLAKKGCPQSGQVAIIADVDERTRKTGEAFAAGLAPDCAITVHTQADTSSPDPLFNPLKTGVCQLDNANVTDAILSRAGGSIADFTGHRQTAFRELERVLNFPQSNLCLKREKQDESCSLTQALPSELKVSADNVSLTGAVSLASMLTEIFLLQQAQGMPEPGWGRITDSHQWNTLLSLHNAQFYLLQRTPEVARSRATPLLDLIKTALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 7077 - protein, 296 aa, Escherichia coli
  strain K12
MSGLPLISRRRLLTAMALSPLLWQMNTAHAAAIDPNRIVALEWLPVELLLALGIVPYGVADTINYRLWVSEPPLPDSVIDVGLRTEPNLELLTEMKPSFMVWSAGYGPSPEMLARIAPGRGFNFSDGKQPLAMARKSLTEMADLLNLQSAAETHLAQYEDFIRSMKPRFVKRGARPLLLTTLIDPRHMLVFGPNSLFQEILDEYGIPNAWQGETNFWGSTAVSIDRLAAYKDVDVLCFDHDNSKDMDALMATPLWQAMPFVRAGRFQRVPAVWFYGATLSAMHFVRVLDNAIGGKA

SEQ ID NO: 7078 - protein, 91 aa, Escherichia coli
  strain K12
MSGDENKLKKYRFPETLTNQSRWFGLPLDELIPAAICIGWGITTSKYLFGIGAAVLVYFGIKKLKKGRGSSWLRDLIYWYMPTALLRGIFS

SEQ ID NO: 7079 - protein, 647 aa, Escherichia coli
  strain K12
MIKFSATLLATLIAASVNAATVDLRIMETTDLHSNMMDFDYYKDTATEKFGLVRTASLINDARNEVKNSVLVDNGDLIQGSPLADYMSAKGLKAGDIHPVYKALNTLDYTVGTLGNHEFNYGLDYLKNALAGAKFPYVNANVIDARTKQPMFTPYLIKDTEVVDKDGKKQTLKIGYIGVVPPQIMGWDKANLSGKVTVNDITETVRKYVPEMREKGADVVVVLAHSGLSADPYKVMAENSVYYLSEIPGVNAIMFGHAHAVFPGKDFADIEGADIAKGTLNGVPAVMPGMWGDHLGVVDLQLSNDSGKWQVTQAKAEARPIYDIANKKSLAAEDSKLVETLKADHDATRQFVSKPIGKSADNMYSYLALVQDDPTVQVVNNAQKAYVEHYIQGDPDLAKLPVLSAAAPFKVGGRKNDPASYVEVEKGQLTFRNAADLYLYPNTLIVVKASGKEVKEWLECSAGQFNQIDPNSTKPQSLINWDGFRTYNFDVIDGVNYQIDVTQPARYDGECQMINANAERIKNLTFNGKPIDPNAMFLVATNNYRAYGGKFAGTGDSHIAFASPDENRSVLAAWIADESKRAGEIHPAADNNWRLAPIAGDKKLDIRFETSPSDKAAAFIKEKGQYPMNKVATDDIGFAIYQVDLSK

SEQ ID NO: 7080 - protein, 317 aa, Escherichia coli
  strain K12
MRAKLLGIVLTTPIAISSFASTETLSFTPDNINADISLGTLSGKTKERVYLAEEGGRKVSQLDWKFNNAAIIKGAINWDLMPQISIGAAGWTTLGSRGGNMVDQDWMDSSNPGTWTDESRHPDTQLNYANEFDLNIKGWLLNEPNYRLGLMAGYQESRYSFTARGGSYIYSSEEGFRDDIGSFPNGERAIGYKQRFKMPYIGLTGSYRYEDFELGGTFKYSGWVESSDNDEHYDPGKRITYRSKVKDQNYYSVAVNAGYYVTPNAKVYVEGAWNRVTNKKGNTSLYDHNNNTSDYSKNGAGIENYNFITTAGLKYTF

SEQ ID NO: 7081 - protein, 358 aa, Escherichia coli
  strain K12
MKLTLKNLSMAIMMSTIVMGSSAMAADSNEKIVIAHRGASGYLPEHTLPAKAMAYAQGADYLEQDLVMTKDDNLVVLHDHYLDRVTDVADRFPDRARKDGRYYAIDFTLDEIKSLKFTEGFDIENGKKVQTYPGRFPMGKSDFRVHTFEEEIEFVQGLNHSTGKNIGIYPEIKAPWFHHQEGKDIAAKTLEVLKKYGYTGKDDKVYLQCFDADELKRIKNELEPKMGMELNLVQLIAYTDWNETQQKQPDGSWVNYNYDWMFKPGAMKQVAEYADGIGPDYHMLIEETSQPGNIKLTGMVQDAQQNKLVVHPYTVRSDKLPEYTPDVNQLYDALYNKAGVNGLFTDFPDKAVKFLNKE

SEQ ID NO: 7082 - protein, 260 aa, Escherichia coli
  strain K12
MKKSILALSLLVGLSTAASSYAALPETVRIGTDTTYAPFSSKDAKGDFVGFDIDLGNEMCKRMQVKCTWVASDFDALIPSLKAKKIDAIISSLSITDKRQQEIAFSDKLYAADSRLIAAKGSPIQPTLDSLKGKHVGVLQGSTQEAYANETWRSKGVDVVAYANQDLVYSDLAAGRLDAALQDEVAASEGFLKQPAGKDFAFAGSSVKDKKYFGDGTGVGLRKDDAELTAAFNKALGELRQDGTYDKMAKKYFDFNVYGD

SEQ ID NO: 7083 - protein, 432 aa, Escherichia coli; identical to SEQ ID NO: 5727
  strain K12

SEQ ID NO: 7084 - protein, 232 aa, Escherichia coli; identical to SEQ ID NO: 5747
  strain K12

SEQ ID NO: 7085 - protein, 365 aa, Escherichia coli; identical to SEQ ID NO: 6335
  strain K12

SEQ ID NO: 7086 - protein, 430 aa, Escherichia coli; identical to SEQ ID NO: 5758
  strain K12

SEQ ID NO: 7087 - protein, 168 aa, Escherichia coli
  strain K12
MSQTVHFQGNPVTVANSIPQAGSKAQTFTLVAKDLSDVTLGQFAGKRKVLNIFPSIDTGVCAASVRKFNQLATEIDNTVVLCISADLPFAQSRFCGAEGLNNVITLSTFRNAEFLQAYGVAIADGPLKGLAARAVVVIDENDNVIFSQLVDEITTEPDYEAALAVLKA

SEQ ID NO: 7088 - protein, 191 aa, Escherichia coli; identical to SEQ ID NO: 5748
  strain K12

SEQ ID NO: 7089 - protein, 177 aa, Escherichia coli
  strain K12
MRLLPLVAAATAAFLVVACSSPTPPRGVTVVNNFDAKRYLGTWYEIARFDHRFERGLEKVTATYSLRDDGGLNVINKGYNPDRGMWQQSEGKAYFTGAPTRAALKVSFFGPFYGGYNVIALDREYRHALVCGPDRDYLWILSRTPTISDEVKQEMLAVATREGFDVSKFIWVQQPGS

SEQ ID NO: 7090 - protein, 344 aa, Escherichia coli
  strain K12
MAYSVQKSRLAKVAGVSLVLLLAACSSDSRYKRQVSGDEAYLEAAPLAELHAPAGMILPVTSGDYAIPVTNGSGAVGKALDIRPPAQPLALVSGARTQFTGDTASLLVENGRGNTLWPQVVSVLQAKNYTITQRDDAGQTLTTDWVQWNRLDEDEQYRGRYQISVKPQGYQQAVTVKLLNLEQAGKPVADAASMQRYSTEMMNVISAGLDKSATDAANAAQNRASTTMDVQSAADDTGLPMLVVRGPFNVVWQRLPAALEKVGMKVTDSTRSQGNMAVTYKPLSDSDWQELGASDPGLASGDYKLQVGDLDNRSSLQFIDPKGHTLTQSQNDALVAVFQAAFSK

SEQ ID NO: 7091 - protein, 155 aa, Escherichia coli
  strain K12
MIKRVLVVSMVGLSLVGCVNNDTLSGDVYTASEAKQVQNVSYGTIVNVRPVQIQGGDDSNVIGAIGGAVLGGFLGNTVGGGTGRSLATAAGAVAGGVAGQGVQSAMNKTQGVELEIRKDDGNTIMVVQKQGNTRFSPGQRVVLASNGSQVTVSPR

SEQ ID NO: 7092 - protein, 248 aa, Escherichia coli
  strain K12
MTKLKLLALGVLIATSAGVAHAEGKFSLGAGVGVVEHPYKDYDTDVYPVPVINYEGDNFWFRGLGGGYYLWNDATDKLSITAYWSPLYFKAKDSGDHQMRHLDDRKSTMMAGLSYAHFTQYGYLRTTLAGDTLDNSNGIVWDMAWLYRYTNGGLTVTPGIGVQWNSENQNEYYYGVSRKESARSGLRGYNPNDSWSPYLELSASYNFLGDWSVYGTARYTRLSDEVTDSPMVDKSWTGLISTGITYKF

SEQ ID NO: 7093 - protein, 346 aa, Escherichia coli
  strain K12
MKKTAIAIAVALAGFATVAQAAPKDNTWYTGAKLGWSQYHDTGFINNNGPTHENQLGAGAFGGYQVNPYVGFEMGYDWLGRMPYKGSVENGAYKAQGVQLTAKLGYPITDDLDIYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 7094 - protein, 173 aa, Escherichia coli
  strain K12
MQLNKVLKGLMIALPVMAIAACSSNKNASNDGSEGMLGAGTGMDANGGNGNMSSEEQARLQMQQLQQNNIVYFDLDKYDIRSDFAQMLDAHANFLRSNPSYKVTVEGHADERGTPEYNISLGERRANAVKMYLQGKGVSADQISIVSYGKEKPAVLGHDEAAYSKNRRAVLVY

SEQ ID NO: 7095 - protein, 212 aa, Escherichia coli
  strain K12
MKKLTVAALAVTTLLSGSAFAHEAGEFFMRAGSATVRPTEGAGGTLGSLGGFSVTNNTQLGLTFTYMATDNIGVELLAATPFRHKIGTRATGDIATVHHLPPTLMAQWYFGDASSKFRPYVGAGINYTTFFDNGFNDHGKEAGLSDLSLKDSWGAAGQVGVDYLINRDWLVNMSVWYMDIDTTANYKLGGAQQHDSVRLDPWVFMFSAGYRF

SEQ ID NO: 7096 - protein, 171 aa, Escherichia coli
  strain K12
MKKIACLSALAAVLAFTAGTSVAATSTVTGGYAQSDAQGQMNKMGGFNLKYRYEEDNSPLGVIGSFTYTEKSRTASSGDYNKNQYYGITAGPAYRINDWASIYGVVGVGYGKFQTTEYPTYKHDTSDYGFSYGAGLQFNPMENVALDFSYEQSRIRSVDVGTWIAGVGYRF

SEQ ID NO: 7097 - protein, 289 aa, Escherichia coli
  strain K12
MRTLQGWLLPVFMLPMAVYAQEATVKEVHDAPAVRGSIIANMLQEHDNPFTLYPYDTNYLIYTQTSDLNKEAIASYDWAENARKDEVKFQLSLAFPLWRGILGPNSVLGASYTQKSWWQLSNSEESSPFRETNYEPQLFLGFATDYRFAGWTLRDVEMGYNHDSNGRSDPTSRSWNRLYTRLMAENGNWLVEVKPWYVVGNTDDNPDITKYMGYYQLKIGYHLGDAVLSAKGQYNWNTGYGGAELGLSYPITKHVRLYTQVYSGYGESLIDYNFNQTRVGVGVMLNDLF

SEQ ID NO: 7098 - protein, 254 aa, Escherichia coli
  strain K12
MRSIARRTAVGAALLLVMPVAVWISGWRWQPGEQSWLLKAAFWVTETVTQPWGVITHLILFGWFLWCLRFRIKAAFVLFAILAAAILVGQGVKSWIKDKVQEPRPFVIWLEKTHHIPVDEFYTLKRAERGNLVKEQLAEEKNIPQYLRSHWQKETGFAFPSGHTMFAASWALLAVGLLWPRRRTLTIAILLVWATGVMGSRLLLGMHWPRDLVVATLISWALVAVATWLAQRICGPLTPPAEENREIAQREQES

SEQ ID NO: 7099 - protein, 294 aa, Escherichia coli
  strain K12
MKKTLLAAGAVLALSSSFTVNAAENDKPQYLSDWWHQSVNVVGSYHTRFGPQIRNDTYLEYEAFAKKDWFDFYGYADAPVFFGGNSDAKGIWNHGSPLFMEIEPRFSIDKLTNTDLSFGPFKEWYFANNYIYDMGRNKDGRQSTWYMGLGTDIDTGLPMSLSMNVYAKYQWQNYGAANENEWDGYRFKIKYFVPITDLWGGQLSYIGFTNFDWGSDLGDDSGNAINGIKTRTNNSIASSHILALNYDHWHYSVVARYWHDGGQWNDDAELNFGNGNFNVRSTGWGGYLVVGYNF

SEQ ID NO: 7100 - protein, 379 aa, Escherichia coli
  strain K12
MMKSKMKLMPLLVSVTLISGCTVLPGSNMSTMGKDVIKQQDADFDLDKMVNVYPLTPRLIDQLRPRPNVARPNMTLESEIANYQYRVGPGDVLNVTVWDHPELTTPAGQYRSSSDTGNWVQPDGTMFYPYIGKVHVVGKTLAEIRSDITGRLATYIADPQVDVNIAAFRSQKAYISGQVNKSGQQAITNVPLTILDAINAAGGLTDTADWRNVVLTHNGREERISLQALMQNGDLNQNRLLYPGDILYVPRNDDLKVFVMGEVKKQSTLKMDFSGMTLTEALGNAEGIDMTTSNASGIFVIRPLKGEGGRNGKIANIYQLDMSDATSLVMATEFRLQPYDVVYVTTAPVSRWNRLINQLLPTISGVRYMTDTASDIHNW

SEQ ID NO: 7101 - protein, 379 aa, Escherichia coli
  strain K12
MKKNIFKFSVLTLAVLSLTACTLVPGQNLSTSNKDVIELPDNQYDLDKMVNIYPVTPGLIDQLRAKPIMSQANPELEQQIANYEYRIGIGDVLMVTVWDHPELTTPAGQYRSASDTGNWVNADGAIFYPYIGRLKVAGKTLTQVRNEITARLDSVIESPQVDVSVAAFRSQKAYVTGEVSKSGQQPITNIPLTIMDAINAAGGLTADADWRNVVLTQNGVKTKVNLYALMQRGDLRQNKLLHPGDILFIPRNDDLKVFVMGEVGKQSTLKMDRSGMTLAEALGNAEGMNQDVADATGIFVIRATQNKQNGKIANIYQLNAKDASAMILGTEFQLEPYDIVYVTTAPLARWNRVISLLVPTISGVHDLTETSRWIQTWPN

SEQ ID NO: 7102 - protein, 365 aa, Escherichia coli
  strain K12
MKGRWVKYLLMGTVVAMLAACSSKPTDRGQQYKDGKFTQPFSLVNQPDAVGAPINAGDFAEQINHIRNSSPRLYGNQSNVYNAVQEWLRAGGDTRNMRQFGIDAWQMEGADNYGNVQFTGYYTPVIQARHTRQGEFQYPIYRMPPKRGRLPSRAEIYAGALSDKYILAYSNSLMDNFIMDVQGSGYIDFGDGSPLNFFSYAGKNGHAYRSIGKVLIDRGEVKKEDMSMQAIRHWGETHSEAEVRELLEQNPSFVFFKPQSFAPVKGASAVPLVGRASVASDRSIIPPGTTLLAEVPLLDNNGKFNGQYELRLMVALDVGGAIKGQHFDIYQGIGPEAGHRAGWYNHYGRVWVLKTAPGAGNVFSG

SEQ ID NO: 7103 - protein, 113 aa, Escherichia coli
  strain K12
MRCKTLTAAAAVLLMLTAGCSTLERVVYRPDINQGNYLTANDVSKIRVGMTQQQVAYALGTPLMSDPFGTNTWFYVFRQQPGHEGVTQQTLTLTFNSSGVLTNIDNKPALSGN

SEQ ID NO: 7104 - protein, 810 aa, Escherichia coli; identical to SEQ ID NO: 6345
  strain K12

SEQ ID NO: 7105 - protein, 206 aa, Escherichia coli
  strain K12
MTTPTFDTIEAQASYGIGLQVGQQLSESGLEGLLPEALVAGIADALEGKHPAVPVDVVHRALREIHERADAVRRQRFQAMAAEGVKYLEENAKKEGVNSTESGLQFRVINQGEGAIPARTDRVRVHYTGKLIDGTVFDSSVARGEPAEFPVNGVIPGWIEALTLMPVGSKWELTIPQELAYGERGAGASIPPFSTLVFEVELLEIL

SEQ ID NO: 7106 - protein, 124 aa, Escherichia coli
  strain K12
MASTARSLRYALAILTTSLVTPSVWAHAHLTHQYPAANAQVTAAPQAITLNFSEGVETGFSGAKITGPKNENIKTLPAKRNEQDQKQLIVPLADSLKPGTYTVDWHVVSVDGHKTKGHYTFSVK

SEQ ID NO: 7107 - protein, 141 aa, Escherichia coli
  strain K12
MKRNTKIALVMMALSAMAMGSTSAFAHGGHGMWQQNAAPLTSEQQTAWQKIHNDFYAQSSALQQQLVTKRYEYNALLAANPPDSSKINAVAKEMENLRQSLDELRVKRDIAMAEAGIPRGAGMGMGYGGCGGGGHMGMGHW

SEQ ID NO: 7108 - protein, 328 aa, Escherichia coli
  strain K12
MNRRNFIKAASCGALLTGALPSVSHAAAENRPPIPGSLGMLYDSTLCVGCQACVTKCQDINFPERNPQGEQTWSNNDKLSPYTNNIIQVWTSGTGVNKDQEENGYAYIKKQCMHCVDPNCVSVCPVSALKKDPKTGIVHYDKDVCTGCRYCMVACPYNVPKYDYNNPFGALHKCELCNQKGVERLDKGGLPGCVEVCPAGAVIFGTREELMAEAKKRLALKPGSEYHYPRQTLKSGDTYLHTVPKYYPHLYGEKEGGGTQVLVLTGVPYENLDLPKLDDLSTGARSENIQHTLYKGMMLPLAVLAGLTVLVRRNTKNDHHDGGDDHES

SEQ ID NO: 7109 - protein, 86 aa, Escherichia coli
  strain K12
MKTINTVVAAMALSTLSFGVFAAEPVTASQAQNMNKIGVVSADGASTLDALEAKLAEKAAAAGASGYSITSATNNNKLSGTAVIYK

SEQ ID NO: 7110 - protein, 86 aa, Escherichia coli
  strain K12
MKKCLTLLIATVLSGISLTAYAAQPMSNLDSGQLRPAGTVSATGASNLSDLEDKLAEKAREQGAKGYVINSAGGNDQMFGTATIYK

SEQ ID NO: 7111 - protein, 306 aa, Escherichia coli
  strain K12
MNMKLKTLFAAAFAVVGFCSTASAVTYPLPTDGSRLVGQNQVITIPEGNTQPLEYFAAEYQMGLSNMMEANPGVDTFLPKGGTVLNIPQQLILPDTVHEGIVINSAEMRLYYYPKGTNTVIVLPIGIGQLGKDTPINWTTKVERKKAGPTWTPTAKMHAEYRAAGEPLPAVVPAGPDNPMGLYALYIGRLYAIHGTNANFGIGLRVSHGCVRLRNEDIKFLFEKVPVGTRVQFIDEPVKATTEPDGSRYIEVHNPLSTTEAQFEGQEIVPITLTKSVQTVTGQPDVDQVVLDEAIKNRSGMPVRLN

SEQ ID NO: 7112 - protein, 375 aa, Escherichia coli
  strain K12
MTINFRRNALQLSVAALFSSAFMANAADVPQVKVTVTDKQCEPMTITVNAGKTQFIIQNHSQKALEWEILKGVMVVEERENIAPGFSQKMTANLQPGEYDMTCGLLTNPKGKLIVKGEATADAAQSDALLSLGGAITAYKAYVMAETTQLVTDTKAFTDAIKAGDIEKAKALYAPTRQHYERIEPIAELFSDLDGSIDAREDDYEQKAADPKFTGFHRLEKALFGDNTTKGMDQYAEQLYTDVVDLQKRISELAFPPSKVVGGAAGLIEEVAASKISGEEDRYSHTDLWDFQANVEGSQKIVDLLRPQLQKANPELLAKVDANFKKVDTILAKYRTKDGFETYDKLTDADRNALKGPITALAEDLAQLRGVLGLD

SEQ ID NO: 7113 - protein, 213 aa, Escherichia coli; identical to SEQ ID NO: 5744
  strain K12

SEQ ID NO: 7114 - protein, 85 aa, Escherichia coli
  strain K12
MKNVKTLIAAAILSSMSFASFAAVEVQSTPEGQQKVGTISANAGTNLGSLEEQLAQKADEMGAKSFRITSVTGPNTLHGTAVIYK

SEQ ID NO: 7115 - protein, 478 aa, Escherichia coli; identical to SEQ ID NO: 5711
  strain K12

SEQ ID NO: 7116 - protein, 188 aa, Escherichia coli
  strain K12
MSVLRSLLTAGVLASGLLWSLNGITATPAAQASDDRYEVTQQRNPDAACLDCHKPDTEGMHGKHASVINPNNKLPVTCTNCHGQPSPQHREGVKDVMRFNEPMYKVGEQNSVCMSCHLPEQLQKAFWPHDVHVTKVACASCHSLHPQQDTMQTLSDKGRIKICVDCHSDQRTNPNFNPASVPLLKEQP

SEQ ID NO: 7117 - protein, 149 aa, Escherichia coli
  strain K12
MKSHDLKKALCQWTAMLALVVSGAVWAANGVDFSQSPEVSGTQEGAIRMPKEQDRMPLNYVNQPPMIPHSVEGYQVTTNTNRCLQCHGVESYRTTGAPRISPTHFMDSDGKVGAEVAPRRYFCLQCHVPQADTAPIVGNTFTPSKGYGK

SEQ ID NO: 7118 - protein, 428 aa, Escherichia coli
  strain K12
MKNWKTLLLGIAMIANTSFAAPQVVDKVAAVVNNGVVLESDVDGLMQSVKLNAAQARQQLPDDATLRHQIMERLIMDQIILQMGQKMGVKISDEQLDQAIANIAKQNNMTLDQMRSRLAYDGLNYNTYRNQIRKEMIISEVRNNEVRRRITILPQEVESLAQQVGNQNDASTELNLSHILIPLPENPTSDQVNEAESQARAIVDQARNGADFGKLAIAHSADQQALNGGQMGWGRIQELPGIFAQALSTAKKGDIVGPIRSGVGFHILKVNDLRGESKNISVTEVHARHILLKPSPIMTDEQARVKLEQIAADIKSGKTTFAAAAKEFSQDPGSANQGGDLGWATPDIFDPAFRDALTRLNKGQMSAPVHSSFGWHLIELLDTRNVDKTDAAQKDRAYRMLMNRKFSEEAASWMQEQRASAYVKILSN

SEQ ID NO: 7119 - protein, 245 aa, Escherichia coli [sequence omitted]

SEQ ID NO: 7120 - protein, 157 aa, Escherichia coli
  strain K12
MGRISSGGMMFKAITTVAALVIATSAMAQDDLTISSLAKGETTKAAFNQMVQGHKLPAWVMKGGTYTPAQTVTLGDETYQVMSACKPHDCGSQRIAVMWSEKSNQMTGLFSTIDEKTSQEKLTWLNVNDALSIDGKTVLFAALTGSLENHPDGFNFK

SEQ ID NO: 7121 - protein, 367 aa, Escherichia coli
  strain K12
MNIKGKALLAGCIALAFSNMALAEDIKVAVVGAMSGPVAQYGDQEFTGAEQAVADINAKGGIKGNKLQIVKYDDACDPKQAVAVANKVVNDGIKYVIGHLCSSSTQPASDIYEDEGILMITPAATAPELTARGYQLILRTTGLDSDQGPTAAKYILEKVKPQRIAIVHDKQQYGEGLARAVQDGLKKGNANVVFFDGITAGEKDFSTLVARLKKENIDFVYYGGYHPEMGQILRQARAAGLKTQFMGPEGVANVSLSNIAGESAEGLLVTKPKNYDQVPANKPIVDAIKAKKQDPSGAFVWTTYAALQSLQAGLNQSDDPAEIAKYLKANSVDTVMGPLTWDEKGDLKGFEFGVFDWHANGTATDAK

SEQ ID NO: 7122 - protein, 208 aa, Escherichia coli
  strain K12
MMNFNNVFRWHLPFLFLVLLTFRAAAADTLLILGDSLSAGYRMSASAAWPALLNDKWQSKTSVVNASISGDTSQQGLARLPALLKQHQPRWVLVELGGNDGLRGFQPQQTEQTLRQILQDVKAANAEPLLMQIRLPANYGRRYNEAFSAIYPKLAKEFDVPLLPFFMEEVYLKPQWMQDDGIHPNRDAQPFIADWMAKQLQPLVNHDS

SEQ ID NO: 7123 - protein, 193 aa, Escherichia coli; identical to SEQ ID NO: 6300
  strain K12

SEQ ID NO: 7124 - protein, 130 aa, Escherichia coli
  strain K12
MKKFAAVIAVMALCSAPVMAAEQGGFSGPSATQSQAGGFQGPNGSVTTVESAKSLRDDTWVTLRGNIVERISDDLYVFKDASGTINVDIDHKRWNGVTVTPKDTVEIQGEVDKDWNSVEIDVKQIRKVNP

SEQ ID NO: 7125 - protein, 185 aa, Escherichia coli
  strain K12
MKFKTNKLSLNLVLASSLLAASIPAFAVTGDTDQPIHIESDQQSLDMQGNVVTFTGNVIVTQGTIKINADKVVVTRPGGEQGKEVIDGYGKPATFYQMQDNGKPVEGHASQMHYELAKDFVVLTGNAYLQQVDSNIKGDKITYLVKEQKMQAFSDKGKRVTTVLVPSQLQDKNNKGQTPAQKKGN

SEQ ID NO: 7126 - protein, 211 aa, Escherichia coli [sequence omitted]

SEQ ID NO: 7127 - protein, 237 aa, Escherichia coli; identical to SEQ ID NO: 6384
  strain K12

SEQ ID NO: 7128 - protein, 166 aa, Escherichia coli
  strain K12
MRIVTAAVMASTLAVSSLSHAAEVGSGDNWHPGEELTQRSTQSHMFDGISLTEHQRQQMRDLMQQARHEQPPVNVSELETMHRLVTAENFDENAVRAQAEKMANEQIARQVEMAKVRNQMYRLLTPEQQAVLNEKHQQRMEQLRDVTQWQKSSSLKLLSSSNSRSQ

SEQ ID NO: 7129 - protein, 185 aa, Escherichia coli
  strain K12
MRNLVKYVGIGLLVMGLAACDDKDTNATAQGSVAESNATGNPVNLLDGKLSFSLPADMTDQSGKLGTQANNMHVWSDATGQKAVIVIMGDDPKEDLAVLAKRLEDQQRSRDPQLQVVTNKAIELKGHKMQQLDSIISAKGQTAYSSVILGNVGNQLLTMQITLPADDQQKAQTTAENIINTLVIQ

SEQ ID NO: 7130 - protein, 355 aa, Escherichia coli
  strain K12
MFVKLLRSVAIGLIVGAILLVAMPSLRSLNPLSTPQFDSTDETPASYNLAVRRAAPAVVNVYNRGLNTNSHNQLEIRTLGSGVIMDQRGYIITNKHVINDADQIIVALQDGRVFEALLVGSDSLTDLAVLKINATGGLPTIPINARRVPHIGDVVLAIGNPYNLGQTITQGIISATGRIGLNPTGRQNFLQTDASINHGNSGGALVNSLGELMGINTLSFDKSNDGETPEGIGFAIPFQLATKIMDKLIRDGRVIRGYIGIGGREIAPLHAQGGGIDQLQGIVVNEVSPDGPAANAGIQVNDLIISVDNKPAISALETMDQVAEIRPGSVIPVVVMRDDKQLTLQVTIQEYPATN

SEQ ID NO: 7131 - protein, 332 aa, Escherichia coli
  strain K12
MNKKVLTLSAVMASMLFGAAAHAADTRIGVTIYKYDDNFMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLNDANNQAKATFDLAKNLADGKGAADGTNWKIDNKVVRVPYVGVDKDNLAEFSKK

SEQ ID NO: 7132 - protein, 208 aa, Escherichia coli; identical to SEQ ID NO: 5717
  strain K12

SEQ ID NO: 7133 - protein, 236 aa, Escherichia coli
  strain K12
MKKGFMLFTLLAAFSGFAQADDAAIQQTLAKMGIKSSDIQPAPVAGMKTVLTNSGVLYITDDGKHIIQGPMYDVSGTAPVNVTNKMLLKQLNALEKEMIVYKAPQEKHVITVFTDITCGYCHKLHEQMADYNALGITVRYLAFPRQGLDSDAEKEMKAIWCAKDKNKAFDDVMAGKSVAPASCDVDIADHYALGVQLGVSGTPAVVLSNGTLVPGYQPPKEMKEFLDEHQKMTSGK

SEQ ID NO: 7134 - protein, 318 aa, Escherichia coli
  strain K12
MRLAPLYRNALLLTGLLLSGIAAVQAADWPRQITDSRGTHTLESQPQRIVSTSVTLTGSLLAIDAPVIASGATTPNNRVADDQGFLRQWSKVAKERKLQRLYIGEPSAEAVAAQMPDLILISATGGDSALALYDQLSTIAPTLIINYDDKSWQSLLTQLGEITGHEKQAAERIAQFDKQLAAAKEQIKLPPQPVTAIVYTAAAHSANLWTPESAQGQMLEQLGFTLAKLPAGLNASQSQGKRHDIIQLGGENLAAGLNGESLFLFAGDQKDADAIYANPLLAHLPAVQNKQVYALGTETFRLDYYSAMQVLDRLKALF

SEQ ID NO: 7135 - protein, 266 aa, Escherichia coli
  strain K12
MKLAHLGRQALMGVMAVALVAGMSVKSFADEGLLNKVKERGTLLVGLEGTYPPFSFQGDDGKLTGFEVEFAQQLAKHLGVEASLKPTKWDGMLASLDSKRIDVVINQVTISDERKKKYDFSTPYTISGIQALVKKGNEGTIKTADDLKGKKVGVGLGTNYEEWLRQNVQGVDVRTYDDDPTKYQDLRVGRIDAILVDRLAALDLVKKTNDTLAVTGEAFSRQESGVALRKGNEDLLKAVNDAIAEMQKDGTLQALSEKWFGADVTK

SEQ ID NO: 7136 - protein, 248 aa, Escherichia coli
  strain K12
MKSVLKVSLAALTLAFAVSSHAADKKLVVATDTAFVPFEFKQGDKYVGFDVDLWAAIAKELKLDYELKPMDFSGIIPALQTKNVDLALAGITITDERKKAIDFSDGYYKSGLLVMVKANNNDVKSVKDLDGKVVAVKSGTGSVDYAKANIKTKDLRQFPNIDNAYMELGTNRADAVLHDTPNILYFIKTAGNGQFKAVGDSLEAQQYGIAFPKGSDELRDKVNGALKTLRENGTYNEIYKKWFGTEPK

SEQ ID NO: 7137 - protein, 110 aa, Escherichia coli
  strain K12
MKKVLGVILGGLLLLPVVSNAADAQKAADNKKPVNSWTCEDFLAVDESFQPTAVGFAEALNNKDKPEDAVLDVQGIATVTPAIVQACTQDKQANFKDKVKGEWDKIKKDM

SEQ ID NO: 7138 - protein, 260 aa, Escherichia coli
  strain K12
MKKLVLSLSLVLAFSSATAAFAAIPQNIRIGTDPTYAPFESKNSQGELVGFDIDLAKELCKRINTQCTFVENPLDALIPSLKAKKIDAIMSSLSITEKRQQEIAFTDKLYAADSRLVVAKNSDIQPTVESLKGKRVGVLQGTTQETFGNEHWAPKGIEIVSYQGQDNIYSDLTAGRIDAAFQDEVAASEGFLKQPVGKDYKFGGPSVKDEKLFGVGTGMGLRKEDNELREALNKAFAEMRADGTYEKLAKKYFDFDVYGG

SEQ ID NO: 7139 - protein, 161 aa, Escherichia coli; identical to SEQ ID NO: 5769
  strain K12

SEQ ID NO: 7140 - protein, 396 aa, Escherichia coli
  strain K12
MKIKTGARILALSALTTMMFSASALAKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTRITK

SEQ ID NO: 7141 - protein, 91 aa, Escherichia coli
  strain K12
MKQLLASPSLQLVTYPASATAQSAEFASADCVTGLNEIGQISVSNISGDPQDVERIVALKADEQGASWYRIITMYEDQQPDNWRVQAILYA

SEQ ID NO: 7142 - protein, 91 aa, Escherichia coli
  strain K12
MFSRVLALLAVLLLSANTWAAIEINNHQARNMDDVQSLGVIYINHNFATESEARQALNEETDAQGATYYHVILMREPGSNGNMHASADIYR

SEQ ID NO: 7143 - protein, 201 aa, Escherichia coli
  strain K12
MTMTRLKISKTLLAVMLTSAVATGSAYAENNAQTTNESAGQKVDSSMNKVGNFMDDSAITAKVKAALVDHDNIKSTDISVKTDQKVVTLSGFVESQAQAEEAVKVAKGVEGVTSVSDKLHVRDAKEGSVKGYAGDTATTSEIKAKLLADDIVPSRHVKVETTDGVVQLSGTVDSQAQSDRAESIAKAVDGVKSVKNDLKTK

SEQ ID NO: 7144 - protein, 310 aa, Escherichia coli
  strain K12
MPKFRVSLFSLALMLAVPFAPQAVAKTAAATTASQPEIASGSAMIVDLNTNKVIYSNHPDLVRPIASISKLMTAMVVLDARLPLDEKLKVDISQTPEMKGVYSRVRLNSEISRKDMLLLALMSSENRAAASLAHHYPGGYKAFIKAMNAKAKSLGMNNTRFVEPTGLSVHNVSTARDLTKLLIASKQYPLIGQLSTTREDMATFSNPTYTLPFRNTNHLVYRDNWNIQLTKTGFTNAAGHCLVMRTVINNKPVALVVMDAFGKYTHFADASRLRTWIETGKVMPVPAAALSYKKQKAAQMAAAGQTAQND

SEQ ID NO: 7145 - protein, 348 aa, Escherichia coli
  strain K12
MKKWSRHLLAAGALALGMSAAHADDNNTLYFYNWTEYVPPGLLEQFTKETGIKVIYSTYESNETMYAKLKTYKDGAYDLVVPSTYYVDKMRKEGMIQKIDKSKLTNFSNLDPDMLNKPFDPNNDYSIPYIWGATAIGVNGDAVDPKSVTSWADLWKPEYKGSLLLTDDAREVFQMALRKLGYSGNTTDPKEIEAAYNELKKLMPNVAAFNSDNPANPYMEGEVNLGMIWNGSAFVARQAGTPIDVVWPKEGGIFWMDSLAIPANAKNKEGALKLINFLLRPDVAKQVAETIGYPTPNLAARKLLSPEVANDKTLYPDAETIKNGEWQNDVGAASSIYEEYYQKLKAGR

SEQ ID NO: 7146 - protein, 190 aa, Escherichia coli
  strain K12
MFKSTLAAMAAVFALSALSPAAMAAKGDPHVLLTTSAGNIELELDKQKAPVSVQNFVDYVNSGFYNNTTFHRVIPGFMIQGGGFTEQMQQKKPNPPIKNEADNGLRNTRGTIAMARTADKDSATSQFFINVADNAFLDHGQRDFGYAVFGKVVKGMDVADKISQVPTHDVGPYQNVPSKPVVILSAKVLP

SEQ ID NO: 7147 - protein, 330 aa, Escherichia coli
  strain K12
MRHSVLFATAFATLISTQTFAADLPGKGITVNPVQSTITEETFQTLLVSRALEKLGYTVNKPSEVDYNVGYTSLASGDATFTAVNWTPLHDNMYEAAGGDKKFYREGVFVNGAAQGYLIDKKTADQYKITNIAQLKDPKIAKLFDTNGDGKADLTGCNPGWGCEGAINHQLAAYELTNTVTHNQGNYAAMMADTISRYKEGKPVFYYTWTPYWVSNELKPGKDVVWLQVPFSALPGDKNADTKLPNGANYGFPVSTMHIVANKAWAEKNPAAAKLFAIMQLPVADINAQNAIMHDGKASEGDIQGHVDGWIKAHQQQFDGWVNEALAAQK

SEQ ID NO: 7148 - protein, 318 aa, Escherichia coli
  strain K12
MKQLWFAMSLVTGSLLFSANASATPASGALLQQMNLASQSLNYELSFISINKQGVESLRYRHARLDNRPLAQLLQMDGPRREVVQRGNEISYFEPGLEPFTLNGDYIVDSLPSLIYTDFKRLSPYYDFISVGRTRIADRLCEVIRVVARDGTRYSYIVWMDTESKLPMRVDLLDRDGETLEQFRVIAFNVNQDISSSMQTLAKANLPPLLSVPVGEKAKFSWTPTWLPQGFSEVSSSRRPLPTMDNMPIESRLYSDGLFSFSVNVNRATPSSTDQMLRTGRRTVSTSVRDNAEITIVGELPPQTAKRIAENIKFGAAQ

SEQ ID NO: 7149 - protein, 329 aa, Escherichia coli
  strain K12
MNKWGVGLTFLLAATSVMAKDIQLLNVSYDPTRELYEQYNKAFSAHWKQQTGDNVVIRQSHGGSGKQATSVINGIEADVVTLALAYDVDAIAERGRIDKEWIKRLPDNSAPYTSTIVFLVRKGNPKQIHDWNDLIKPGVSVITPNPKSSGGARWNYLAAWGYALHHNNNDQAKAQDFVRALYKNVEVLDSGARGSTNTFVERGIGDVLIAWENEALLAANELGKDKFEIVTPSESILAEPTVSVVDKVVEKKGTKEVAEAYLKYLYSPEGQEIAAKNYYRPRDAEVAKKYENAFPKLKLFTIDEEFGGWTKAQKEHFANGGTFDQISKR

SEQ ID NO: 7150 - protein, 438 aa, Escherichia coli
  strain K12
MKPLHYTASALALGLALMGNAQAVTTIPFWHSMEGELGKEVDSLAQRFNAENPDYKIVPTYKGNYEQNLSAGIAAFRTGNAPAILQVYEVGTATMMASKAIKPVYDVFKEAGIQFDESQFVPTVSGYYSDSKTGHLLSQPFNSSTPVLYYNKDAFKKAGLDPEQPPKTWQDLADYAAKLKASGMKCGYASGWQGWIQLENFSAWNGLPFASKNNGFDGTDAVLEFNKPEQVKHIAMLEEMNKKGDFSYVGRKDESTEKFYNGDCAMTTASSGSLANIREYAKFNYGVGMMPYDADAKDAPQNAIIGGASLWVMQGKDKETYTGVAKFLDFLAKPENAAEWHQKTGYLPITKAAYDLTREQGFYEKNPGADTATRQMLNKPPLPFTKGLRLGNMPQIRVIVDEELESVWTGKKTPQQALDTAVERGNQLLRRFEKSTKS

SEQ ID NO: 7151 - protein, 346 aa, Escherichia coli
  strain K12
MKVMRTTVATVVAATLSMSAFSVFAEASLTGAGATFPAPVYAKWADTYQKETGNKVNYQGIGSSGGVKQIIANTVDFGASDAPLSDEKLAQEGLFQFPTVIGGVVLAVNIPGLKSGELVLDGKTLGDIYLGKIKKWDDEAIAKLNPGLKLPSQNIAVVRRADGSGTSFVFTSYLAKVNEEWKNNVGTGSTVKWPIGLGGKGNDGIAAFVQRLPGAIGYVEYAYAKQNNLAYTKLISADGKPVSPTEENFANAAKGADWSKTFAQDLTNQKGEDAWPITSTTFILIHKDQKKPEQGTEVLKFFDWAYKTGAKQANDLDYASLPDSVVEQVRAAWKTNIKDSSGKPLY

SEQ ID NO: 7152 - protein, 645 aa, Escherichia coli
  strain K12
MEKAKQVTWRLLAAGVCLLTVSSVARADSLDEQRSRYAQIKQAWDNRQMDVVEQMMPGLKDYPLYPYLEYRQITDDLMNQPAVTVTNFVRANPTLPPARTLQSRFVNELARREDWRGLLAFSPEKPGTTEAQCNYYYAKWNTGQSEEAWQGAKELWLTGKSQPNACDKLFSVWRASGKQDPLAYLERIRLAMKAGNTGLVTVLAGQMPADYQTIASAIISLANNPNTVLTFARTTGATDFTRQMAAVAFASVARQDAENARLMIPSLAQAQQLNEDQIQELRDIVAWRLMGNDVTDEQAKWRDDAIMRSQSTSLIERRVRMALGTGDRRGLNTWLARLPMEAKEKDEWRYWQADLLLERGREAEAKEILHQLMQQRGFYPMVAAQRIGEEYELKIDKAPQNVDSALTQGPEMARVRELMYWNLDNTARSEWANLVKSKSKTEQAQLARYAFNNQWWDLSVQATIAGKLWDHLEERFPLAYNDLFKRYTSGKEIPQSYAMAIARQESAWNPKVKSPVGASGLMQIMPGTATHTVKMFSIPGYSSPGQLLDPETNINIGTSYLQYVYQQFGNNRIFSSAAYNAGPGRVRTWLGNSAGRIDAVAFVESIPFSETRGYVKNVLAYDAYYRYFMGDKPTLMSATEWGRRY

SEQ ID NO: 7153 - protein, 518 aa, Escherichia coli; identical to SEQ ID NO: 6358
  strain K12

SEQ ID NO: 7154 - protein, 173 aa, Escherichia coli
  strain K12
MKRFSLAILALVVATGAQAASEKVEMNLVTSQGVGQSIGSVTITETDKGLEFSPDLKALPPGEHGFHIHAKGSCQPATKDGKASAAESAGGHLDPQNTGKHEGPEGAGHLGDLPALVVNNDGKATDAVIAPRLKSLDEIKDKALMVHVGGDNMSDQPKPLGGGGERYACGVIK

SEQ ID NO: 7155 - protein, 359 aa, Escherichia coli; identical to SEQ ID NO: 5847
  strain K12

SEQ ID NO: 7156 - protein, 274 aa, Escherichia coli; identical to SEQ ID NO: 6362
  strain K12

SEQ ID NO: 7157 - protein, 203 aa, Escherichia coli; identical to SEQ ID NO: 6396
  strain K12

SEQ ID NO: 7158 - protein, 446 aa, Escherichia coli
  strain K12
MSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGQTQQGQALAATANGIDSNTKIAHLNGNQWGFGWNAGILYELDKNNRYALTYRSEVKIDFKGNYSSDLNRAFNNYGLPIPTATGGATQSGYLTLNLPEMWEVSGYNRVDPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 7159 - protein, 774 aa, Escherichia coli; identical to SEQ ID NO: 6382
  strain K12

SEQ ID NO: 7160 - protein, 565 aa, Escherichia coli; identical to SEQ ID NO: 6395
  strain K12

SEQ ID NO: 7161 - protein, 897 aa, Escherichia coli; identical to SEQ ID NO: 6392
  strain K12

SEQ ID NO: 7162 - protein, 244 aa, Escherichia coli
  strain K12
MMKTKKLMMVALVSSTLALSGCGAMSTAIKKRNLEVKTQMSETIWLEPASERTVFLQIKNTSDKDMSGLQGKIADAVKAKGYQVVTSPDKAYYWIQANVLKADKMDLRESQGWLNRGYEGAAVGAALGAGITGYNSNSAGATLGVGLAAGLVGMAADAMVEDVNYTMITDVQIAERTKATVTTDNVAALRQGTSGAKIQTSTETGNQHKYQTRVVSNANKVNLKFEEAKPVLEDQLAKSIANIL

SEQ ID NO: 7163 - protein, 247 aa, Escherichia coli
  strain K12
MNKALLPLLLCCFIFPASGKDAGWQWYNEKINPKEKENKPVPAAPRQEPDIMQKLAALQTATKRALYEAILYPGVDNFVKYFRLQNYWAQQAGLFTMSARKAMLAHPELDYNLQYSHYNGTVRNQLAADQAQQRQAIAKLAEHYGIMFFYRGQDPIDGQLAQVINGFRDTYGLSVIPVSVDGVINPLLPDSRTDQGQAQRLGVKYFPAMMLVDPKQGSVRPLSYGFISQDDLAKQFLNVSEDFKPNF

SEQ ID NO: 7164 - protein, 300 aa, Escherichia coli
  strain K12
MLAFIRFLFAGLLLVISHAFAATVQDEHGTFTLEKTPQRIVVLELSFADALAAVDVIPIGIADDNDAKRILPEVRAHLKPWQSVGTRAQPSLEAIAALKPDLIIADSSRHAGVYIALQQIAPVLLLKSRNETYAENLQSAAIIGEMVGKKREMQARLEQHKERMAQWASQLPKGTRVAFGTSREQQFNLHTQETWTGSVLASLGLNVPAAMAGASMPSIGLEQLLAVNPAWLLVAHYREESIVKRWQQDPLWQMLTAAQKQQVASVDSNTWARMRGIFAAERIAADTVKIFHHQPLTVVK

SEQ ID NO: 7165 - protein, 458 aa, Escherichia coli
  strain K12
MMPRIKPLLVLCAALLTVTPAASADVNSDMNQFFNKLGFASNTTQPGVWQGQAAGYAYGGSLYARTQVKNVQLISMTLPDINAGCGGIDAYLGSFSFINGEQLQRFVKQIMSNAAGYFFDLALQTTVPEIKTAKDFLQKMASDINSMNLSSCQAAQGIIGGLFPRTQVSQQKVCQDIAGESNIFADWAASRQGCTVGGKSDSVRDKASDKDKERVTKNINIMWNALSKNRMFDGNKELKEFVMTLTGSLVFGPNGEITPLSARTTDRSIIRAMMEGGTAKISHCNDSDKCLKVVADTPVTISRDNALKSQITKLLASIQNKAVSDTPLDDKEKGFISSTTIPVFKYLVDPQMLGVSNSMIYQLTDYIGYDILLQYIQELIQQARAMVATGNYDEAVIGHINDNMNDATRQIAAFQSQVQVQQDALLVVDRQMSYMRQQLSARMLSRYQNNYHFGGSTL

SEQ ID NO: 7166 - protein, 338 aa, Escherichia coli
  strain K12
MNAKIIASLAFTSMFSLSTLLSPAHAEEQEKALNFGIISTESQQNLKPQWTPFLQDMEKKLGVKVNAFFAPDYAGIIQGMRFNKVDIAWYGNLSAMEAVDRANGQVFAQTVAADGSPGYWSVLIVNKDSPINNLNDLLAKRKDLTFGNGDPNSTSGFLVPGYYVFAKNNISASDFKRTVNAGHETNALAVANKQVDVATNNTENLDKLKTSAPEKLKELKVIWKSPLIPGDPIVWRKNLSETTKDKIYDFFMNYGKTPEEKAVLERLGWAPFRASSDLQLVPIRQLALFKEMQGVKSNKGLNEQDKLAKTTEIQAQLDDLDRLNNALSAMSSVSKAVQ

SEQ ID NO: 7167 - protein, 338 aa, Escherichia coli
  strain K12
MAVNLLKKNSLALVASLLLAGHVQATELLNSSYDVSRELFAALNPPFEQQWAKDNGGDKLTIKQSHAGSSKQALAILQGLKADVVTYNQVTDVQILHDKGKLIPADWQSRLPNNSSPFYSTMGFLVRKGNPKNIHDWNDLVRSDVKLIFPNPKTSGNARYTYLAAWGAADKADGGDKGKTEQFMTQFLKNVEVFDTGGRGATTTFAERGLGDVLISFESEVNNIRKQYEAQGFEVVIPKTNILAEFPVAWVDKNVQANGTEKAAKAYLNWLYSPQAQTIITDYYYRVNNPEVMDKLKDKFPQTELFRVEDKFGSWPEVMKTHFTSGGELDKLLAAGRN

SEQ ID NO: 7168 - protein, 729 aa, Escherichia coli; identical to SEQ ID NO: 6402
  strain K12

SEQ ID NO: 7169 - protein, 663 aa, Escherichia coli; identical to SEQ ID NO: 6307
  strain K12

SEQ ID NO: 7170 - protein, 181 aa, Escherichia coli
  strain K12
MSLTKSLLFTLLLSAAAVQASTRDEIERLWNPQGMATQPAQPAAGTSARTAKPAPRWFRLSNGRQVNLADWKVVLFMQGHCPYCHQFDPVLKQLAQQYGFSVFSYTLDGQGDTAFPEALPVPPDVMQTFFPNIPVATPTTFLVNVNTLEALPLLQGATDAAGFMARVDTVLQMYGGKKGAK

SEQ ID NO: 7171 - protein, 330 aa, Escherichia coli
  strain K12
MKRRLWLLMLFLFAGHVPAASADSACEGRFVNPITDICWSCIFPLSLGSIKVSQGKVPDTANPSMPIQICPAPPPLFRRIGLAIGYWEPMALTDVTRSPGCMVNLGFSLPAFGKTAQGTAKKDEKQVNGAFYHVHWYKYPLTYWLNIITSLGCLEGGDMDIAYLSEIDPTWTDSSLTTILNPEAVIFANPIAQGACAADAIASAFNMPLDVLFWCAGSQGSMYPFNGWVSNESSPLQSSLLVSERMAFKLHRQGMIMETIGKNNAVCNEYPSPILPKERWRYQMVNMYPDSGQCHPFGRSVTRWETGKNPPNTKKNFGYLMWRKRNCVFL

SEQ ID NO: 7172 - protein, 210 aa, Escherichia coli
  strain K12
MRCRGLIALLIWGQSVAAADLGTWGDLWPVKEPDMLTVIMQRLTALEQSGEMGRKMDAFKERVIRNSLRPPAVPGIGRTEKYGSRLFDPSVRLAADIRDNEGRVFARQGEVMNPLQYVPFNQTLYFINGDDPAQVAWMKRQTPPTLESKIILVQGSIPEMQKSLDSRVYFDQNGVLCQRLGIDQVPARVSAVPGDRFLKVEFIPAEEGRK

SEQ ID NO: 7173 - protein, 212 aa, Escherichia coli
  strain K12
MKLSMKSLAALLMMLNGAVMASENVNTPENRQFLKQQENLSRQLREKPDHQLKAWAEKQVLENPLQRSDNHFLDELVRKQQASQDGKPRQGALYFVSFSIPEEGLKRMLGETRHFGIPATLRGMVNNDLKTTAEAVLSLVKDGATDGVQIDPTLFSQYGIRTVPALVVFCSQGYDIIRGNLRVGQALEKVAATGDCRQVAHDLLAGKGDSGK

SEQ ID NO: 7174 - protein, 580 aa, Escherichia coli [sequence omitted]

SEQ ID NO: 7175 - protein, 413 aa, Escherichia coli
  strain K12
MNKTLIAAAVAGIVLLASNAQAQTVPEGYQLQQVLMMSRHNLRAPLANNGSVLEQSTPNKWPEWDVPGGQLTTKGGVLEVYMGHYMREWLAEQGMVKSGECPPPYTVYAYANSLQRTVATAQFFITGAFPGCDIPVHHQEKMGTMDPTFNPVITDDSAAFSEQAVAAMEKELSKLQLTDSYQLLEKIVNYKDSPACKEKQQCSLVDGKNTFSAKYQQEPGVSGPLKVGNSLVDAFTLQYYEGFPMDQVAWGEIKSDQQWKVLSKLKNGYQDSLFTSPEVARNVAKPLVSYIDKALVTDRTSAPKITVLVGHDSNIASLLTALDFKPYQLHDQNERTPIGGKIVFQRWHDSKANRDLMKIEYVYQSAEQLRNADALTLQAPAQRVTLELSGCPIDADGFCPMDKFDSVLNEAVK

SEQ ID NO: 7176 - protein, 658 aa, Escherichia coli
  strain K12
MSDDMSMGLPSSAGEHGVLRSMQEVAMSSQEASKMLRTYNIAWWGNNYYDVNELGHISVCPDPDVPEARVDLAQLVKTREAQGQRLPALFCFPQILQHRLRSINAAFKRARESYGYNGDYFLVYPIKVNQHRRVIESLIHSGEPLGLEAGSKAELMAVLAHAGMTRSVIVCNGYKDREYIRLALIGEKMGHKVYLVIEKMSEIAIVLDEAERLNVVPRLGVRARLASQGSGKWQSSGGEKSKFGLAATQVLQLVETLREAGRLDSLQLLHFHLGSQMANIRDIATGVRESARFYVELHKLGVNIQCFDVGGGLGVDYEGTRSQSDCSVNYGLNEYANNIIWAIGDACEENGLPHPTVITESGRAVTAHHTVLVSNIIGVERNEYTVPTAPAEDAPRALQSMWETWQEMHEPGTRRSLREWLHDSQMDLHDIHIGYSSGIFSLQERAWAEQLYLSMCHEVQKQLDPQNRAHRPIIDELQERMADKMYVNFSLFQSMPDAWGIDQLFPVLPLEGLDQVPERRAVLLDITCDSDGAIDHYIDGDGIATTMPMPEYDPENPPMLGFFMVGAYQEILGNMHNLFGDTEAVDVFVFPDGSVEVELSDEGDTVADMLQYVQLDPKTLLTQFRDQVKKTDLDAELQQQFLEEFEAGLYGYTYLEDE

SEQ ID NO: 7177 - protein, 268 aa, Escherichia coli
  strain K12
MKAFWRNAALLAVSLLPFSSANALALQAKQYGDFDRYVLALSWQTGFCQSQHDRNRNERDECRLQTETTNKADFLTVHGLWPGLPKSVAARGVDERRWMRFGCATRPIPNLPEARASRMCSSPETGLSLETAAKLSEVMPGAGGRSCLERYEYAKHGACFGFDPDAYFGTMVRLNQEIKESEAGKFLADNYGKTVSRRDFDAAFAKSWGKENVKAVKLTCQGNPAYLTEIQISIKADAINAPLSANSFLPQPHPGNCGKTFVIDKAGY

SEQ ID NO: 7178 - protein, 365 aa, Escherichia coli
  strain K12
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTQRATGVATYRNNDFFGLVDGLNFAAQYQGKNDRSDFDNYTEGNGDGFGFSATYEYEGFGIGATYAKSDRTDTQVNAGKVLPEVFASGKNAEVWAAGLKYDANNIYLATTYSETQNMTVFADHFVANKAQNFEAVAQYQFDFGLRPSVAYLQSKGKDLGVWGDQDLVKYVDVGATYYFNKNMSTFVDYKINLLDKNDFTKALGVSTDDIVAVGLVYQF

SEQ ID NO: 7179 - protein, 317 aa, Escherichia coli
  strain K12
MNPLLTDSRRQALRSASHWYAVLSGERVSPQQEARWQQWYEQDQDNQWAWQQVENLRNQLGGVPGDVASRALHDTRLTRRHVMKGLLLLLGAGGGWQLWQSETGEGLRADYRTAKGTVSRQQLEDGSLLTLNTQSAADVRFDAHQRTVRLWYGEIAITTAKDALQRPFRVLTRQGQLTALGTEFTVRQQDNFTQLDVQQHAVEVLLASAPAQKRIVNAGESLQFSASEFGAVKPLDDESTSWTKDILSFSDKPLGEVIATLTRYRNGVLRCDPAVAGLRLSGTFPLKNTDAILNVIAQTLPVKIQSITRYWINISPL

SEQ ID NO: 7180 - protein, 162 aa, Escherichia coli; identical to SEQ ID NO: 6365
  strain K12

SEQ ID NO: 7181 - protein, 543 aa, Escherichia coli
  strain K12
MTNITKRSLVAAGVLAALMAGNVALAADVPAGVTLAEKQTLVRNNGSEVQSLDPHKIEGVPESNISRDLFEGLLVSDLDGHPAPGVAESWDNKDAKVWTFHLRKDAKWSDGTPVTAQDFVYSWQRSVDPNTASPYASYLQYGHIAGIDEILEGKKPITDLGVKAIDDHTLEVTLSEPVPYFYKLLVHPSTSPVPKAAIEKFGEKWTQPGNIVTNGAYTLKDWVVNERIVLERSPTYWNNAKTVINQVTYLPIASEVTDVNRYRSGEIDMTNNSMPIELFQKLKKEIPDEVHVDPYLCTYYYEINNQKPPFNDVRVRTALKLGMDRDIIVNKVKAQGNMPAYGYTPPYTDGAKLTQPEWFGWSQEKRNEEAKKLLAEAGYTADKPLTINLLYNTSDLHKKLAIAASSLWKKNIGVNVKLVNQEWKTFLDTRHQGTFDVARAGWCADYNEPTSFLNTMLSNSSMNTAHYKSPAFDSIMAETLKVTDEAQRTALYTKAEQQLDKDSAIVPVYYYVNARLVKPWVGGYTGKDPLDNTYTRNMYIVKH

SEQ ID NO: 7182 - protein, 535 aa, Escherichia coli
  strain K12
MRISLKKSGMLKLGLSLVAMTVAASVQAKTLVYCSEGSPEGFNPQLFTSGTTYDASSVPLYNRLVEFKIGTTEVIPGLAEKWEVSEDGKTYTFHLRKGVKWHDNKEFKPTRELNADDVVFSFDRQKNAQNPYHKVSGGSYEYFEGMGLPELISEVKKVDDNTVQFVLTRPEAPFLADLAMDFASILSKEYADAMMKAGTPEKLDLNPIGTGPFQLQQYQKDSRIRYKAFDGYWGTKPQIDTLVFSITPDASVRYAKLQKNECQVMPYPNPADIARMKQDKSINLMEMPGLNVGYLSYNVQKKPLDDVKVRQALTYAVNKDAIIKAVYQGAGVSAKNLIPPTMWGYNDDVQDYTYDPEKAKALLKEAGLEKGFSIDLWAMPVQRPYNPNARRMAEMIQADWAKVGVQAKIVTYEWGEYLKRAKDGEHQTVMMGWTGDNGDPDNFFATLFSCAASEQGSNYSKWCYKPFEDLIQPARATDDHNKRVELYKQAQVVMHDQAPALIIAHSTVFEPVRKEVKGYVVDPLGKHHFENVSIE

SEQ ID NO: 7183 - protein, 104 aa, Escherichia coli
  strain K12
MFKKGLLALALVFSLPVFAAEHWIDVRVPEQYQQEHVQGAINIPLKEVKERIATAVPDKNDTVKVYCNAGRQSGQAKEILSEMGYTHVENAGGLKDIAMPKVKG

SEQ ID NO: 7184 - protein, 602 aa, Escherichia coli
  strain K12
MKRILPLILALVAGMAQADSNSDYRAGSDFAHQIKGQGSSSIQGFKPQESIPGYNANPDETKYYGGVTAGGDGGLKNDGTTEWATGETGKTITESFMNKPKDILSPDAPFIQTGRDVVNRADSIVGNTGQQCSAQEISRSEYTNYTCERDLQVEQYCTRTARMELQGSTTWETRTLEYEMSQLPAREVNGQYVVSITSPVTGEIVDAHYSWSRTYLQKSVPMTITVLGTPLSWNAKYSADASFTPVQKTLTAGVAFTSSHPVRVGNTKFKRHTAMKLRLVVRVKKASYTPYVVWSESCPFSKELGKLTKTECTEAGGNRTLVKDGQSYSMYQSCWAYRDTYVTQSADKGTCQTYTDNPACTLVSHQCAFYSEEGACLHEYATYSCESKTSGKVMVCGGDVFCLDGECDKAQSGKSNDFAEAVSQLAALAAAGKDVAALNGVDVRAFTGQAKFCKKAAAGYSNCCKDSGWGQDIGLAKCSSDEKALAKAKSNKLTVSVGEFCSKKVLGVCLEKKRSYCQFDSKLAQIVQQQGRNGQLRISFGSAKHPDCRGITVDELQKIQFNRLDFTNFYEDLMNNQKIPDSGVLTQKVKEQIADQLKQAGQ

SEQ ID NO: 7185 - protein, 1015 aa, Escherichia coli
  strain K12
  MOD_RES (196)..(196): Selenocysteine
MDVSRRQFFKICAGGMAGTTVAALGFAPKQALAQARNYKLLRAKEIRNTCTYCSVGCGLLMYSLGDGAKNAREAIYHIEGDPDHPVSRGALCPKGAGLLDYVNSENRLRYPEYRAPGSDKWQRISWEEAFSRIAKLMKADRDANFIEKNEQGVTVNRWLSTGMLCASGASNETGMLTQKFARSLGMLAVDNQARVXHGPTVASLAPTFGRGAMTNHWVDIKNANVVMVMGGNAAEAHPVGFRWAMEAKNNNDATLIVVDPRFTRTASVADIYAPIRSGTDITFLSGVLRYLIENNKINAEYVKHYTNASLLVRDDFAFEDGLFSGYDAEKRQYDKSSWNYQLDENGYAKRDETLTHPRCVWNLLKEHVSRYTPDVVENICGTPKADFLKVCEVLASTSAPDRTTTFLYALGWTQHTVGAQNIRTMAMIQLLLGNMGMAGGGVNALRGHSNIQGLTDLGLLSTSLPGYLTLPSEKQVDLQSYLEANTPKATLADQVNYWSNYPKFFVSLMKSFYGDAAQKENNWGYDWLPKWDQTYDVIKYFNMMDEGKVTGYFCQGFNPVASFPDKNKVVSCLSKLKYMVVIDPLVTETSTFWQNHGESNDVDPASIQTEVFRLPSTCFAEEDGSIANSGRWLQWHWKGQDAPGEARNDGEILAGIYHHLRELYQSEGGKGVEPLMKMSWNYKQPHEPQSDEVAKENNGYALEDLYDANGVLIAKKGQLLSSFAHLRDDGTTASSCWIYTGSWTEQGNQMANRDNSDPSGLGNTLGWAWAWPLNRRVLYNRASADINGKPWDPKRMLIQWNGSKWTGNDIPDFGNAAPGTPTGPFIMQPEGMGRLFAINKMAEGPFPEHYEPIETPLGTNPLHPNVVSNPVVRLYEQDALRMGKKEQFPYVGTTYRLTEHFHTWTKHALLNAIAQPEQFVEISETLAAAKGINNGDRVTVSSKRGFIRAVAVVTRRLKPLNVNGQQVETVGIPIHWGFEGVARKGYIANTLTPNVGDANSQTPEYKAFLVNIEKA

SEQ ID NO: 7186 - protein, 468 aa, Escherichia coli
  strain K12
MASISSLGVGSGLDLSSILDSLTAAQKATLTPISNQQSSFTAKLSAYGTLKSALTTFQTANTALSKADLFSATSTTSSTTAFSATTAGNAIAGKYTISVTHLAQAQTLTTRTTRDDTKTAIATSDSKLTIQQGGDKDPITIDISAANSSLSGIRDAINNAKAGVSASIINVGNGEYRLSVTSNDTGLDNAMTLSVSGDDALQSFMGYDASASSNGMEVSVAAQNAQLTVNNVAIENSSNTISDALENITLNLNDVTTGNQTLTITQDTSKAQTAIKDWVNAYNSLIDTFSSLTKYTAVDAGADSQSSSNGALLGDSTLRTIQTQLKSMLSNTVSSSSYKTLAQIGITTDPSDGKLELDADKLTAALKKDASGVGALIVGDGKKTGITTTIGSNLTSWLSTTGIIKAATDGVSKTLNKLTKDYNAASDRIDAQVARYKEQFTQLDVLMTSLNSTSSYLTQQFENNSNSK

SEQ ID NO: 7187 - protein, 477 aa, Escherichia coli
  strain K12
MRFSRFIIGLTSCIAFSVQAANVDEYITQLPAGANLALMVQKVGASAPAIDYHSQQMALPASTQKVITALAALIQLGPDFRFTTTLETKGNVENGVLKGDLVARFGADPTLKRQDIRNMVATLKKSGVNQIDGNVLIDTSIFASHDKAPGWPWNDMTQCFSAPPAAAIVDRNCFSVSLYSAPKPGDMAFIRVASYYPVTMFSQVRTLPRGSAEAQYCELDVVPGDLNRFTLTGCLPQRSEPLPLAFAVQDGASYAGAILKDELKQAGITWSGTLLRQTQVNEPGTVVASKQSAPLHDLLKIMLKKSDNMIADTVFRMIGHARFNVPGTWRAGSDAVRQILRQQAGVDIGNTIIADGSGLSRHNLIAPATMMQVLQYIAQHDNELNFISMLPLAGYDGSLQYRAGLHQAGVDGKVSAKTGSLQGVYNLAGFITTASGQRMAFVQYLSGYAVEPADQRNRRIPLVRFESRLYKDIYQNN

SEQ ID NO: 7188 - protein, 551 aa, Escherichia coli
  strain K12
MEFSFSPKRLVVAVAAALPLMASAADTPSTATARKGFAGYDHPNQYLVKPATTIADNMMPVMQHPAQDKETQQKLAELEKKTGKKPNVVVFLLDDVGWMDVGFNGGGVAVGNPTPDIDAVASQGLILTSAYSQPSSSPTRATILTGQYSIHHGILMPPMYGQPGGLQGLTTLPQLLHDQGYVTQAIGKWHMGENKESQPQNVGFDDFRGFNSVSDMYTEWRDVHVNPEVALSPDRSEYIKQLPFSKDDVHAVRGGEQQAIADITPKYMEDLDQRWMDYGVKFLDKMAKSDKPFFLYYGTRGCHFDNYPNAKYAGSSPARTSYGDCMVEMNDVFANLYKTLEKNGQLDNTLIVFTSDNGPEAEVPPHGRTPFRGAKGSTWEGGVRVPTFVYWKGMIQPRKSDGIVDLADLFPTALDLAGHPGAKVANLVPKTTFIDGVDQTSFFLGTNGQSNRKAEHYFLNGKLAAVRMDEFKYHVLIQQPYAYTQSGYQGGFTGTVMQTAGSSVFNLYTDPQESDSIGVRHIPMGVPLQTEMHAYMEILKKYPPRAQIKSD

SEQ ID NO: 7189 - protein, 676 aa, Escherichia coli
  strain K12
MKLAACFLTLLPGFAVAASWTSPGFPAFSEQGTGTFVSHAQLPKGTRPLTLNFDQQCWQPADAIKLNQMLSLQPCSNTPPQWRLFRDGEYTLQIDTRSGTPTLMISIQNAAEPVASLVRECPKWDGLPLTVDVSATFPEGAAVRDYYSQQIAIVKNGQIMLQPAATSNGLLLLERAETDTSAPFDWHNATVYFVLTDRFENGDPSNDQSYGRHKDGMAEIGTFHGGDLRGLTNKLDYLQQLGVNALWISAPFEQIHGWVGGGTKGDFPHYAYHGYYTQDWTNLDANMGNEADLRTLVDSAHQRGIRILFDVVMNHTGYATLADMQEYQFGALYLSGDEVKKSLGERWSDWKPAAGQTWHSFNDYINFSDKTGWDKWWGKNWIRTDIGDYDNPGFDDLTMSLAFLPDIKTESTTASGLPVFYKNKMDTHAKAIDGYTPRDYLTHWLSQWVRDYGIDGFRVDTAKHVELPAWQQLKTEASAALREWKKANPDKALDDKPFWMTGEAWGHGVMQSDYYRHGFDAMINFDYQEQAAKAVDCLAQMDTTWQQMAEKLQGFNVLSYLSSHDTRLFREGGDKAAELLLLAPGAVQIFYGDESSRPFGPTGSDPLQGTRSDMNWQDVSGKSAASVAHWQKISQFRARHPAIGAGKQTTLLLKQGYGFVREHGDDKVLVVWAGQQ

SEQ ID NO: 7190 - protein, 235 aa, Escherichia coli
  strain K12
MYRYLSIAAVVLSAAFSGPALAEGINSFSQAKAAAVKVHADAPGTFYCGCKINWQGKKGVVDLQSCGYQVRKNENRASRVEWEHVVPAWQFGHQRQCWQDGGRKNCAKDPVYRKMESDMHNLQPSVGEVNGDRGNFMYSQWNGGEGQYGQCAMKVDFKEKAAEPPARARGAIARTYFYMRDQYNLTLSRQQTQLFNAWNKMYPVTDWECERDERIAKVQGNHNPYVQRACQARKS

SEQ ID NO: 7191 - protein, 538 aa, Escherichia coli; identical to SEQ ID NO: 6546
  strain K12

SEQ ID NO: 7192 - protein, 445 aa, Escherichia coli
  strain K12
MMYRIRNWLVATLLLLCTPVGAATLSDIQVSNGNQQARITLSFIGDPDYAFSHQSKRTVALDIKQTGVIQGLPLLFSGNNLVKAIRSGTPKDAQTLRLVVDLTENGKTEAVKRQNGSNYTVVFTINADVPPPPPPPPVVAKRVETPAVVAPRVSEPARNPFKTESNRTTGVISSNTVTRPAARATANTGDKIIIAIDAGHGGQDPGAIGPGGTREKNVTIAIARKLRTLLNDDPMFKGVLTRDGDYFISVMGRSDVARKQNANFLVSIHADAAPNRSATGASVWVLSNRRANSEMASWLEQHEKQSELLGGAGDVLANSQSDPYLSQAVLDLQFGHSQRVGYDVATSMISQLQRIGEIHKRRPEHASLGVLRSPDIPSVLVETGFISNNSEERLLASDDYQQQLAEAIYKGLRNYFLAHPMQSAPQGATAQTASTVTTPDRTLPN

SEQ ID NO: 7193 - protein, 470 aa, Escherichia coli
  strain K12
MSLSRRQFIQASGIALCAGAVPLKASAAGQQQPLPVPPLLESRRGQPLFMTVQRAHWSFTPGTRASVWGINGRYLGPTIRVWKGDDVKLIYSNRLTENVSMTVAGLQVPGPLMGGPARMMSPNADWAPVLPIRQNAATLWYHANTPNRTAQQVYNGLAGMWLVEDEVSKSLPIPNHYGVDDFPVIIQDKRLDNFGTPEYNEPGSGGFVGDTLLVNGVQSPYVEVSRGWVRLRLLNASNSRRYQLQMNDGRPLHVISGDQGFLPAPVSVKQLSLAPGERREILVDMSNGDEVSITCGEAASIVDRIRGFFEPSSILVSTLVLTLRPTGLLPLVTDSLPMRLLPTEIMAGSPIRSRDISLGDDPGINGQLWDVNRIDVTAQQGTWERWTVRADEPQAFHIEGVMFQIRNVNGAMPFPEDRGWKDTVWVDGQVELLVYFGQPSWAHFPFYFNSQTLEMADRGSIGQLLVNPVP

SEQ ID NO: 7194 - protein, 109 aa, Escherichia coli
  strain K12
MTMKKLLIIILPVLLSGCSAFNQLVERMQTDTLEYQCDEKPLTVKLNNPRQEVSFVYDNQLLHLKQGISASGARYTDGIYVFWSKGDEATVYKRDRIVLNNCQLQNPQR

SEQ ID NO: 7195 - protein, 617 aa, Escherichia coli
  strain K12
MRRFLTTLMILLVVLVAGLSALVLLVNPNDFRDYMVKQVAARSGYQLQLDGPLRWHVWPQLSILSGRMSLTAQGASQPLVRADNMRLDVALLPLLSHQLSVKQVMLKGAVIQLTPQTEAVRSEDAPVAPRDNTLPDLSDDRGWSFDISSLKVADSVLVFQHEDDEQVTIRNIRLQMEQDPQHRGSFEFSGRVNRDQRDLTISLNGTVDASDYPHDLTAAIEQINWQLQGADLPKQGIQGQGSFQAQWQESHKRLSFNQISLTANDSTLSGQAQVTLTEKPEWQLRLQFPQLNLDNLIPLNETANGENGAAQQGQSQSTLPRPVISSRIDEPAYQGLQGFTADILLQASNVRWRGMNFTDVATQMTNKSGLLEITQLQGKLNGGQVSLPGTLDATSINPRINFQPRLENVEIGTILKAFNYPISLTGKMSLAGDFSGADIDADAFRHNWQGQAHVEMTDTRMEGMNFQQMIQQAVERNGGDVKAAENFDNVTRLDRFTTDLTLKDGVVTLNDMQGQSPVLALTGEGMLNLADQTCDTQFDIRVVGGWNGESKLIDFLKETPVPLRVYGNWQQLNYSLQVDQLLRKHLQDEAKRRLNDWAERNKDSRNGKDVKKLLEKM

SEQ ID NO: 7196 - protein, 224 aa, Escherichia coli
  strain K12
MLRHITFTVFITTSMNTLATGMVPETSVLLVDEKRGEASINIKNTDDHPSLLYTTIVDLPESNKSIRLIPTQPVIRVEAGQVQQVRFLLQATVPLQSEELKRVTFEGIPPKDDKSSRVTVSIRQDLPVLIHPASLPEERETWKFLEWRKNGDQIEISNPSNYVVRMTLQFKTLPSGKTGAINKTYFLPHTSTTTALTNATDTKVEFYPASRYGYRGNKYVTDLK

SEQ ID NO: 7197 - protein, 317 aa, Escherichia coli
  strain K12
MRFSTQMMYQQNMRGITNSQAEWMKYGEQMSTGKRVVNPSDDPIAASQAVVLSQAQAQNSQYTLARTFATQKVSLEESVLSQVTTAIQNAQEKIVYASNGTLSDDDRASLATDIQGLRDQLLNLANTTDGNGRYIFAGYKTETAPFSEEKGKYVGGAESIKQQVDASRSMVIGHTGDKIFDSITSNAVAEPDGSASETNLFAMLDSAIAALKTPVADSEADKETAAAALDKTNRGLKNSLNNVLTVRAELGTQLNELESLDSLGSDRALGQTQQMSDLVDVDWNATISSYIMQQTALQASYKAFTDMQGLSLFQLSK

SEQ ID NO: 7198 - protein, 878 aa, Escherichia coli; identical to SEQ ID NO: 6378
  strain K12

SEQ ID NO: 7199 - protein, 243 aa, Escherichia coli
  strain K12
MKKVLIAALIAGFSLSATAAETIRFATEASYPPFESIDANNQIVGFDVDLAQALCKEIDATCTFSNQAFDSLIPSLKFRRVEAVMAGMDITPEREKQVLFTTPYYDNSALFVGQQGKYTSVDQLKGKKVGVQNGTTHQKFIMDKHPEITTVPYDSYQNAKLDLQNGRIDGVFGDTAVVTEWLKDNPKLAAVGDKVTDKDYFGTGLGIAVRQGNTELQQKLNTALEKVKKDGTYETIYNKWFQK

SEQ ID NO: 7200 - protein, 243 aa, Escherichia coli
  strain K12
MKKLVLAALLASFTFGASAAEKINFGVSATYPPFESIGANNEIVGFDIDLAKALCKQMQAECTFTNHAFDSLIPSLKFRKYDAVISGMDITPERSKQVSFTTPYYENSAVVIAKKDTYKTFADLKGKRIGMENGTTHQKYIQDQHPEVKTVSYDSYQNAFIDLKNGRIDGVFGDTAVVNEWLKTNPQLGVATEKVTDPQYFGTGLGIAVRPDNKALLEKLNNALAAIKADGTYQKISDQWFPQ

SEQ ID NO: 7201 - protein, 370 aa, Escherichia coli
  strain K12
MTALNKKWLSGLVAGALMAVSVGTLAAEQKTLHIYNWSDYIAPDTVANFEKETGIKVVYDVFDSNEVLEGKLMAGSTGFDLVVPSASFLERQLTAGVFQPLDKSKLPEWKNLDPELLKLVAKHDPDNKFAMPYMWATTGIGYNVDKVKAVLGENAPVDSWDLILKPENLEKLKSCGVSFLDAPEEVFATVLNYLGKDPNSTKADDYTGPATDLLLKLRPNIRYFHSSQYINDLANGDICVAIGWAGDVWQASNRAKEAKNGVNVSFSIPKEGAMAFFDVFAMPADAKNKDEAYQFLNYLLRPDVVAHISDHVFYANANKAATPLVSAEVRENPGIYPPADVRAKLFTLKVQDPKIDRVRTRAWTKVKSGK

SEQ ID NO: 7202 - protein, 423 aa, Escherichia coli
  strain K12
MQYKDENGVNEPSRRRLLKVIGALALAGSCPVAHAQKTQSAPGTLSPDARNEKQPFYGEHQAGILTPQQAAMMLVAFDVLASDKADLERLFRLLTQRFAFLTQGGAAPETPNPRLPPLDSGILGGYIAPDNLTITLSVGHSLFDERFGLAPQMPKKLQKMTRFPNDSLDAALCHGDVLLQICANTQDTVIHALRDIIKHTPDLLSVRWKREGFISDHAARSKGKETPINLLGFKDGTANPDSQNDKLMQKVVWVTADQQEPAWTIGGSYQAVRLIQFRVEFWDRTPLKEQQTIFGRDKQTGAPLGMQHEHDVPDYASDPEGKVIALDSHIRLANPRTAESESSLMLRRGYSYSLGVTNSGQLDMGLLFVCYQHDLEKGFLTVQKRLNGEALEEYVKPIGGGYFFALPGVKDANDYFGSALLRV

SEQ ID NO: 7203 - protein, 327 aa, Escherichia coli
  strain K12
MLKKCLPLLLLCTAPVFAKPVLTVYTYDSFAADWGPGPVVKKAFEADCNCELKLVALEDGVSLLNRLRMEGKNSKADVVLGLDNNLLDAASKTGLFAKSGVAADAVNVPGGWNNDTFVPFDYGYFAFVYDKNKLKNPPQSLKELVESDQNWRVIYQDPRTSTPGLGLLLWMQKVYGDDAPQAWQKLAKKTVTVTKGWSEAYGLFLKGESDLVLSYTTSPAYHILEEKKDNYAAANFSEGHYLQVEVAARTAASKQPELAQKFLQFMVSPAFQNAIPTGNWMYPVANVTLPAGFEKLTKPATTLEFTPAEVAAQRQAWISEWQRAVSR

SEQ ID NO: 7204 - protein, 784 aa, Escherichia coli; identical to SEQ ID NO: 6283
  strain K12

SEQ ID NO: 7205 - protein, 990 aa, Escherichia coli
  strain K12
MKENNLNRVIGWSGLLLTSLLSTSALADNIGTSAEELGLSDYRHFVIYPRLDKALKAQKNNDEATAIREFEYIHQQVPDNIPLTLYLAEAYRHFGHDDRARLLLEDQLKRHPGDARLERSLAAIPVEVKSVTTVEELLAQQKACDAAPTLRCRSEVGQNALRLAQLPVARAQLNDATFAASPEGKTLRTDLLQRAIYLKQWSQADTLYNEARQQNTLSAAERRQWFDVLLAGQLDDRILALQSQGIFTDPQSYITYATALAYRGEKARLQHYLIENKPLFTTDAQEKSWLYLLSKYSANPVQALANYTVQFADNRQYVVGATLPVLLKEGQYDAAQKLLATLPANEMLEERYAVSVATRNKAEALRLARLLYQQEPANLTRLDQLTWQLMQNEQSREAADLLLQRYPFQGDARVSQTLMARLASLLESHPYLATPAKVAILSKPLPLAEQRQWQSQLPGIADNCPAIVRLLGDMSPSYDAAAWNRLAKCYRDTLPGVALYAWLQAEQRQPSAWQHRAVAYQAYQVEDYATALAAWQKISLHDMSNEDLLAAANTAQAAGNGAARDRWLQQAEKRGLGSNALYWWLHAQRYIPGQPELALNDLTRSINIAPSANAYVARATIYRQRHNVPAAVSDLRAALELEPNNSNTQAALGYALWDSGDIAQSREMLEPAHKGLPDDPALIRQLAYVNQRLDDMPATQHYARLVIDDIDNQALITPLTPEQNQQRFNFRRLHEEVGRRWTFSFDSSIGLRSGAMSTANNNVGGAAPGKSYRSYGQLEAEYRIGRNMLLEGDLLSVYSRVFADTGENGVMMPVKNPMSGTGLRWKPLRDQIFFIAVEQQLPLNGQNGASDTMLRASASFFNGGKYSDEWHPNGSGWFAQNLYLDAAQYIRQDIQAWTADYRVSWHQKVANGQTIEPYAHVQDNGYRDKGTQGAQLGGVGVRWNIWTGETHYDAWPHKVSLGVEYQHTFKAINQRNGERNNAFLTIGVHW

SEQ ID NO: 7206 - protein, 241 aa, Escherichia coli; identical to SEQ ID NO: 6379
  strain K12

SEQ ID NO: 7207 - protein, 1016 aa, Escherichia coli
  strain K12
  MOD_RES (196)..(196): Selenocysteine
MQVSRRQFFKICAGGMAGTTAAALGFAPSVALAETRQYKLLRTRETRNTCTYCSVGCGLLMYSLGDGAKNAKASIFHIEGDPDHPVNRGALCPKGAGLVDFIHSESRLKFPEYRAPGSDKWQQISWEEAFDRIAKLMKEDRDANYIAQNAEGVTVNRWLSTGMLCASASSNETGYLTQKFSRALGMLAVDNQARVXHGPTVASLAPTFGRGAMTNHWVDIKNANLVVVMGGNAAEAHPVGFRWAMEAKIHNGAKLIVIDPRFTRTAAVADYYAPIRSGTDIAFLSGVLLYLLNNEKFNREYTEAYTNASLIVREDYGFEDGLFTGYDAEKRKYDKSSWTYELDENGFAKRDTTLQHPRCVWNLLKQHVSRYTPDVVENICGTPKDAFLKVCEYIAETSAHDKTASFLYALGWTQHSVGAQNIRTMAMIQLLLGNMGMAGGGVNALRGHSNIQGLTDLGLLSQSLPGYMTLPSEKQTDLQTYLTANTPKPLLEGQVNYWGNYPKFFVSMMKAFFGDKATAENSWGFDWLPKWDKGYDVLQYFEMMKEGKVNGYICQGFNPVASFPNKNKVIGCLSKLKFLVTIDPLNTETSNFWQNHGELNEVDSSKIQTEVFRLPSTCFAEENGSIVNSGRWLQWHWKGADAPGIALTDGEILSGIFLRLRKMYAEQGGANPDQVLNMTWNYAIPHEPSSEEVAMESNGKALADITDPATGAVIVKKGQQLSSFAQLRDDGTTSCGCWIFAGSWTPEGNQMARRDNADPSGLGNTLGWAWAWPLNRRILYNRASADPQGNPWDPKRQLLKWDGTKWTGWDIPDYSAAPPGSGVGPFIMQQEGMGRLFALDKMAEGPFPEHYEPFETPLGTNPLHPNVISNPAARIFKDDAEALGKADKFPYVGTTYRLTEHFHYWTKHALLNAILQPEQFVEIGESLANKLGIAQGDTVKVSSNRGYIKAKAVVTKRIRTLKANGKDIDTIGIPIHWGYEGVAKKGFIANTLTPFVGDANTQTPEFKSFLVNVEKV

SEQ ID NO: 7208 - protein, 127 aa, Escherichia coli
  strain K12
MNKGLLTLLLLFTCFAHAQVVDTWQFANPQQQQQALNIASQLRCPQCQNQNLLESNAPVAVSMRHQVYSMVAEGKNEVEIIGWMTERYGDFVRYNPPLTGQTLVLWALPVVLLLLMALILWRVRAKR

SEQ ID NO: 7209 - protein, 488 aa, Escherichia coli
  strain K12
MINRQLSRLLLCSILGSTTLISGCALVRKDSAPHQQLKPEQIKLADDIHLASSGWPQAQWWKQLNDPQLDALIQRTLSGSHTLAEAKLREEKAQSQADLLDAGSQLQVAALGMLNRQRVSANGFLSPYSMDAPALGMDGPYYTEATVGLFAGLDLDLWGVHRSAVAAAIGAHNAALAETAAVELSLATGVAQLYYSMQASYQMLDLLEQTHDVIDYAVKAHQSKVAHGLEAQVPFHGARAQILAVDKQIVAVKGQITETRESLRALIGAGASDMPEIRPVALPQVQTGIPATLSYELLARRPDLQAMRWYVQASLDQVDSARALFYPSFDIKAFFGLDSIHLHTLFKKTSRQFNFIPGLKLPLFDGGRLNANLEGTRAASNMMIERYNQSVLNAVRDVAVNGTRLQTLNDEREMQAERVEATRFTQRAAEAAYQRGLTSRLQATEARLPVLAEEMSLLMLDSRRVIQSIQLMKSLGGGYQAGPVVEKK

SEQ ID NO: 7210 - protein, 246 aa, Escherichia coli; identical to SEQ ID NO: 6964
  strain K12

SEQ ID NO: 7211 - protein, 865 aa, Escherichia coli; identical to SEQ ID NO: 6375
  strain K12

SEQ ID NO: 7212 - protein, 511 aa, Escherichia coli; identical to SEQ ID NO: 6694
  strain K12

SEQ ID NO: 7213 - protein, 118 aa, Escherichia coli; identical to SEQ ID NO: 6381
  strain K12

SEQ ID NO: 7214 - protein, 848 aa, Escherichia coli
  strain K12
MNNNDLFQASRRRFLAQLGGLTVAGMLGPSLLTPRRATAAQAATDAVISKEGILTGSHWGAIRATVKDGRFVAAKPFELDKYPSKMIAGLPDHVHNAARIRYPMVRVDWLRKRHLSDTSQRGDNRFVRVSWDEALDMFYEELERVQKTHGPSALLTASGWQSTGMFHNASGMLAKAIALHGNSVGTGGDYSTGAAQVILPRVVGSMEVYEQQTSWPLVLQNSKTIVLWGSDLLKNQQANWWCPDHDVYEYYAQLKAKVAAGEIEVISIDPVVTSTHEYLGREHVKHIAVNPQTDVPLQLALAHTLYSENLYDKNFLANYCVGFEQFLPYLLGEKDGQPKDAAWAEKLTGIDAETIRGLARQMAANRTQIIAGWCVQRMQHGEQWAWMIVVLAAMLGQIGLPGGGFGFGWHYNGAGTPGRKGVILSGFSGSTSIPPVHDNSDYKGYSSTIPIARFIDAILEPGKVINWNGKSVKLPPLKMCIFAGTNPFHRHQQINRIIEGLRKLETVIAIDNQWTSTCRFADIVLPATTQFERNDLDQYGNHSNRGIIAMKQVVPPQFEARNDFDIFRELCRRFNREEAFTEGLDEMGWLKRIWQEGVQQGKGRGVHLPAFDDFWNNKEYVEFDHPQMFVRHQAFREDPDLEPLGTPSGLIEIYSKTIADMNYDDCQGHPMWFEKIERSHGGPGSQKYPLHLQSVHPDFRLHSQLCESETLRQQYTVAGKEPVFINPQDASARGIRNGDVVRVFNARGQVLAGAVVSDRYAPGVARIHEGAWYDPDKGGEPGALCKYGNPNVLTIDIGTSQLAQATSAHTTLVEIEKYNGTVEQVTAFNGPVEMVAQCEYVPASQVKS

SEQ ID NO: 7215 - protein, 547 aa, Escherichia coli
  strain K12
MSSLINNAMSGLNAAQAALNTASNNISSYNVAGYTRQTTIMAQANSTLGAGGWVGNGVYVSGVQREYDAFITNQLRAAQTQSSGLTARYEQMSKIDNMLSTSTSSLATQMQDFFTSLQTLVSNAEDPAARQALIGKSEGLVNQFKTTDQYLRDQDKQVNIAIGASVDQINNYAKQIASLNDQISRLTGVGAGASPNNLLDQRDQLVSELNQIVGVEVSVQDGGTYNITMANGYSLVQGSTARQLAAVPSSADPSRTTVAYVDGTAGNIEIPEKLLNTGSLGGILTFRSQDLDQTRNTLGQLALAFAEAFNTQHKAGFDANGDAGEDFFAIGKPAVLQNTKNKGDVAIGATVTDASAVLATDYKISFDNNQWQVTRLASNTTFTVTPDANGKVAFDGLELTFTGTPAVNDSFTLKPVSDAIVNMDVLITDEAKIAMASEEDAGDSDNRNGQALLDLQSNSKTVGGAKSFNDAYASLVSDIGNKTATLKTSSATQGNVVTQLSNQQQSISGVNLDEEYGNLQRFQQYYLANAQVLQTANAIFDALINIR

SEQ ID NO: 7216 - protein, 826 aa, Escherichia coli; identical to SEQ ID NO: 6373
  strain K12

SEQ ID NO: 7217 - protein, 239 aa, Escherichia coli; identical to SEQ ID NO: 6428
  strain K12

SEQ ID NO: 7218 - protein, 305 aa, Escherichia coli
  strain K12
MPLLKLWAGSLVMLAAVSLPLQAASPVKVGSKIDTEGALLGNIILQVLESHGVPTVNKVQLGTTPVVRGAITSGELDIYPEYTGNGAFFFKDENDAAWKNAQQGYEKVKKLDSEHNKLIWLTPAPANNTWTIAVRQDVAEKNKLTSLADLSRYLQEGGTFKLAASAEFIERADALPAFEKAYGFKLGQDQLLSLAGGDTAVTIKAAAQQTSGVNAAMAYGTDGPVAALGLQTLSDPQGVQPIYAPAPVVRESVLREYPQMAQWLQPVFASLDAKTLQQLNASIAVEGLDAKKVAADYLKQKGWTK

SEQ ID NO: 7219 - protein, 765 aa, Escherichia coli
  strain K12
MKWLCSVGIAVSLALQPALADDLFGNHPLTPEARDAFVTELLKKMTVDEKIGQLRLISVGPDNPKEAIREMIKDGQVGAIFNTVTRQDIRAMQDQVMELSRLKIPLFFAYDVLHGQRTVFPISLGLASSFNLDAVKTVGRVSAYEAADDGLNMTWAPMVDVSRDPRWGRASEGFGEDTYLTSTMGKTMVEAMQGKSPADRYSVMTSVKHFAAYGAVEGGKEYNTVDMSPQRLFNDYMPPYKAGLDAGSGAVMVALNSLNGTPATSDSWLLKDVLRDQWGFKGITVSDHGAIKELIKHGTAADPEDAVRVALKSGINMSMSDEYYSKYLPGLIKSGKVTMAELDDAARHVLNVKYDMGLFNDPYSHLGPKESDPVDTNAESRLHRKEAREVARESLVLLKNRLETLPLKKSATIAVVGPLADSKRDVMGSWSAAGVADQSVTVLTGIKNAVGENGKVLYAKGANVTSDKGIIDFLNQYEEAVKVDPRSPQEMIDEAVQTAKQSDVVVAVVGEAQGMAHEASSRTDITIPQSQRDLIAALKATGKPLVLVLMNGRPLALVKEDQQADAILETWFAGTEGGNAIADVLFGDYNPSGKLPMSFPRSVGQIPVYYSHLNTGRPYNADKPNKYTSRYFDEANGALYPFGYGLSYTTFTVSDVKLSAPTMKRDGKVTASVQVTNTGKREGATVVQMYLQDVTASMSRPVKQLKGFEKITLKPGETQTVSFPIDIEALKFWNQQMKYDAEPGKFNVFIGTDSARVKKGEFELL

SEQ ID NO: 7220 - protein, 478 aa, Escherichia coli
  strain K12
  MOD_RES (56)..(56): Any amino acid
MNRDSFYPAIACFPLLLMLAGCAPMHETRQALSQQTPAAQVDTALPTALKMVGQTXQWWLEYHDNQLTSLINNALQNAPDMQVAEQRIQLAEAQAKAVATQDGPQIDFSADMERQKMSAEGLMGPFALNDPAAGTTGPWYTNGTFGLTAGWHLDIWGKNRAEVTARLGTVKARAAEREQTRQLLAGSVARLYWEWQTQAALNTVLQQIEKEQNTIIATDRQLYQNGITSSVEGVETDINASKTRQQLNDVAGKMKIIEARLSALTNNQTKSLKLKPVALPKVASQLPDELGYSLLARRADLQAAHWYVESSLSTIDAAKAAFYPDINLMAFLQQDALHLSDLFRHSAQQMGVTAGLTLPIFDSGRLNANLDIAKAESNLSIASYNKAVVEAVNDVARAASQVQTLAEKNQHQAQIERDALRVVGLAQARFNAGIIAGSRVSEARIPALRERANGLLLQGQWLDASIQLTGALGGGYKR

SEQ ID NO: 7221 - protein, 524 aa, Escherichia coli
  strain K12
MLSTLRRTLFALLACASFIVHAAAPDEITTAWPVNVGPLNPHLYTPNQMFAQSMVYEPLVKYQADGSVIPWLAKSWTHSEDGKTWTFTLRDDVKFSNGEPFDAEAAAENFRAVLDNRQRHAWLELANQIVDVKALSKTELQITLKSAYYPFLQELALPRPFRFIAPSQFKNHETMNGIKAPIGTGPWILQESKLNQYDVFVRNENYWGEKPAIKKITFNVIPDPTTRAVAFETGDIDLLYGNEGLLPLDTFARFSQNPAYHTQLSQPIETVMLALNTAKAPTNELAVREALNYAVNKKSLIDNALYGTQQVADTLFAPSVPYANLGLKPSQYDPQKAKALLEKAGWTLPAGKDIREKNGQPLRIELSFIGTDALSKSMAEIIQADMRQIGADVSLIGEEESSIYARQRDGRFGMIFHRTWGAPYDPHAFLSSMRVPSHADFQAQQGLADKPLIDKEIGEVLATHDETQRQALYRDILTRLHDEAVYLPISYISMMVVSKPELGNIPYAPIATEIPFEQIKPVKP

SEQ ID NO: 7222 - protein, 863 aa, Escherichia coli
  strain K12
MHQSGSVSLCRSAISVLVATALYSPIALASTVEYGETVDGVVLEKDIQLVYGTANNTKINPGGEQHIKEFGVSNNTEINGGYQYIEMNGAAEYSVLNDGYQIVQMGGAANQTTLNNGVLQVYGAANDTTIKGGRLIVEKDGGAVFVAIEKGGLLEVKEGGFAFAVDQKAGGAIKTTTRAMEVFGTNRLGQFDIKNGIANNMLLENGGSLRVEENDFAYNTTVDSGGLLEVMDGGTVTGVDKKAGGKLIVSTNALEVSGPNSKGQFSIKDGVSKNYELDDGSGLIVMEDTQAIDTILDKHATMQSLGKDTGTKVQANAVYDLGRSYQNGSITYSSKAISENMVINNGRANVWAGTMVNVSVRGNDGILEVMKPQINYAPAMLVGKVVVSEGASFRTHGAVDTSKADVSLENSVWTIIADITTTNQNTLLNLANLAMSDANVIMMDEPVTRSSVTASAENFITLTTNTLSGNGNFYMRTDMANHQSDQLNVTGQATGDFKIFVTDTGASPAAGDSLTLVTTGGGDAAFTLGNAGGVVDIGTYEYTLLDNGNHSWSLAENRAQITPSTTDVLNMAAAQPLVFDAELDTVRERLGSVKGVSYDTAMWSSAINTRNNVTTDAGAGFEQTLTGLTLGIDSRFSREESSTIRGLIFGYSHSDIGFDRGGKGNIDSYTLGAYAGWEHQNGAYVDGVVKVDRFANTIHGKMSNGATAFGDYNSNGAGAHVESGFRWVDGLWSVRPYLAFTGFTTDGQDYTLSNGMRADVGNTRILRAEAGTAVSYHMDLQNGTTLEPWLKAAVRQEYADSNQVKVNDDGKFNNDVAGTSGVYQAGIRSSFTPTLSGHLSVSYGNGAGVESPWNTQAGVVWTF

SEQ ID NO: 7223 - protein, 828 aa, Escherichia coli; identical to SEQ ID NO: 6366
  strain K12

SEQ ID NO: 7224 - protein, 315 aa, Escherichia coli
  strain K12
MQTKLLAIMLAAPVVFSSQEASASDFFGPEKISTEINLGTLSGKTKERVYEPEEGGRKVSQLDWKYSNAAILKGAVNWELNPWLSVGAAGWTTLNSRGGNMVDQDWMDSGTPGTWTDESRHPDTRLNYANEFDLNVKGWFLKESDYRLAIMAGYQESRYSFNATGGTYIYSENGGFRNETGALPDKIKVIGYKQHFKIPYVGLTGNYRYDNFEFGGAFKYSGWVRGSDNDEHYVRQTTFRSKVINQNYYSVAVNAGYYITPEAKVYIEGVWSRLTNKKGDTSLYDRSDNTSEHNNNGAGIENYNFITTAGLKYTF

SEQ ID NO: 7225 - protein, 412 aa, Escherichia coli; identical to SEQ ID NO: 6390
  strain K12

SEQ ID NO: 7226 - protein, 289 aa, Escherichia coli
  strain K12
MSTFKPLKTLTSRRQVLKAGLAALTLSGMSQAIAKDELLKTSNGHSKPKAKKSGGKRVVVLDPGHGGIDTGAIGRNGSKEKHVVLAIAKNVRSILRNHGIDARLTRSGDTFIPLYDRVEIAHKHGADLFMSIHADGFTNPKAAGASVFALSNRGASSAMAKYLSERENRADEVAGKKATDKDHLLQQVLFDLVQTDTIKNSLTLGSHILKKIKPVHKLHSRNTEQAAFVVLKSPSVPSVLVETSFITNPEEERLLGTAAFRQKIATAIAEGVISYFHWFDNQKAHSKKR

SEQ ID NO: 7227 - protein, 102 aa, Escherichia coli; identical to SEQ ID NO: 6385
  strain K12

SEQ ID NO: 7228 - protein, 516 aa, Escherichia coli
  strain K12
MQRRDFLKYSVALGVASALPLWSRAVFAAERPTLPIPDLLTTDARNRIQLTIGAGQSTFGGKTATTWGYNGNLLGPAVKLQRGKAVTVDIYNQLTEETTLHWHGLEVPGEVDGGPQGIIPPGGKRSVTLNVDQPAATCWFHPHQHGKTGRQVAMGLAGLVVIEDDEILKLMLPKQWGIDDVPVIVQDKKFSADGQIDYQLDVMTAAVGWFGDTLLTNGAIYPQHAAPRGWLRLRLLNGCNARSLNFATSDNRPLYVIASDGGLLPEPVKVSELPVLMGERFEVLVEVNDNKPFDLVTLPVSQMGMAIAPFDKPHPVMRIQPIAISASGALPDTLSSLPALPSLEGLTVRKLQLSMDPMLDMMGMQMLMEKYGDQAMAGMDHSQMMGHMGHGNMNHMNHGGKFDFHHANKINGQAFDMNKPMFAAAKGQYERWVISGVGDMMLHPFHIHGTQFRILSENGKPPAAHRAGWKDTVKVEGNVSEVLVKFNHDAPKEHAYMAHCHLLEHEDTGMMLGFTV

SEQ ID NO: 7229 - protein, 186 aa, Escherichia coli
  strain K12
MNVSKYVAIFSFVFIQLISVGKVFANADEWMTTFRENIAQTWQQPEHYDLYIPAITWHARFAYDKEKTDRYNERPWGGGFGLSRWDEKGNWHGLYAMAFKDSWNKWEPIAGYGWESTWRPLADENFHLGLGFTAGVTARDNWNYIPLPVLLPLASVGYGPVTFQMTYIPGTYNNGNVYFAWMRFQF

SEQ ID NO: 7230 - protein, 266 aa, Escherichia coli; identical to SEQ ID NO: 5772
  strain K12

SEQ ID NO: 7231 - protein, 188 aa, Escherichia coli
  strain K12
MNMTKGALILSLSFLLAACSSIPQNIKGNNQPDIQKSFVAVHNQPGLYVGQQARFGGKVINVINGKTDTLLEISVLPLDSYAKPDIEANYQGRLLARQSGFLDPVNYRNHFVTILGTIQGEQPGFINKVPYNFLEVNMQGIQVWHLREVVNTTYNLWDYGYGAFWPEPGWGAPYYTNAVSQVTPELVK

SEQ ID NO: 7232 - protein, 257 aa, Escherichia coli
  strain K12
MARKWLNLFAGAALSFAVAGNALADEGKITVFAAASLTNAMQDIATQFKKEKGVDVVSSFASSSTLARQIEAGAPADLFISADQKWMDYAVDKKAIDTATRQTLLGNSLVVVAPKASVQKDFTIDSKTNWTSLLNGGRLAVGDPEHVPAGIYAKEALQKLGAWDTLSPKLAPAEDVRGALALVERNEAPLGIVYGSDAVASKGVKVVATFPEDSHKKVEYPVAVVEGHNNATVKAFYDYLKGPQAAEIFKRYGFTIK

SEQ ID NO: 7233 - protein, 330 aa, Escherichia coli
  strain K12
MKIKNILLTLCTSLLLTNVAAHAKEVKIGMAIDDLRLERWQKDRDIFVKKAESLGAKVFVQSANGNEETQMSQIENMINRGVDVLVIIPYNGQVLSNVVKEAKQEGIKVLAYDRMINDADIDFYISFDNEKVGELQAKALVDIVPQGNYFLMGGSPVDNNAKLFRAGQMKVLKPYVDSGKIKVVGDQWVDGWLPENALKIMENALTANNNKIDAVVASNDATAGGAIQALSAQGLSGKVAISGQDADLAGIKRIAAGTQTMTVYKPITLLANTAAEIAVELGNGQEPKADTTLNNGLKDVPSRLLTPIDVNKNNIKDTVIKDGFHKESEL

SEQ ID NO: 7234 - protein, 498 aa, Escherichia coli
  strain K12
MQGTKIRLLAGGLLMMATAGYVQADALQPDPAWQQGTLSNGLQWQVLTTPQRPSDRVEIRLLVNTGSLAESTQQSGYSHAIPRIALTQSGGLDAAQARSLWQQGIDPKRPMPPVIVSYDTTLFNLSLPNNRNDLLKEALSYLANATGKLTITPETINHALQSQDMVATWPADTKEGWWRYRLKGSTLLGHDPADPLKQPVEAEKIKDFYQKWYTPDAMTLLVVGNVDARSVVDQINKTFGELKGKRETPAPVPTLSPLRAEAVSIMTDAVRQDRLSIMWDTPWQPIRESAALLRYWRADLAREALFWHVQQALSASNSKDIGLGFDCRVLYLRAQCAINIESPNDKLNSNLNLVARELAKVRDKGLPEEEFNALVAQKKLELQKLFAAYARADTDILMGQRMRSLQNQVVDIAPEQYQKLRQDFLNSLTVEMLNQDLRQQLSNDMALILLQPKGEPEFNMKALQAVWDQIMAPSTAAATTSVATDDVHPEVTDIPPAQ

SEQ ID NO: 7235 - protein, 368 aa, Escherichia coli
  strain K12
MNVLRSGIVTMLLLAAFSVQAACTWPAWEQFKKDYISQEGRVIDPSDARKITTSEGQSYGMFSALAANDRAAFDNILDWTQNNLAQGSLKERLPAWLWGKKENSKWEVLDSNSASDGDVWMAWSLLEAGRLWKEQRYTDIGSALLKRIAREEVVTVPGLGSMLLPGKVGFAEDNSWRFNPSYLPPTLAQYFTRFGAPWTTLRETNQRLLLETAPKGFSPDWVRYEKDKGWQLKAEKTLISSYDAIRVYMWVGMMPDSDPQKARMLNRFKPMATFTEKNGYPPEKVDVATGKAQGKGPVGFSAAMLPFLQNRDAQAVQRQRVADNFPGSDAYYNYVLTLFGQGWDQHRFRFSTKGELLPDWGQECANSH

SEQ ID NO: 7236 - protein, 328 aa, Escherichia coli
  strain K12
MKLRSVTYALFIAGLAAFSTSSLAAQSLRFGYETSQTDSQHIAAKKFNDLLQERTKGELKLKLFPDSTLGNAQAMISGVRGGTIDMEMSGSNNFAGLSPVMNLLDVPFLFRDTAHAHKTLDGKVGDDLKASLEGKGLKVLAYWENGWRDVTNSRAPVKTPADLKGLKIRTNNSPMNIAAFKVFGANPIPMPFAEVYTGLETRTIDAQEHPINVVWSAKFFEVQKFLSLTHHAYSPLLVVINKAKFDGLSPEFQQALVSSAQEAGNYQRKLVAEDQQKIIDGMKEAGVEVITDLDRKAFSDALGNQVRDMFVKDVPQGADLLKAVDEVQ

SEQ ID NO: 7237 - protein, 246 aa, Escherichia coli
  strain K12
MLINRNIVALFALPFMASATASELSIGAGAAYNESPYRGYNENTKAIPLISYEGDTFYVRQTTLGFILSQSEKNELSLTASWMPLEFDPTDNDDYAMQQLDKRDSTAMAGVAWYHHERWGTVKASAAADVLDNSNGWVGELSVFHKMQIGRLSLTPALGVLYYDENFSDYYYGISESESRRSGLASYSAQDAWVPYVSLTAKYPIGEHVVLMASAGYSELPEEITDSPMIDRNESFTFVTGVSWRF

SEQ ID NO: 7238 - protein, 419 aa, Escherichia coli
  strain K12
MTRAVKPRRFAIRPIIYASVLSAGVLLCAFSAHADERDQLKSIQADIAAKERAVRQKQQQRASLLAQLKKQEEAISEATRKLRETQNTLNQLNKQIDEMNASIAKLEQQKAAQERSLAAQLDAAFRQGEHTGIQLILSGEESQRGQRLQAYFGYLNQARQETIAQLKQTREEVAMQRAELEEKQSEQQTLLYEQRAQQAKLTQALNERKKTLAGLESSIQQGQQQLSELRANESRLRNSIARAEAAAKARAEREAREAQAVRDRQKEATRKGTTYKPTESEKSLMSRTGGLGAPRGQAFWPVRGPTLHRYGEQLQGELRWKGMVIGASEGTEVKAIADGRVILADWLQGYGLVVVVEHGKGDMSLYGYNQSALVSVGSQVRAGQPIALVGSSGGQGRPSLYFEIRRQGQAVNPQPWLGR

SEQ ID NO: 7239 - protein, 457 aa, Escherichia coli
  strain K12
MRIHILGICGTFMGGLAMLARQLGHEVTGSDANVYPPMSTLLEKQGIELIQGYDASQLEPQPDLVIIGNAMTRGNPCVEAVLEKNIPYMSGPQWLHDFVLRDRWVLAVAGTHGKTTTAGMATWILEQCGYKPGFVIGGVPGNFEVSAHLGESDFFVIEADEYDCAFFDKRSKFVHYCPRTLILNNLEFDHADIFDDLKAIQKQFHHLVRIVPGQGRIIWPENDINLKQTMAMGCWSEQELVGEQGHWQAKKLTTDASEWEVLLDGEKVGEVKWSLVGEHNMHNGLMAIAAARHVGVAPADAANALGSFINARRRLELRGEANGVTVYDDFAHHPTAILATLAALRGKVGGTARIIAVLEPRSNTMKMGICKDDLAPSLGRADEVFLLQPAHIPWQVAEVAEACVQPAHWSGDVDTLADMVVKTAQPGDHILVMSNGGFGGIHQKLLDGLAKKAEAAQ

SEQ ID NO: 7240 - protein, 302 aa, Escherichia coli
  strain K12
MQLRKPATAILALALSAGLAQADDAAPAAGSTLDKIAKNGVIVVGHRESSVPFSYYDNQQKVVGYSQDYSNAIVEAVKKKLNKPDLQVKLIPITSQNRIPLLQNGTFDFECGSTTNNVERQKQAAFSDTIFVVGTRLLTKKGGDIKDFANLKDKAVVVTSGTTSEVLLNKLNEEQKMNMRIISAKDHGDSFRTLESGRAVAFMMDDALLAGERAKAKKPDNWEIVGKPQSQEAYGCMLRKDDPQFKKLMDDTIAQVQTSGEAEKWFDKWFKNPIPPKNLNMNFELSDEMKALFKEPNDKALN

SEQ ID NO: 7241 - protein, 342 aa, Escherichia coli
  strain K12
MRVLLFLLLSLFMLPAFSADNLLRWHDAQHFTVQASTPLKAKRAWKLCALYPSLKDSYWLSLNYGMQEAARRYGVDLKVLEAGGYSQLATQQAQIDQCKQWGAEAILLGSSTTSFPDLQKQVASLPVIELVNAIDAPQVKSRVGVPWFQMGYQPGRYLVQWAHGKPLNVLLMPGPDNAGGSKEMVEGFRAAIAGSPVRIVDIALGDNDIEIQRNLLQEMLERHPEIDVVAGTAIAAEAAMGEGRNLKTPLTVVSFYLSHQVYRGLKRGRVIMAASDQMVWQGELAVEQAIRQLQGQSVSDNVSPPILVLTPKNADREHIRRSLSPGGFRPVYFYQHTSAAKK

SEQ ID NO: 7242 - protein, 455 aa, Escherichia coli
  strain K12
MKKQTQLLSALALSVGLTLSASFQAVASIPGQVADQAPLPSLAPMLEKVLPAVVSVRVEGTASQGQKIPEEFKKFFGDDLPDQPAQPFEGLGSGVIINASKGYVLTNNHVINQAQKISIQLNDGREFDAKLIGSDDQSDIALLQIQNPSKLTQIAIADSDKLRVGDFAVAVGNPFGLGQTATSGIVSALGRSGLNLEGLENFIQTDASINRGNSGGALLNLNGELIGINTAILAPGGGSVGIGFAIPSNMARTLAQQLIDFGEIKRGLLGIKGTEMSADIAKAFNLDVQRGAFVSEVLPGSGSAKAGVKAGDIITSLNGKPLNSFAELRSRIATTEPGTKVKLGLLRNGKPLEVEVTLDTSTSSSASAEMITPALEGATLSDGQLKDGGKGIKIDEVVKGSPAAQAGLQKDDVIIGVNRDRVNSIAEMRKVLAAKPAIIALQIVRGNESIYLLMR

SEQ ID NO: 7243 - protein, 464 aa, Escherichia coli
  strain K12
MSRFVPRIIPFYLLLLVAGGTANAQSTFEQKAANPFDNNNDGLPDLGMAPENHDGEKHFAEIVKDFGETSMNDNGLDTGEQAKAFALGKVRDALSQQVNQHVESWLSPWGNASVDVKVDNEGHFTGSRGSWFVPLQDNDRYLTWSQLGLTQQDNGLVSNVGVGQRWARGNWLVGYNTFYDNLLDENLQRAGFGAEAWGEYLRLSANFYQPFAAWHEQTATQEQRMARGYDLTARMRMPFYQHLNTSVSLEQYFGDRVDLFNSGTGYHNPVALSLGLNYTPVPLVTVTAQHKQGESGENQNNLGLNLNYRFGVPLKKQLSAGEVAESQSLRGSRYDNPQRNNLPTLEYRQRKTLTVFLATPPWDLKPGETVPLKLQIRSRYGIRQLIWQGDTQILSLTPGAQANSAEGWTLIMPDWQNGEGASNHWRLSVVVEDNQGQRVSSNEITLTLVEPFDALSNDELRWEP

SEQ ID NO: 7244 - protein, 310 aa, Escherichia coli
  strain K12
MLHKKTLLFAALSAALWGGATQAADAAVVASLKPVGFIASAIADGVTETEVLLPDGASEHDYSLRPSDVKRLQNADLVVWVGPEMEAFMQKPVSKLPGAKQVTIAQLEDVKPLLMKSIHGDDDDHDHAEKSDEDHHHGDFNMHLWLSPEIARATAVAIHGKLVELMPQSRAKLDANLKDFEAQLASTETQVGNELAPLKGKGYFVFHDAYGYFEKQFGLTPLGHFTVNPEIQPGAQRLHEIRTQLVEQKATCVFAEPQFRPAVVESVARGTSVRMGTLDPLGTNIKLGKTSYSEFLSQLANQYASCLKGD

SEQ ID NO: 7245 - protein, 310 aa, Escherichia coli
  strain K12
MRRVNILCSFALLFASHTSLAVTYPLPPEGSRLVGQSFTVTVPDHNTQPLETFAAQYGQGLSNMLEANPGADVFLPKSGSQLTIPQQLILPDTVRKGIVVNVAEMRLYYYPPDSNTVEVFPIGIGQAGRETPRNWVTTVERKQEAPTWTPTPNTRREYAKRGESLPAFVPAGPDNPMGLYAIYIGRLYAIHGTNANFGIGLRVSQGCIRLRNDDIKYLFDNVPVGTRVQIIDQPVKYTTEPDGSNWLEVHEPLSRNRAEYESDRKVPLPVTPSLRAFINGQEVDVNRANAALQRRSGMPVQISSGSRQMF

SEQ ID NO: 7246 - protein, 1039 aa, Escherichia coli
  strain K12
MKRHLNTCYRLVWNHMTGAFVVASELARARGKRGGVAVALSLAAVTSLPVLAADIVVHPGETVNGGTLANHDNQIVFGTTNGMTISTGLEYGPDNEANTGGQWVQDGGTANKTTVTSGGLQRVNPGGSVSDTVISAGGGQSLQGRAVNTTLNGGEQWMHEGAIATGTVINDKGWQVVKPGTVATDTVVNTGAEGGPDAENGDTGQFVRGDAVRTTINKNGRQIVRAEGTANTTVVYAGGDQTVHGHALDTTLNGGYQYVHNGGTASDTVVNSDGWQIVKNGGVAGNTTVNQKGRLQVDAGGTATNVTLKQGGALVTSTAATVTGINRLGAFSVVEGKADNVVLENGGRLDVLTGHTATNTRVDDGGTLDVRNGGTATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGSLTGNGSVEKSGSGTLTVSNTTLTQKAVNLNEGTLTLNDSTVTTDVIAQRGTALKLTGSTVLNGAIDPTNVTLASGATWNIPDNATVQSVVDDLSHAGQIHFTSTRTGKFVPATLKVKNLNGQNGTISLRVRPDMAQNNADRLVIDGGRATGKTILNLVNAGNSASGLATSGKGIQVVEAINGATTEEGAFVQGNRLQAGAFNYSLNRDSDESWYLRSENAYRAEVPLYASMLTQAMDYDRIVAGSRSHQTGVNGENNSVRLSIQGGHLGHDNNGGIARGATPESSGSYGFVRLEGDLMRTEVAGMSVTAGVYGAAGHSSVDVKDDDGSRAGTVRDDAGSLGGYLNLVHTSSGLWADIVAQGTRHSMKASSDNNDFRARGWGWLGSLETGLPFSITDNLMLEPQLQYTWQGLSLDDGKDNAGYVKFGHGSAQHVRAGFRLGSHNDMTFGEGTSSRAPLRDSAKHSVSELPVNWWVQPSVIRTFSSRGDMRVGTSTAGSGMTFSPSQNGTSLDLQAGLEARVRENITLGVQAGYAHSVSGSSAEGYNGQATLNVTF

SEQ ID NO: 7247 - protein, 184 aa, Escherichia coli
  strain K12
MTLRKILALTCLLLPMMASAHQFETGQRVPPIGITDRGELVLDKDQFSYKTWNSAQLVGKVRVLQHIAGRTSAKEKNATLIEAIKSAKLPHDRYQTTTIVNTDDAIPGSGMFVRSSLESNKKLYPWSQFIVDSNGVALGAWQLDEESSAVVVLDKDGRVQWAKDGALTPEEVQQVMDLLQKLLK

SEQ ID NO: 7248 - protein, 311 aa, Escherichia coli
  strain K12
MNKYLKYFSGTLVGLMLSTSAFAAAEYAVVLKTLSNPFWVDMKKGIEDEAKTLGVSVDIFASPSEGDFQSQLQLFEDLSNKNYKGIAFAPLSSVNLVMPVARAWKKGIYLVNLDEKIDMDNLKKAGGNVEAFVTTDNVAVGAKGASFIIDKLGAEGGEVAIIEGKAGNASGEARRNGATEAFKKASQIKLVASQPADWDRIKALDVATNVLQRNPNIKAIYCANDTMAMGVAQAVANAGKTGKVLVVGTDGIPEARKMVEAGQMTATVAQNPADIGATGLKLMVDAEKSGKVIPLDKAPEFKLVDSILVTQ

SEQ ID NO: 7249 - protein, 318 aa, Escherichia coli
  strain K12
MWKRLLIVSAVSAAMSSMALAAPLTVGFSQVGSESGWRAAETNVAKSEAEKRGITLKIADGQQKQENQIKAVRSFVAQGVDAIFIAPVVATGWEPVLKEAKDAEIPVFLLDRSIDVKDKSLYMTTVTADNILEGKLIGDWLVKEVNGKPCNVVELQGTVGASVAIDRKKGFAEAIKNAPNIKIIRSQSGDFTRSKGKEVMESFIKAENNGKNICMVYAHNDDMVIGAIQAIKEAGLKPGKDILTGSIDGVPDIYKAMMDGEANASVELTPNMAGPAFDALEKYKKDGTMPEKLTLTKSTLYLPDTAKEELEKKKNMGY

SEQ ID NO: 7250 - protein, 326 aa, Escherichia coli
  strain K12
MNAIISPDYYYVLTVAGQSNAMAYGEGLPLPDREDAPHPRIKQLARFAHTHPGGPPCHFNDIIPLTHCPHDVQDMQGYHHPLATNHQTQYGTVGQALHIARKLLPFIPDNAGILIVPCCRGGSAFTAGSEGTYSERHGASHDACRWGTDTPLYQDLVSRTRAALAKNPQNKFLGACWMQGEFDLMTSDYASHPQHFNHMVEAFRRDLKQYHSQLNNITDAPWFCGDTTWYWKENFPHSYEAIYGNYQNNVLANIIFVDFQQQGERGLTNAPDEDPDDLSTGYYGSAYRSPENWTTALRSSHFSTAARRGIISDRFVEAILQFWRER

SEQ ID NO: 7251 - protein, 368 aa, Escherichia coli; identical to SEQ ID NO: 6380
  strain K12

SEQ ID NO: 7252 - protein, 551 aa, Escherichia coli; identical to SEQ ID NO: 6971
  strain K12

SEQ ID NO: 7253 - protein, 236 aa, Escherichia coli
  strain K12
MVKKAIVTAMAVISLFTLMGCNNRAEVDTLSPAQAAELKPMPQSWRGVLPCADCEGIETSLFLEKDGTWVMNERYLGAREEPSSFASYGTWARTADKLVLTDSKGEKSYYRAKGDALEMLDREGNPIESQFNYTLEAAQSSLPMTPMTLRGMYFYMADAATFTDCATGKRFMVANNAELERSYLAARGHSEKPVLLSVEGHFTLEGNPDTGAPTKVLAPDTAGKFYPNQDCSSLGQ

SEQ ID NO: 7254 - protein, 236 aa, Escherichia coli; identical to SEQ ID NO: 6409
  strain K12

SEQ ID NO: 7255 - protein, 361 aa, Escherichia coli
  strain K12
MFKRRYVTLLPLFVLLAACSSKPKPTETDTTTGTPSGGFLLEPQHNVMQMGGDFANNPNAQQFIDKMVNKHGFDRQQLQEILSQAKRLDSVLRLMDNQAPTTSVKPPSGPNGAWLRYRKKFITPDNVQNGVVFWNQYEDALNRAWQVYGVPPEIIVGIIGVETRWGRVMGKTRILDALATLSFNYPRRAEYFSGELETFLLMARDEQDDPLNLKGSFAGAMGYGQFMPSSYKQYAVDFSGDGHINLWDPVDAIGSVANYFKAHGWVKGDQVAVMANGQAPGLPNGFKTKYSISQLAAAGLTPQQPLGNHQQASLLRLDVGTGYQYWYGLPNFYTITRYNHSTHYAMAVWQLGQAVALARVQ

SEQ ID NO: 7256 - protein, 242 aa, Escherichia coli
  strain K12
MRKNNTAIIFGSLFFSCSVMAANGTLAPTVVPMVNGGQASIAISNTSPNLFTVPGDRIIAVNSLDGALTNNEQTASGGVVVATVNKKPFTFILETERGLNLSIQAVPREGAGRTIQLVSDLRGTGEEAGAWETSTPYESLLVTISQAVRGGKLPAGWYQVPVTKETLQAPAGLSSVADAVWTGNHLKMVRFAVENKTLSALNIRESDFWQPGTRAVMFSQPASQLLAGARMDVYVIRDGEGN

SEQ ID NO: 7257 - protein, 171 aa, Escherichia coli
  strain K12
MKQTSFFIPLLGTLLLYGCAGTSTEFECNATTSDTCMTMEQANEKAKKLERSSEAKPVAASLPRLAEGNFRTMPVQTVTATTPSGSRPAVTAHPEQKLLAPRPLFTAAREVKTVVPVSSVTPVTPPRPLRTGEQTAALWIAPYIDNQDVYHQPSSVFFVIKPSAWGKPRIN

SEQ ID NO: 7258 - protein, 231 aa, Escherichia coli; identical to SEQ ID NO: 6400
  strain K12

SEQ ID NO: 7259 - protein, 838 aa, Escherichia coli; identical to SEQ ID NO: 6399
  strain K12

SEQ ID NO: 7260 - protein, 793 aa, Escherichia coli; identical to SEQ ID NO: 6397
  strain K12

SEQ ID NO: 7261 - protein, 678 aa, Escherichia coli; identical to SEQ ID NO: 6398
  strain K12

SEQ ID NO: 7262 - protein, 270 aa, Escherichia coli
  strain K12
MKSLFKVTLLATTMAVALHAPITFAAEAAKPATAADSKAAFKNDDQKSAYALGASLGRYMENSLKEQEKLGIKLDKDQLIAGVQDAFADKSKLSDQEIEQTLQAFEARVKSSAQAKMEKDAADNEAKGKEYREKFAKEKGVKTSSTGLVYQVVEAGKGEAPKDSDTVVVNYKGTLIDGKEFDNSYTRGEPLSFRLDGVIPGWTEGLKNIKKGGKIKLVIPPELAYGKAGVPGIPPNSTLVFDVELLDVKPAPKADAKPEADAKAADSAKK

SEQ ID NO: 7263 - protein, 200 aa, Escherichia coli; identical to SEQ ID NO: 6363
  strain K12

SEQ ID NO: 7264 - protein, 650 aa, Escherichia coli; identical to SEQ ID NO: 6393
  strain K12

SEQ ID NO: 7265 - protein, 341 aa, Escherichia coli
  strain K12
  MOD_RES (23)..(23): Any amino acid
MKKMMIATLAAASVLLAVANQAXAGATLDAVQKKGFVQCGISDGLPGFSYADADGKFSGIDVDICRGVAAAVFGDDTKVKYTPLTAKERFTALQSGEVDLLSRNTTWTSSRDAGMGMAFTGVTYYDGIGFLTHDKAGLKSAKELDGATVCIQAGTDTELNVADYFKANNMKYTPVTFDRSDESAKALESGRCDTLASDQSQLYALRIKLSNPAEWIVLPEVISKEPLGPVVRRGDDEWFSIVRWTLFAMLNAEEMGINSQNVDEKAANPATPDMAHLLGKEGDYGKDLKLDNKWAYNIIKQVGNYSEIFERNVGSESPLKIKRGQNNLWNNGGIQYAPPVR

SEQ ID NO: 7266 - protein, 427 aa, Escherichia coli
  strain K12
MNTFSVSRLALALAFGVTLTACSSTPPDQRPSDQTAPGTSSRPILSAKEAQNFDAQHYFASLTPGAAAWNPSPITLPAQPDFVVGPAGTQGVTHTTIQAAVDAAIIKRTNKRQYIAVMPGEYQGTVYVPAAPGGITLYGTGEKPIDVKIGLSLDGGMSPADWRHDVNPRGKYMPGKPAWYMYDSCQSKRSDSIGVLCSAVFWSQNNGLQLQNLTIENTLGDSVDAGNHPAVALRTDGDQVQINNVNILGRQNTFFVTNSGVQNRLETNRQPRTLVTNSYIEGDVDIVSGRGAVVFDNTEFRVVNSRTQQEAYVFAPATLSNIYYGFLAVNSRFNAFGDGVAQLGRSLDVDANTNGQVVIRDSAINEGFNTAKPWADAVISNRPFAGNTGSVDDNDEIQRNLNDTNYNRMWEYNNRGVGSKVVAEAKK

SEQ ID NO: 7267 - protein, 757 aa, Escherichia coli
  strain K12
MGSPSLYSARKTTLALAVALSFAWQAPVFAHGGEAHMVPMDKTLKEFGADVQWDDYAQLFTLIKDGAYVKVKPGAQTAIVNGQPLALQVPVVMKDNKAWVSDTFINDVFQSGLDQTFQVEKRPHPLNALTADEIKQAVEIVKASADFKPNTRFTEISLLPPDKEAVWAFALENKPVDQPRKADVIMLDGKHIIEAVVDLQNNKLLSWQPIKDAHGMVLLDDFASVQNIINNSEEFAAAVKKRGITDAKKVITTPLTVGYFDGKDGLKQDARLLKVISYLDVGDGNYWAHPIENLVAVVDLEQKKIVKIEEGPVVPVPMTARPFDGRDRVAPAVKPMQIIEPEGKNYTITGDMIHWRNWDFHLSMNSRVGPMISTVTYNDNGTKRKVMYEGSLGGMIVPYGDPDIGWYFKAYLDSGDYGMGTLTSPIARGKDAPSNAVLLNETIADYTGVPMEIPRAIAVFERYAGPEYKHQEMGQPNVSTERRELVVRWISTVGNYDYIFDWIFHENGTIGIDAGATGIEAVKGVKAKTMHDETAKDDTRYGTLIDHNIVGTTHQHIYNFRLDLDVDGENNSLVAMDPVVKPNTAGGPRTSTMQVNQYNIGNEQDAAQKFDPGTIRLLSNPNKENRMGNPVSYQIIPYAGGTHPVAKGAQFAPDEWIYHRLSFMDKQLWVTRYHPGERFPEGKYPNRSTHDTGLGQYSKDNESLDNTDAVVWMTTGTTHVARAEEWPIMPTEWVHTLLKPWNFFDETPTLGALKKDK

SEQ ID NO: 7268 - protein, 809 aa, Escherichia coli
  strain K12
MTLTRREFIKHSGIAAGALVVTSAAPLPAWAEEKGGKILTAGRWGAMNVEVKDGKIVSSTGALAKTIPNSLQSTAADQVHTTARIQHPMVRKSYLDNPLQPAKGRGEDTYVQVSWEQALKLIHEQHDRIRKANGPSAIFAGSYGWRSSGVLHKAQTLLQRYMNLAGGYSGHSGDYSTGAAQVIMPHVVGSVEVYEQQTSWPLILENSQVVVLWGMNPLNTLKIAWSSTDEQGLEYFHQLKKSGKPVIAIDPIRSETIEFFDDNATWIAPNMGTDVALMLGIAHTLMTQGKHDKVFLEKYTTGYPQFEEYLTGKSDNTPKSAVWAAEITGVPEAQIVKLAELMAANRTMLMAGWGIQRQQYGEQKHWMLVTLAAMLGQIGTPGGGFGFSYHYSNGGNPTRVGGVLPEMSAAIAGHASEAADDGGMTAIPVARIVDALENPGGKYQHNGKEQTYPNIKMIWWAGGGNFTHHQDTNRLIKAWQKPEMIVVSECYWTAAAKHADIVLPITTSFERNDLTMTGDYSNQHIVPMKQAVAPQFEARNDFDVFADLAELLKPGGKEIYTEGKDEMAWLKFFYDAAQKGARAQRVTMPMFNAFWQQNKLIEMRHSEKNEQYVRYGDFRADPVKNALGTPSGKIEIYSKTLEKFGYKDCPAHPTWLAPDEWKGTADEKQLQLLTAHPAHRLHSQLNYAELRKKYAIADREPITIHTEDAARFGIANGDLVRVWNKRGQILTGAVVTDGIKKGVVCVHEGAWPDLENGLCKNGSANVLTADIPSSQLANACAGNSALVYIEKYTGNAPKLTAFDQPAVQA

SEQ ID NO: 7269 - protein, 110 aa, Escherichia coli
  strain K12
MNTLLLLAALSSQITFNTTQQGDVYTIIPEVTLTQSCLCRVQILSLREGSSGQSQTKQEKTLSLPANQPIALTKLSLNISPDDRVKIVVTVSDGQSLHLSQQWPPSSEKS

SEQ ID NO: 7270 - protein, 1526 aa, Escherichia coli
  strain K12
MNRTSPYYCRRSVLSLLISALIYAPPGMAAFTTNVIGVVNDETVDGNQKVDERGTTNNTHIINHGQQNVHGGVSNGSLIESGGYQDIGSHNNFVGQANNTTINGGRQSIHDGGISTGTTIESGNQDVYKGGISNGTTIKGGASRVEGGSANGILIDGGSQIVKVQGHADGTTINKSGSQDVVQGSLATNTTINGGRQYVEQSTVETTTIKNGGEQRVYESRALDTTIEGGTQSLNSKSTAKNTHIYSGGTQIVDNTSTSDVIEVYSGGVLDVRGGTATNVTQHDGAILKTNTNGTTVSGTNSEGAFSIHNHVADNVLLENGGHLDINAYGSANKTIIKDKGTMSVLTNAKADATRIDNGGVMDVAGNATNTIINGGTQNINNYGIATGTNINSGTQNIKSGGKADTTIISSGSRQVVEKDGTAIGSNISAGGSLIVYTGGIAHGVNQETGSALVANTGAGTDIEGYNKLSHFTITGGEANYVVLENTGELTVVAKTSAKNTTIDTGGKLIVQKEAKTDSTRLNNGGVLEVQDGGEAKHVEQQSGGALIASTTSGTLIEGTNSYGDAFYIRNSEAKNVVLENAGSLTVVTGSRAVDTIINANGKMDVYGKDVGTVLNSAGTQTIYASATSDKANIKGGKQTVYGLATEANIESGEQIVDGGSTEKTHINGGTQTVQNYGKAINTDIVSGLQQIMANGTAEGSIINGGSQVVNEGGLAENSVLNDGGTLDVREKGSATGIQQSSQGALVATTRATRVTGTRADGVAFSIEQGAANNILLANGGVLTVESDTSSDKTQVNMGGREIVKTKATATGTTLTGGEQIVEGVANETTINDGGIQTVSANGEAIKTKINEGGTLTVNDNGKATDIVQNSGAALQTSTANGIEISGTHQYGTFSISGNLATNMLLENGGNLLVLAGTEARDSTVGKGGAMQNLGQDSATKVNSGGQYTLGRSKDEFQALARAEDLQVAGGTAIVYAGTLADASVSGATGSLSLMTPRDNVTPVKLEGAVRITDSATLTLGNGVDTTLADLTAASRGSVWLNSNNSCAGTSNCEYRVNSLLLNDGDVYLSAQTAAPATTNGIYNTLTTNELSGSGNFYLHTNVAGSRGDQLVVNNNATGNFKIFVQDTGVSPQSDDAMTLVKTGGGDASFTLGNTGGFVDLGTYEYVLKSDGNSNWNLTNDVKPNPDPIPNPKPDPKPDPKPDPNPKPDPTPDPTPTPVPEKRITPSTAAVLNMAATLPLVFDAELNSIRERLNIMKASPHNNNVWGATYNTRNNVTTDAGAGFEQTLTGMTVGIDSRNDIPEGITTLGAFMGYSHSHIGFDRGGHGSVGSYSLGGYASWEHESGFYLDGVVKLNRFKSNVAGKMSSGGAANGSYHSNGLGGHIETGMRFTDGNWNLTPYASLTGFTADNPEYHLSNGMKSKSVDTRSIYRELGATLSYNMRLGNGMEVEPWLKAAVRKEFVDDNRVKVNSDGNFVNYLSGRRGIYQAGIKASFSSTLSGHLGVGYSHSAGVESPWNAVAGVNWSF

SEQ ID NO: 7271 - protein, 60 aa, Escherichia coli
  strain K12
MRKLKMMLCVMMLPLVVVGCTSKQSVSQCVKPPRPPAWIMQPPPDWQTPLNGIISPSERG

SEQ ID NO: 7272 - protein, 61 aa, Escherichia coli
  strain K12
MRKLKMMLCVMMLPLVVVGCTSKQSVSQCVKPPPPPAWIMQPPPDWQTPLNGIISPSGNDW

SEQ ID NO: 7273 - protein, 203 aa, Escherichia coli; identical to SEQ ID NO: 6414
  strain K12

SEQ ID NO: 7274 - protein, 207 aa, Escherichia coli; identical to SEQ ID NO: 5743
  strain K12

SEQ ID NO: 7275 - protein, 170 aa, Escherichia coli [sequence omitted]

SEQ ID NO: 7276 - protein, 417 aa, Escherichia coli
  strain K12
MSGSNTAISRRRLLQGAGAMWLLSVSQVSLAAVSQVVAVRVWPASSYTRVTVESNRQLKYKQFALSNPERVVVDIEDVNLNSVLKGMAAQIRADDPFIKSARVGQFDPQTVRMVFELKQNVKPQLFALAPVAGFKERLVMDLYPANAQDMQDPLLALLEDYNKGDLEKQVPPAQSGPQPGKAGRDRPIVIMLDPGHGGEDSGAVGKYKTREKDVVLQIARRLRSLIEKEGNMKVYMTRNEDIFIPLQVRVAKAQKQRADLFVSIHADAFTSRQPSGSSVFALSTKGATSTAAKYLAQTQNASDLIGGVSKSGDRYVDHTMFDMVQSLTIADSLKFGKAVLNKLGKINKLHKNQVEQAGFAVLKAPDIPSILVETAFISNVEEERKLKTATFQQEVAESILAGIKAYFADGATLARRG

SEQ ID NO: 7277 - protein, 112 aa, Escherichia coli
  strain K12
MTIKNKMLLGALLLVTSAAWAAPATAGSTNTSGISKYELSSFIADFKHFKPGDTVPEMYRTDEYNIKQWQLRNLPAPDAGTHWTYMGGAYVLISDTDGKIIKAYDGEIFYHR

SEQ ID NO: 7278 - protein, 191 aa, Escherichia coli
  strain K12
MKALSPIAVLISALLLQGCVAAAVVGTAAVGTKAATDPRSVGTQVDDGTLEVRVNSALSKDEQIKKEARINVTAYQGKVLLVGQSPNAELSARAKQIAMGVDGANEVYNEIRQGQPIGLGEASNDTWITTKVRSQLLTSDLVKSSNVKVTTENGEVFLMGLVTEREAKAAADIASRVSGVKRVTTAFTFIK

SEQ ID NO: 7279 - protein, 87 aa, Escherichia coli
  strain K12
MKIKTTVAALSVLSVLSFGAFAADSIDAAQAQNREAIGTVSVSGVASSPMDMREMLNKKAEEKGATAYQITEARSGDTWHATAELYK

SEQ ID NO: 7280 - protein, 85 aa, Escherichia coli
  strain K12
MKTIFTVGAVVLATCLLSGCVNEQKVNQLASNVQTLNAKIARLEQDMKALRPQIYAAKSEANRANTRLDAQDYFDCLRCLRMYAE

SEQ ID NO: 7281 - protein, 134 aa, Escherichia coli
  strain K12
MRALPICLVALMLSGCSMLSRSPVEPVQSTAPQPKAEPAKPKAPRATPVRIYTNAEELVGKPFRDLGEVSGDSCQASNQDSPPSIPTARKRMQINASKMKANAVLLHSCEVTSGTPGCYRQAVCIGSALNITAK

SEQ ID NO: 7282 - protein, 807 aa, Escherichia coli
  strain K12
MYSSSRKRCPKTKWALKLLTAAFLAASPAAKSAVNNAYDALIIEARKGNTQPALSWFALKSALSNNQIADWLQIALWAGQDKQVITVYNRYRHQQLPARGYAAVAVAYRNLQQWQNSLTLWQKALSLEPQNKDYQRGQILTLADAGHYDTALVKLKQLNSGAPDKANLLAEAYIYKLAGRHQDELRAMTESLPENASTQQYPTEYVQALRNNQLAAAIDDANLTPDIRADIHAELVRLSFMPTRSESERYAIADRALAQYAALEILWHDNPDRTAQYQRIQVDHLGALLTRDRYKDVISHYQRLKKTGQIIPPWGQYWVASAYLKDHQPKKAQSIMTELFYHKETIAPDLSDEELADLFYSHLESENYPGALTVTQHTINTSPPFLRLMGTPTSIPNDTWLQGHSFLSTVAKYSNDLPQAEMTARELAYNAPGNQGLRIDYASVLQARGWPRAAENELKKAEVIEPRNINLEVEQAWTALTLQEWQQAAVLTHDVVEREPQDPGVVRLKRAVDVHNLAELRIAGSTGIDAEGPDSGKHDVDLTTIVYSPPLKDNWRGFAGFGYADGQFSEGKGIVRDWLAGVEWRSRNIWLEAEYAERVFNHEHKPGARLSGWYDFNDNWRIGSQLERLSHRVPLRAMKNGVTGNSAQAYVRWYQNERRKYGVSWAFTDFSDSNQRHEVSLEGQERIWSSPYLIVDFLPSLYYEQNTEHDTPYYNPIKTFDIVPAFEASHLLWRSYENSWEQIFSAGVGASWQKHYGTDVVTQLGYGQRISWNDVIDAGATLRWEKRPYDGDREHNLYVEFDMTFRF

SEQ ID NO: 7283 - protein, 372 aa, Escherichia coli
  strain K12
MTGDNTLIHSHGINRRDFMKLCAALAATMGLSSKAAAEMAESVTNPQRPPVIWIGAQECTGCTESLLRATHPTVENLVLETISLEYHEVLSAAFGHQVEENKHNALEKYKGQYVLVVDGSIPLKDNGIYCMVAGEPIVDHIRKAAEGAAAIIAIGSCSAWGGVAAAGVNPTGAVSLQEVLPGKTVINIPGCPPNPHNFLATVAHIITYGKPPKLDDKNRPTFAYGRLIHEHCERRPHFDAGRFAKEFGDEGHREGWCLYHLGCKGPETYGNCSTLQFCDVGGVWPVAIGHPCYGCNEEGIGFHKGIHQLANVENQTPRSQKPDVNAKEGGNVSAGAIGLLGGVVGLVAGVSVMAVRELGRQQKKDNADSRGE

SEQ ID NO: 7284 - protein, 78 aa, Escherichia coli
  strain K12
MKATKLVLGAVILGSTLLAGCSSNAKIDQLSSDVQTLNAKVDQLSNDVNAMRSDVQAAKDDAARANQRLDNMATKYRK

SEQ ID NO: 7285 - protein, 238 aa, Escherichia coli
  strain K12
MKKAKILSGVLLLCFSSPLISQAATLDVRGGYRSGSHAYETRLKVSEGWQNGWWASMESNTWNTIHDNKKENAALNDVQVEVNYAIKLDDQWTVRPGMLTHFSSNGTRYGPYVKLSWDATKDLNFGIRYRYDWKAYRQQDLSGDMSRDNVHRWDGYVTYHINSDFTFAWQTTLYSKQNDYRYANHKKWATENAFVLQYHMTPDITPYIEYDYLDRQGVYNGRDNLSENSYRIGVSFKL

SEQ ID NO: 7286 - protein, 78 aa, Escherichia coli
  strain K12
MFKKSVLFATLLSGVMAFSTNADDKIILKHISVSSVSASPTVLEDTIADIARKYNASSWKVTSMRIDNNSTATAVLYK

SEQ ID NO: 7287 - protein, 91 aa, Escherichia coli
  strain K12
MKIISKMLVGALALAVTNVYAAELMTKAEFEKVESQYEKIGDISTSNEMSTADAKEDLIKKADEKGADVLVLTSGQTDNKIHGTANIYKKK

SEQ ID NO: 7288 - protein, 468 aa, Escherichia coli
  strain K12
MRTFSGKRSTLALAIAGVTAMSGFMAMPEARAEGFIDDSTLTGGIYYWQRERDRKDVTDGDKYKTNLSHSTWNANLDFQSGYAADMFGLDIAAFTAIEMAENGDSSHPNEIAFSKSNKAYDEDWSGDKSGISLYKAAAKFKYGPVWARAGYIQPTGQTLLAPHWSFMPGTYQGAEAGANFDYGDAGALSFSYMWTNEYKAPWHLEMDEFYQNDKTTKVDYLHSFGAKYDFKNNFVLEAAFGQAEGYIDQYFAKASYKFDIAGSPLTTSYQFYGTRDKVDDRSVNDLYDGTAWLQALTFGYRAADVVDLRLEGTWVKADGQQGYFLQRMTPTYASSNGRLDIWWDNRSDFNANGEKAVFFGAMYDLKNWNLPGFAIGASYVYAWDAKPATWQSNPDAYYDKNRTIEESAYSLDAVYTIQDGRAKGTMFKLHFTEYDNHSDIPSWGGGYGNIFQDERDVKFMVIAPFTIF

SEQ ID NO: 7289 - protein, 242 aa, Escherichia coli; identical to SEQ ID NO: 6420
  strain K12

SEQ ID NO: 7290 - protein, 815 aa, Escherichia coli; identical to SEQ ID NO: 6927
  strain K12

SEQ ID NO: 7291 - protein, 332 aa, Escherichia coli; identical to SEQ ID NO: 6429
  strain K12

SEQ ID NO: 7292 - protein, 760 aa, Escherichia coli; identical to SEQ ID NO: 6415
  strain K12

SEQ ID NO: 7293 - protein, 512 aa, Escherichia coli
  strain K12
MARAVHRSGLVALGIATALMASCAFAAKDVVVAVGSNFTTLDPYDANDTLSQAVAKSFYQGLFGLDKEMKLKNVLAESYTVSDDGITYTVKLREGIKFQDGTDFNAAAVKANLDRASDPANHLKRYNLYKNIAKTEAIDPTTVKITLKQPFSAFINILAHPATAMISPAALEKYGKEIGFYPVGTGPYELDTWNQTDFVKVKKFAGYWQPGLPKLDSITWRPVADNNTRAAMLQTGEAQFAFPIPYEQATLLEKNKNIELMASPSIMQRYISMNVTQKPFDNPKVREALNYAINRPALVKVAFAGYATPATGVVPPSIAYAQSYKPWPYDPVKARELLKEAGYPNGFSTTLWSSHNHSTAQKVLQFTQQQLAQVGIKAQVTAMDAGQRAAEVEGKGQKESGVRMFYTGWSASTGEADWALSPLFASQNWPPTLFNTAFYSNKQVDDFLAQALKTNDPAEKTRLYKAAQDIIWQESPWIPLVVEKLVSAHSKNLTGFWIMPDTGFSFEDADLQ

SEQ ID NO: 7294 - protein, 276 aa, Escherichia coli
  strain K12
MRRFFWLVAAALLLAGCAGEKGIVEKEGYQLDTRRQAQAAYPRIKVLVIHYTADDFDSSLATLTDKQVSSHYLVPAVPPRYNGKPRIWQLVPEQELAWHAGISAWRGATRLNDTSIGIELENRGWQKSAGVKYFAPFEPAQIQALIPLAKDIIARYHIKPENVVAHADIAPQRKDDPGPLFPWQQLAQQGIGAWPDAQRVNFYLAGRAPHTPVDTASLLELLARYGYDVKPDMTPREQRRVIMAFQMHFRPTLYNGEADAETQAIAEALLEKYGQD

SEQ ID NO: 7295 - protein, 319 aa, Escherichia coli
  strain K12
MRNIIKLALAGLLSVSTFAVAAESSPEALRIGYQKGSIGMVLAKSHQLLEKRYPESKISWVEFPAGPQMLEALNVGSIDLGSTGDIPPIFAQAAGADLVYVGVEPPKPKAEVILVAENSPIKTVADLKGHKVAFQKGSSSHNLLLRALRQAGLKFTDIQPTYLTPADARAAFQQGNVDAWAIWDPYYSAALLQGGVRVLKDGTDLNQTGSFYLAARPYAEKNGAFIQGVLATFSEADALTRSQREQSIALLAKTMGLPAPVIASYLDHRPPTTIKPVNAEVAALQQQTADLFYENRLVPKKVDIRQRIWQPTQLEGKQL

SEQ ID NO: 7296 - protein, 233 aa, Escherichia coli; identical to SEQ ID NO: 6411
  strain K12

SEQ ID NO: 7297 - protein, 866 aa, Escherichia coli; identical to SEQ ID NO: 6410
  strain K12

SEQ ID NO: 7298 - protein, 672 aa, Escherichia coli
  strain K12
MLRNGNKYLLMLVSIIMLTACISQSRTSFIPPQDRESLLAEQPWPHNGFVAISWHNVEDEAADQRFMSVRTSALREQFAWLRENGYQPVSIAQIREAHRGGKPLPEKAVVLTFDDGYQSFYTRVFPILQAFQWPAVWAPVGSWVDTPADKQVKFGDELVDREYFATWQQVREVARSRLVELASHTWNSHYGIQANATGSLLPVYVNRAYFTDHARYETAAEYRERIRLDAVKMTEYLRTKVEVNPHVFVWPYGEANGIAIEELKKLGYDMFFTLESGLANASQLDSIPRVLIANNPSLKEFAQQIITVQEKSPQRIMHIDLDYVYDENLQQMDRNIDVLIQRVKDMQISTVYLQAFADPDGDGLVKEVWFPNRLLPMKADIFSRVAWQLRTRSGVNIYAWMPVLSWDLDPTLTRVKYLPTGEKKAQIHPEQYHRLSPFDDRVRAQVGMLYEDLAGHAAFDGILFHDDALLSDYEDASAPAITAYQQAGFSGSLSEIRQNPEQFKQWARFKSRALTDFTLELSARVKAIRGPHIKTARNIFALPVIQPESEAWFAQNYADFLKSYDWTAIMAMPYLEGVAEKSADQWLIQLTNQIKNIPQAKDKSILELQAQNWQKNGQHQAISSQQLAHWMSLLQLNGVKNYGYYPDNFLHNQPEIDLIRPEFSTAWYPKND

SEQ ID NO: 7299 - protein, 219 aa, Escherichia coli
  strain K12
MLIIKRSVAIIAILFSPLSTASNLTSQLHNFFSAQLAGVSDEVRVSIRTAPNLLPPCEQPLLSMSNNSRLWGNVNVLARCGNDKRYLQVNVQATGNYVVAAMPIARGGKLEAGNVKLKRGRLDTLPPRTVLDINQLVDAISLRDLSPDQPIQLTQFRQAWRVKAGQRVNVIASGDGFSANAEGQALNNAAVAQNARVRMVSGQVVSGVVDADGNILINL

SEQ ID NO: 7300 - protein, 313 aa, Escherichia coli
  strain K12
MISDSKLLASAAWDAQSLNELKAKAGEDPAANIRPVARQVEGMFVQMMLKSMRDALPKDGLFSSEHTRLYTSMYDQQIAQQMTAGKGLGLAEMMVKQMTPEQPLPEESTPAAPMKFPLETVVRYQNQALSQLVQKAVPRNYDDSLPGDSKAFLAQLSLPAQLASQQSGVPHHLILAQAALESGWGQRQIRRENGEPSYNLFGVKASGNWKGPVTEITTTEYENGEAKKVKAKFRVYSSYLEALSDYVGLLTRNPRYAAVTTAASAEQGAQALQDAGYATDPHYARKLTNMIQQMKSISDKVSKTYSMNIDNLF

SEQ ID NO: 7301 - protein, 320 aa, Escherichia coli
  strain K12
MMIKTRFSRWLTFFTFAAAVALALPAKANTWPLPPAGSRLVGENKFHVVENDGGSLEAIAKKYNVGFLALLQANPGVDPYVPRAGSVLTIPLQTLLPDAPREGIVINIAELRLYYYPPGKNSVTVYPIGIGQLGGDTLTPTMVTTVSDKRANPTWTPTANIRARYKAQGIELPAVVPAGLDNPMGHHAIRLAAYGGVYLLHGTNADFGIGMRVSSGCIRLRDDDIKTLFSQVTPGTKVNIINTPIKVSAEPNGARLVEVHQPLSEKIDDDPQLLPITLNSAMQSFKDAAQTDAEVMQHVMDVRSGMPVDVRRHQVSPQTL

SEQ ID NO: 7302 - protein, 133 aa, Escherichia coli
  strain K12
MKIKSIRKAVLLLALLTSTSFAAGKNVNVEFRKGHSSAQYSGEIKGYDYDTYTFYAKKGQKVHVSISNEGADTYLFGPGIDDSVDLSRYSPELDSHGQYSLPASGKYELRVLQTRNDARKNKTKKYNVDIQIK

SEQ ID NO: 7303 - protein, 430 aa, Escherichia coli
  strain K12
MIKSKIVLLSALVSCALISGCKEENKTNVSIEFMHSSVEQERQAVISKLIARFEKENPGITVKQVPVEEDAYNTKVITLSRSGSLPEVIETSHDYAKVMDKEQLIDRKAVATVISNVGEGAFYDGVLRIVRTEDGSAWTGVPVSAWIGGIWYRKDVLAKAGLEEPKNWQQLLDVAQKLNDPANKKYGIALPTAESVLTEQSFSQFALSNQANVFNAEGKITLDTPEMMQALTYYRDLTANTMPGSNDIMEVKDAFMNGTAPMAIYSTYILPAVIKEGDPKNVGFVVPTEKNSAVYGMLTSLTITAGQKTEETEAAEKFVTFMEQADNIADWVMMSPGAALPVNKAVVTTATWKDNDVIKALGELPNQLIGELPNIQVFGAVGDKNFTRMGDVTGSGVVSSMVHNVTVGKADLSTTLQASQKKLDELIEQH

SEQ ID NO: 7304 - protein, 301 aa, Escherichia coli
  strain K12
MKKLLPCTALVMCAGMACAQAEERNDWHFNIGAMYEIENVEGYGEDMDGLAEPSVYFNAANGPWRIALAYYQEGPVDYSAGKRGTWFDRPELEVHYQFLENDDFSFGLTGGFRNYGYHYVDEPGKDTANMQRWKIAPDWDVKLTDDLRFNGWLSMYKFANDLNTTGYADTRVETETGLQYTFNETVALRVNYYLERGFNMDDSRNNGEFSTQEIRAYLPLTLGNHSVTPYTRIGLDRWSNWDWQDDIEREGHDFNRVGLFYGYDFQNGLSVSLEYAFEWQDHDEGDSDKFHYAGVGVNYSF

SEQ ID NO: 7305 - protein, 381 aa, Escherichia coli [sequence omitted]

SEQ ID NO: 7306 - protein, 700 aa, Escherichia coli; identical to SEQ ID NO: 6388
  strain K12

SEQ ID NO: 7307 - protein, 516 aa, Escherichia coli
  strain K12
MKRSISFRPTLLALVLATNFPVAHAAVPKDMLVIGKAADPQTLDPAVTIDNNDWTVTYPSYQRLVQYKTDGDKGSTDVEGDLASSWKASDDQKEWTFTLKDNAKFADGTPVTAEAVKLSFERLLKIGQGPAEAFPKDLKIDAPDEHTVKFTLSQPFAPFLYTLANDGASIINPAVLKEHAADDARGFLAQNTAGSGPFMLKSWQKGQQLVLVPNPHYPGNKPNFKRVSVKIIGESASRRLQLSRGDIDIADALPVDQLNALKQENKVNVAEYPSLRVTYLYLNNSKAPLNQADLRRAISWSTDYQGMVNGILSGNGKQMRGPIPEGMWGYDATAMQYNHDETKAKAEWDKVTSKPTSLTFLYSDNDPNWEPIALATQSSLNKLGIIVKLEKLANATMRDRVGKGDYDIAIGNWSPDFADPYMFMNYWFESDKKGLPGNRSFYENSEVDKLLRNALATTDQTQRTRDYQQAQKIVIDDAAYVYLFQKNYQLAMNKEVKGFVFNPMLEQVFNINTMSK

SEQ ID NO: 7308 - protein, 340 aa, Escherichia coli; identical to SEQ ID NO: 6975
  strain K12

SEQ ID NO: 7309 - protein, 334 aa, Escherichia coli
  strain K12
MKRASLLTLTLIGAFSAIQAAWAVDYPLPPTGSRLVGQNQTYTVQEGDKNLQAIARRFDTAAMLILEANNTIAPVPKPGTTITIPSQLLLPDAPRQGIIVNLAELRLYYYPPGENIVQVYPIGIGLQGLETPVMETRVGQKIPNPTWTPTAGIRQRSLERGIKLPPVVPAGPNNPLGRYALRLAHGNGEYLIHGTSAPDSVGLRVSSGCIRMNAPDIKALFSSVRTGTPVKVINEPVKYSVEPNGMRYVEVHRPLSAEEQQNVQTMPYTLPAGFTQFKDNKAVDQKLVDKALYRRAGYPVSVSSGATPAASNAPSVESAQNGEPEQGNMLRVTQ

SEQ ID NO: 7310 - protein, 397 aa, Escherichia coli
  strain K12
  MOD_RES (222)..(222): Any amino acid
MKRKVLAMLVPALLVAGAANAAEVYNKDGNKLDLYGKVVGLHYFSDDSGSDGDMSYARIGFKGETQIADQFTGYGQWEFNIGANGPESDKGNTATRLAFAGLGFGQNGTFDYGRNYGVVYDVEAWTDMLPEFGGDTYAGADNFMNGRANGVATYRNNGFFGLVDGLNFALQYQGNNESGGPFGQEGSGSGDGRSLSKENGDGFGMSTSYDFDFGLSLGAAYXNSDRSDRQVGVGLNDRNHSNRNAGGETAEAWTVGAKYDANNVYLAAMYAETRNMTPYGGGEFDNGESRSAIANKTQNFEVVAQYQFDFGLRPSIAYLQSKGKDLGGWAHDGNGDPRYTNKDLVKYVDIGATYYFNKNMSTYVDYKINLLDNDDDFYEANGIATDDIVAVGLVYQF

SEQ ID NO: 7311 - protein, 137 aa, Escherichia coli
  strain K12
MLKRYLVLSVATAAFSLPSLVNAAQQNILSVHILNQQTGKPAADVTVTLEKKADNGWLQLNTAKTDKDGRIKALWPEQTATTGDYRVVFKTGDYFKKQNLESFFPEIPVEFHINKVNEHYHVPLLLSQYGYSTYRGS

SEQ ID NO: 7312 - protein, 334 aa, Escherichia coli
  strain K12
MKKNQFLKESDVTAESVFFMKRRQVLKALGISATALSLPHAAHADLLSWFKGNDRPPAPAGKALEFSKPAAWQNNLPLTPADKVSGYNNFYEFGLDKADPAANAGSLKTDPWTLKISGEVAKPLTLDHDDLTRRFPLEERIYRMRCVEAWSMVVPWIGFPLHKLLALAEPTSNAKYVAFETIYAPEQMPGQQDRFIGGGLKYPYVEGLRLDEAMHPLTLMTVGVYGKALPPQNGAPVRLIVPWKYGFKGIKSIVSIKLTRERPPTTWNLAAPDEYGFYANVNPYVDHPRWSQATERFIGSGGILDVQRQPTLLFNGYAAQVASLYRGLDLRENF

SEQ ID NO: 7313 - protein, 216 aa, Escherichia coli
  strain K12
MAIRLYKLAVALGVFIVSAPAFSHGHHSHGKPLTEVEQKAANGVFDDANVQNRTLSDWDGVWQSVYPLLQSGKLDPVFQKKADADKTKTFAEIKDYYHKGYATDIEMIGIEDGIVEFHRNNETTSCKYDYDGYKILTYKSGKKGVRYLFECKDPESKAPKYIQFSDHIIAPRKSSHFHIFMGNDSQQSLLNEMENWPTYYPYQLSSEEVVEEMMSH

SEQ ID NO: 7314 - protein, 251 aa, Escherichia coli
  strain K12
MKLRLSALALGTTLLVGCASSGTDQQGRSDPLEGFNRTMYNFNFNVLDPYIVRPVAVAWRDYVPQPARNGLSNFTGNLEEPAVMVNYFLQGDPYQGMVHFTRFFLNTILGMGGFIDVAGMANPKLQRTEPHRFGSTLGHYGVGYGPYVQLPFYGSFTLRDDGGDMADGFYPVLSWLTWPMSVGKWTLEGIETRAQLLDSDGLLRQSSDPYIMVREAYFQRHDFIANGGELKPQENPNAQAIQDDLKDIDSE

SEQ ID NO: 7315 - protein, 821 aa, Escherichia coli; identical to SEQ ID NO: 6408
  strain K12

SEQ ID NO: 7316 - protein, 230 aa, Escherichia coli
  strain K12
MKKINAIILLSSLTSASVFAGAYVENREAYNLASDQGEVMLRVGYNFDMGAGIMLTNTYNFQREDELKHGYNEIEGWYPLFKPTDKLTIQPGGLINDKSIGSGGAVYLDVNYKFVPWFNLTVRNRYNHNNYSSTDLSGELDNNDTYEIGTYWNFKITDKFSYTFEPHYFMRVNDFNSSNGKDHHWEITNTFRYRINEHWLPYFELRWLDRNVEPYHREQNQIRIGTKYFF

SEQ ID NO: 7317 - protein, 881 aa, Escherichia coli
  strain K12
MPDHSLFRLRILPWCIALAMSGSYSSVWAEDDIQFDSRFLELKGDTKIDLKRFSSQGYVEPGKYNLQVQLNKQPLAEEYDIYWYAGEDDVSKSYACLTPELVAQFGLKEDVAKNLQWSHDGKCLKPGQLEGVEIKADLSQSALVISLPQAYLEYTWPDWDPPSRWDDGISGIIADYSITAQTRHEENGGDDSNEISGNGTVGVNLGPWRMRADWQTNYQHTRSNDDDDEFGGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGGFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSEMVRTGNDKEMYTATYNQNFRDAGVSVYLNYTRHTYWDREEQTNYNIMLSHYFNMGSIRNMSVSLTGYRYEYDNRADKGMYISLSMPWGDNSTVSYNGNYGSGTDSSQVGYFSRVDDATHYQLNIGTSDKHTSVDGYYSHDGSLAQVDLSANYHEGQYTSAGLSLQGGATLTTHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGSVYLAGVKPGEHMSVFWSGVAHCDINLPDPLPADLFNGLLLPCQHKGNVAPVVPDDIKPVIQEQTQQVTPTDPPVSVSANQ

SEQ ID NO: 7318 - protein, 248 aa, Escherichia coli
  strain K12
MLKKILLLALLPAIAFAEELPAPVKAIEKQGITIIKTFDAPGGMKGYLGKYQDMGVTIYLTPDGKHAISGYMYNEKGENLSNTLIEKEIYAPAGREMWQRMEQSHWLLDGKKDAPVIVYVFADPFCPYCKQFWQQARPWVDSGKVQLRTLLVGVIKPESPATAAAILASKDPAKTWQQYEASGGKLKLNVPANVSTEQMKVLSDNEKLMDDLGANVTPAIYYMSKENTLQQAVGLPDQKTLNIIMGNK

SEQ ID NO: 7319 - protein, 457 aa, Escherichia coli
  strain K12
MSPCKLLPFCVALALTGCSLAPDYQRPAMPVPQQFSLSQNGLVNAADNYQNAGWRTFFVDNQVKTLISEALVNNRDLRMATLKVQEARAQYRLTDADRYPQLNGEGSGSWSGNLKGNTATTREFSTGLNASFDLDFFGRLKNMSEAERQNYLATEEAQRAVHILLVSNVAQSYFNQQLAYAQLQIAEETLRNYQQSYAFVEKQLLTGSSNVLALEQARGVIESTRSDIAKRQGELAQANNALQLLLGSYGKLPQAQTVNSDSLQSVKLPAGLSSQILLQRPDIMEAEHALMAANANIGAARAAFFPSISLTSGISTASSDLSSLFNASSGMWNFIPKIEIPIFNAGRNQANLDIAEIRQQQSVVNYEQKIQNAFKEVADALALRQSLNDQISAQQRYLASLQITLQRARALYQHGAVSYLEVLDAERSLFATRQTLLDLNYARQVNEISLYTALGGG

SEQ ID NO: 7320 - protein, 110 aa, Escherichia coli
  strain K12
MKKALQVAMFSLFTVIGFNAQANEHHHETMSEAQPQVISATGVVKGIDLESKKITIHHDPIAAVNWPEMTMRFTITPQTKMSEIKTGDKVAFNFVQQGNLSLLQDIKVSQ

SEQ ID NO: 7321 - protein, 230 aa, Escherichia coli; identical to SEQ ID NO: 6360
  strain K12

SEQ ID NO: 7322 - protein, 327 aa, Escherichia coli
  strain K12
MPTKMRTTRNLLLMATLLGSALFARAAEKEMTIGAIYLDTQGYYAGVRQGVQDAAKDSSVQVQLIETNAQGDISKESTFVDTLVARNVDAIILSAVSENGSSRTVRRASEAGIPVICYNTCINQKGVDKYVSAYLVGDPLEFGKKLGNAAADYFIANKIDQPKIAVINCEAFEVCVQRRKGFEEVLKSRVPGAQIVANQEGTVLDKAISVGEKLIISTPDLNAIMGESGGATLGAVKAVRNQNQAGKIAVFGSDMTTEIAQELENNQVLKAVVDISGKKMGNAVFAQTLKVINKQADGEKVIQVPIDLYTKTEDGKQWLATHVDGLP

SEQ ID NO: 7323 - protein, 303 aa, Escherichia coli
  strain K12
MTEIVADKTVEVVKNAIETADGALDLYNKYLDQVIPWQTFDETIKELSRFKQEYSQAASVLVGDIKTLLMDSQDKYFEATQTVYEWCGVATQLLAAYILLFDEYNEKKASAQKDILIKVLDDGITKLNEAQKSLLVSSQSFNNASGKLLALDSQLTNDFSEKSSYFQSQVDKIRKEAYAGAAAGVVAGPFGLIISYSIAAGVVEGKLIPELKNKLKSVQNFFTTLSNTVKQANKDIDAAKLKLTTEIAAIGEIKTETETTRFYVDYDDLMLSLLKEAAKKMINTCNEYQKRHGKKTLFEVPEV

SEQ ID NO: 7324 - protein, 537 aa, Escherichia coli
  strain K12
MKHSVSVTCCALLVSSISLSYAAEVPSGTVLAEKQELVRHIKDEPASLDPAKAVGLPEIQVIRDLFEGLVNQNEKGEIVPGVATQWKSNDNRIWTFTLRDNAKWADGTPVTAQDFVYSWQRLVDPKTLSPFAWFAALAGINNAQAIIDGKATPDQLGVTAVDAHTLKIQLDKPLPWFVNLTANFAFFPVQKANVESGKEWTKPGNLIGNGAYVLKERVVNEKLVVVPNTHYWDNAKTVLQKVTFLPINQESAATKRYLAGDIDITESFPKNMYQKLLKDIPGQVYTPPQLGTYYYAFNTQKGPTADQRVRLALSMTIDRRLMTEKVLGTGEKPAWHFTPDVTAGFTPEPSPFEQMSQEELNAQAKTLLSAAGYGPQKPLKLTLLYNTSENHQKIAIAVASMWKKNLGVDVKLQNQEWKTYIDSRNTGNFDVIRASWVGDYNEPSTFLTLLTSTHSGNISRFNNPAYDKVLAQASTENTVKARNADYNAAEKILMEQAPIAPIYQYTNGRLIKPWLKGYPINNPEDVAYSRTMYIVKH

SEQ ID NO: 7325 - protein, 183 aa, Escherichia coli
  strain K12
MKTLIVSTVLAFITFSAQAAAFQVTSNEIKTGEQLTTSHVFSGFGCEGGNTSPSLTWSGVPEGTKSFAVTVYDPDAPTGSGWWHWTVVNIPATVTYLPVDAGRRDGTKLPTGAVQGRNDFGYAGFGGACPPKGDKPHHYQFKVWALKTEKIPVDSNSSGALVGYMLNANKIATAEITPVYEIK

SEQ ID NO: 7326 - protein, 867 aa, Escherichia coli; identical to SEQ ID NO: 6359
  strain K12

SEQ ID NO: 7327 - protein, 250 aa, Escherichia coli; identical to SEQ ID NO: 6361
  strain K12

SEQ ID NO: 7328 - protein, 249 aa, Escherichia coli; identical to SEQ ID NO: 6407
  strain K12

SEQ ID NO: 7329 - protein, 377 aa, Escherichia coli
  strain K12
MKSKVLALLIPALLAAGAAHAAEVYNKDGNKLDLYGKVDGLHYFSDNSAKDGDQSYARLGFKGETQINDQLTGYGQWEYNIQANNTESSKNQSWTRLAFAGLKFADYGSFDYGRNYGVMYDIEGWTDMLPEFGGDSYTNADNFMTGRANGVATYRNTDFFGLVNGLNFAVQYQGNNEGASNGQEGTNNGRDVRHENGDGWGLSTTYDLGMGFSAGAAYTSSDRTNDQVNHTAAGGDKADAWTAGLKYDANNIYLATMYSETRNMTPFGDSDYAVANKTQNFEVTAQYQFDFGLRPAVSFLMSKGRDLHAAGGADNPAGVDDKDLVKYADIGATYYFNKNMSTYVDYKINLLDEDDSFYAANGISTDDIVALGLVYQF

SEQ ID NO: 7330 - protein, 161 aa, Escherichia coli
  strain K12
MRKLTALFVASTLALGAANLAHAADTTTAAPADAKPMMHHKGKFGPHQDMMFKDLNLTDAQKQQIREIMKGQRDQMKRPPLEERRAMHDIIASDTFDKVKAEAQIAKMEEQRKANMLAHMETQNKIYNILTPEQKKQFNANFEKRLTERPAAKGKMPATAE

SEQ ID NO: 7331 - protein, 392 aa, Escherichia coli
  strain K12
MQLRKLLLPGLLSVTLLSGCSLFNSEEDVVKMSPLPTVENQFTPTTAWSTSVGSGIGNFYSNLHPALADNVVYAADRAGLVKALNADDGKEIWSVSLAEKDGWFSKEPALLSGGVTVSGGHVYIGSEKAQVYALNTSDGTVAWQTKVAGEALSRPVVSDGLVLIHTSNGQLQALNEADGAVKWTVNLDMPSLSLRGESAPTTAFGAAVVGGDNGRVSAVLMEQGQMIWQQRISQATGSTEIDRLSDVDTTPVVVNGVVFALAYNGNLTALDLRSGQIMWKRELGSVNDFIVDGNRIYLVDQNDRVMALTIDGGVTLWTQSDLLHRLLTSPVLYNGNLVVGDSEGYLHWINVEDGRFVAQQKVDSSGFQTEPVAADGKLLIQAKDGTVYSITR

SEQ ID NO: 7332 - protein, 193 aa, Escherichia coli
  strain K12
MSDTTELVDLAVIFPDLEIELKYACADNITGKAIYQQARCLLHKDAITALAKSISIAQLSGLQLVIYDAYRPQQAQAMLWQACPDPQYVVDVTVGSNHSRGTAIDLTLRDEHGNILDMGAGFDEMHERSHAYHPSVPPAAQRNRLLLNAIMTGGGFVGISSEWWHFELPQAASYPLLADQFSCFISPGTQHVS

SEQ ID NO: 7333 - protein, 435 aa, Escherichia coli
  strain K12
MKRVSQMTALAMALGLACASSWAAELAKPLTLDQLQQQNGKAIDTRPSAFYNGWPQTLNGPSGHELAALNLSASWLDKMSTEQLNAWIKQHNLKTDAPVALYGNDKDVDAVKTRLQKAGLTHISILSDALSEPSRLQKLPHFEQLVYPQWLHDLQQGKEVTAKPAGDWKVIEAAWGAPKLYLISHIPGADYIDTNEVESEPLWNKVSDEQLKAMLAKHGIRHDTTVILYGRDVYAAARVAQIMLYAGVKDVRLLDGGWQTWSDAGLPVERGTPPKVKAEPDFGVKIPAQPQLMLDMEQARGLLHRQDASLVSIRSWPEFIGTTSGYSYIKPKGEIAGARWGHAGSDSTHMEDFHNPDGTMRSADDITAMWKAWNIKPEQQVSFYCGTGWRASETFMYARAMGWKNVSVYDGGWYEWSSDPKNPVATGERGPDSSK

SEQ ID NO: 7334 - protein, 158 aa, Escherichia coli
  strain K12
MRSPKVKFLTIFTFCIFITKMSFASNSCSNEAGTMFRIEPNLIKAIALVESNLKKDSIGKNRDKNNNIKSLDYWLMQINQMHIPLLKKRGIIKDERDLLDNPCLNIKIGTEILYNHFSRCGVTWQCLGTYNAGFAMDNQKKRQQYAPKYILYIPGLMN

SEQ ID NO: 7335 - protein, 288 aa, Escherichia coli
  strain K12
MFWLMLLIISAKMAHSLWRYISFSAEYTAVSQPVNKPSRVDAKTFDKNDVQLISQQNWFGKYQPVAAQVKQPEPVPVAETRLNVVLRGIAFGARPGAVIEEGGKQQVYLQGETLGSHNAVIEEINRDHVMLRYQGKIERLSLAEEERSTVAVTNKKAVSDEAKQAVAEPAVSVPVEIPAAVRQALAKDPQKIFNYIQLTPVRKEGIVGYAAKPGADRSLFDASGFKEGDIAIALNQQDFTDPRAMIALMRQLPSMDSIQLTVLRKGARHDISIALRYRLFCPPYWKKS

SEQ ID NO: 7336 - protein, 535 aa, Escherichia coli
  strain K12
MYTRNLLWLVSLVSAAPLYAADVPANTPLAPQQVFRYNNHSDPGTLDPQKVEENTAAQIVLDLFEGLVWMDGEGQVQPAQAERWEILDGGKRYIFHLRSGLQWSDGQPLTAEDFVLGWQRAVDPKTASPFAGYLAQAHINNAAAIVAGKADVTSLGVKATDDRTLEVTLEQPVPWFTTMLAWPTLFPVPHHVIAKHGDSWSKPENMVYNGAFVLDQWVVNEKITARKNPKYRDAQHTVLQQVEYLALDNSVTGYNRYRAGEVDLTWVPAQQIPAIEKSLPGELRIIPRLNSEYYNFNLEKPPFNDVRVRRALYLTVDRQLIAQKVLGLRTPATTLTPPEVKGFSATTFDELQKPMSERVAMAKALLKQAGYDASHPLRFELFYNKYDLHEKTAIALSSEWKKWLGAQVTLRTMEWKTYLDARRAGDFMLSRQSWDATYNDASSFLNTLKSDSEENVGHWKNAQYDALLNQATQITDATKRNALYQQAEVIINQQAPLIPIYYQPLIKLLKPYVGGFPLHNPQDYVYSKELYIKAH

SEQ ID NO: 7337 - protein, 320 aa, Escherichia coli
  strain K12
MAISSRNTLLAALAFIAFQAQAVNVTVAYQTSAEPAKVAQADNTFAKESGATVDWRKFDSGASIVRALASGDVQIGNLGSSPLAVAASQQVPIEVFLLASKLGNSEALVVKKTISKPEDLIGKRIAVPFISTTHYSLLAALKHWGIKPGQVEIVNLQPPAIIAAWQRGDIDGAYVWAPAVNALEKDGKVLTDSEQVGQWGAPTLDVWVVRKDFAEKHPEVVKAFAKSAIDAQQPYIANPDVWLKQPENISKLARLSGVPEGDVPGLVKGNTYLTPQQQTAELTGPVNKAIIDTAQFLKEQGKVPAVANDYSQYVTSRFVQ

SEQ ID NO: 7338 - protein, 547 aa, Escherichia coli
  strain K12
MRQVLSSLLVIAGLVSGQAIAAPESPPHADIRDSGFVYCVSGQVNTFNPSKASSGLIVDTLAAQFYDRLLDVDPYTYRLMPELAESWEVLDNGATYRFHLRRDVPFQKTDWFTPTRKMNADDVVFTFQRIFDRNNPWHNVNGSNFPYFDSLQFADNVKSVRKLDNHTVEFRLAQPDASFLWHLATHYASVMSAEYARKLEKEDRQEQLDRQPVGTGPYQLSEYRAGQFIRLQRHDDFWRGKPLMPQVVVDLGSGGTGRLSKLLTGECDVLAWPAASQLSILRDDPRLRLTLRPGMNVAYLAFNTAKPPLNNPAVRHALALAINNQRLMQSIYYGTAETAASILPRASWAYDNEAKITEYNPAKSREQLKSLGLENLTLKLWVPTRSQAWNPSPLKTAELIQADMAQVGVKVVIVPVEGRFQEARLMDMSHDLTLSGWATDSNDPDSFFRPLLSCAAIHSQTNLAHWCDPKFDSVLRKALSSQQLAARIEAYDEAQSILAQELPILPLASSLRLQAYRYDIKGLVLSPFGNASFAGVYREKQDEVKKP

SEQ ID NO: 7339 - protein, 421 aa, Escherichia coli
  strain K12
MRKIVAMAVICLTAASGLTSAYAAQLADDEAGLRIRLKNELRRADKPSAGAGRDIYAWVQGGLLDFNSGYYSNIIGVEGGAYYVYKLGARADMSTRWYLDGDKSFGFALGAVKIKPSENSLLKLGRFGTDYSYGSLPYRIPLMAGSSQRTLPTVSEGALGYWALTPNIDLWGMWRSRVFLWTDSTTGIRDEGVYNSQTGKYDKHRARSFLAASWHDDTSRYSLGASVQKDVSNQIQSILEKSIPLDPNYTLKGELLGFYAQLEGLSRNTSQPNETALVSGQLTWNAPWGSVFGSGGYLRHAMNGAVVDTDIGYPFSLSLDRNREGMQSWQLGVNYRLTPQFTLTFAPIVTRGYESSKRDVRIEGTGILGGMNYRVSEGPLQGMNFFLAADKGREKRDGSTLGDRLNYWDVKMSIQYDFMLK

SEQ ID NO: 7340 - protein, 1371 aa, Escherichia coli
  strain K12
MNCQRYFCFVNGIVEIRTAPEEYQNKPVLVGSQSDGLLIIDNHADIEDGIFSTLHIGNGYNGAVDVINGAALHMDNRSGSAPLIVGAFGNDIAGKLNISGRNSIVSYRDTPSSSGHNESIYVGFGPGATGWINIFNGGVFEVLNSTNIYVGSDTPGGGDGSIVIDGSNSKMTADFSEAYVGLYGNGDISLKNGGQLSASNLYIGGNGRAIVNISGTDSRLIANMITISGSSGAPGIYIADQGILNVDNYINITTANDTKGKLFINSDMPGTIESKGILFGVGKAELIFKHNSDNYAFSSPLISKNTGNGIINAESGETHLTGDNTDYSGLLNILPTASIDISSQKNIGKSVIVNNGVLQITSQDDWTFNNNMTGNGYLNVHTGGHNFAFQNSTNTQEFTGTLALSDTLFDLSDDNTTALTSALVLAGVGSVITAGTGTQVINGFSFDGGAVNFGAVTQGAQQTESQIQVTDNLYINGNGAVRVSTPTDVNGIPQVINSSLSLLEQDDSNATIKLVDASSAVVKGNGGNLQLQDASGQVISSGKQRNIVQQGKNVAKGVYDYRLTSGPHNDGLYIGYALTQLDLLASGVDALVLDAAGTTGNAADMSARITGAGDLAFNSQKGETVSLSNQDNDYTGVTAIRGGNVLMNSNSVLGQTSEIRLATDTRLDMNGHSQTVGKLNGAAGSVLNINGGNLTLTDDGVSAGTLTGGGFLNISGGVLDITGGNHTFAVSTIIAKDATVRMNDVSGLGTGNISNAGTLSLTHASGLLSNNLSGSGTVSLINSDTQISGNNSNYSGLFVVDTSSQLTATGAQNLGIASVSNRGILQLNNTTDWQLINNVTGTGNVRKTGSGSLTVRSNAAWSGQTDIDDGSLILGQSDAPVMLASSLVNIAKNGKLTGFGGVVGNVTNSGSLDLRSAAPGNILTIGGNYTGNNGTLLINTVLDDSSSATDKLVIKGDASGKTRVAVTNVGGSGANTLNSIEVIHVDGNAANAEFIQAGRIAAGAYDYTLGRGPGSNYGNWYLSSSKNTPEPRPDPEPTPEGHDNNLRPEASSYTANIAAANTMFVTRLHERLGQTQYVDAITGEPKATSMWMRHEGGHNRWRDGSGQLKTQSNRYVIQLGGDIAQWDWGGTNRWHLGVMAGYGNNHSSTGAVRTGYHSKGSVNGYSTGLYATWYADDETHNGAYLDTWAQYGWFDNHVKGDGLPGESWKSKGLTASLETGYAWKIGEFSSNYGNLNEWYVQPQAQLVWMGVKADELYESNGTLIESTGDGNVHTRLGVKTWIKRLNKMDDGKSREFSPFVEVNWLHNTRDFGVRMNGEPVYQDGTRNIGEVKTGVEGQINPHLNLWGNVRVQVGDKGYNDTSAMLGVKYTF

SEQ ID NO: 7341 - protein, 1758 aa, Escherichia coli
  strain K12
MCFFLGSRLAYAENIDGSSTISNRDISGSLNIGINKDANIDINGTVNIKDYFSVATCNGQSSTCPEGGLNASAKIDKSASVGASVTIVGDSSKGELNIDGGSTLYTQQLWVSGNDNDKTSNVSDDSNGSLSINNGSNVFVVSSQDDTPFKTNSVKWNQNIISQGNNITDGTVSSGDLVLGKTGNGIIDIDNNSKLDVKNDVVVSTGVDGIPNEKPSEINIKNESNFSVHGDMKGGISAAGKLNLNMDNSSNLHVDKNIAVGIGRESNITVSASRESSIFSDGNFTVATGNNSNANLKLDASNLSVNGVSTIGSGDGSITKFDIKNGSVVTSSSDMTLAKGKGTQANINISSSELNTGSLSVGEGDNADVKMTGSGASVSSKKTFTVAKGNNASATLNYTGSKIDIGSGYIGEGESAKTQLELNNSALTASGKVFIGQGNTTQTNLTLNDKSSVNVSGEMSVAQGSSASVDVTATNAVLSADSLSLGGGEAAKVTMTGSGATVSSKNTFTVAKGNNASATLDYTDSKIDIGSGYIGEGEAAKTQLELNNSALTASGKVFIGQGNTTQTNLTLNDKSSVNVSDEMSVAQGSSASVDVTITNAVLSADSLSLGGGEAAKVTMTGNRATISSGNTFTVAKGNNASATLDYSDSKINIGNGYIGGGEKAQTVLTLKDSALAATGDVIMGQGQETQTDLTLSPQSSIKVSGNMSIAQGNAASAKVIVDNADLSANSMSIGEGDTAAVTMTGNGATISSGNTFTVARGNNASATLDYSDSKINIGNGYIGGGEKAQTVLTLKDSALAATGDVIMGQGQETQTDLTLSPQSSIKVSGNMSIAQGNAASAKVIVDNADLSANSMSIGEGDTAAVTMTGNGATISSGNTFTVARGNNASATLDYSDSKINIGNGYIGVGEKSHTLLKLDNSTFHAAGNIDIGKGSSTIANVSVGAGSNMSIKGNASIGVGDQAKAKFSVKDSVLNIGSSLVLGQGNSTEAEMSVEHSQLYSGGLLLGTANNAVVSMSANNSEISVVGDYTVAKGDGSEATLIYKNSDINLGNGILGAGSGVKTDLSLDNSKFVASDGIIIGKGDNAITNLSISDHSVFKGERINIGNGSYSKNSISITGNSIFDFGSSQESTIGEGDYSQSLVTINDASVYGDGSLTLAKGNNSFAVLNLQDNAVTNANNISLATGLGSKAIVNVSNMNSGQFNPVSMGAGDGYAEVNFDGVNGYTLSTNFICMDSGSCADTVINVNRGTVSLSGTNDWKGQINVYDGTRLDARGNDAVDGILNVSKEAQVDFNGYSQHMTGIDNKGMIYLSDGSASSDVYLDKDYVAHDGSGVQFGIFGQKEADVMHVKGDTSGSSGIVVTTNSKNKIKKGGDILLVEVNGDSSGSFYLNSLIKNGKEYKVTGDYIDVGAWEYALNKKRKNWYLSVDMRPEPGAFINNSKSMLDMFALQRYDIPGQHRYPTLFENLYNNGMWIQFNNNSGSNSEVYDNLKTSYSLNTMMIGGDIYNWTDGYNYSHIGIMGGMGSAANKTTSTNNKRATGNVDGYTLGLYHVFQQNISDGLNESERQGLWTYSSIQYMDYDNSVSSTNNFKANYGVNGFRLTGEVGYLKNIGGIQPSDFYVEPKLYLSHTELSGGVVEDLQGGKITYPNSLTIIEPGVFFSYRKTHESTSNDEAMFKDYIKQSVVDAWFGGGYSFKTGNYSRTNFDSDMVEYNTSDNFALKSGVEFEFLKDARLLLTSSYSINNDRNLSFILGGNYYF

SEQ ID NO: 7342 - protein, 826 aa, Escherichia coli
  strain SE11
MLRMTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 7343 - protein, 224 aa, Escherichia coli; identical to SEQ ID NO: 6302
  strain SE11

SEQ ID NO: 7344 - protein, 784 aa, Escherichia coli; identical to SEQ ID NO: 6283
  strain SE11

SEQ ID NO: 7345 - protein, 866 aa, Escherichia coli
  strain SE11
MTIKPTKNYHNHLTRIATFCALLYCNSAFCAELVEYDHTFLMGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 7346 - protein, 246 aa, Escherichia coli; identical to SEQ ID NO: 6342
  strain SE11

SEQ ID NO: 7347 - protein, 747 aa, Escherichia coli; identical to SEQ ID NO: 6486
  strain SE11

SEQ ID NO: 7348 - protein, 266 aa, Escherichia coli; identical to SEQ ID NO: 5772
  strain SE11

SEQ ID NO: 7349 - protein, 810 aa, Escherichia coli; identical to SEQ ID NO: 6345
  strain SE11

SEQ ID NO: 7350 - protein, 161 aa, Escherichia coli; identical to SEQ ID NO: 5769
  strain SE11

SEQ ID NO: 7351 - protein, 351 aa, Escherichia coli
  strain SE11
MKKSTLALVVMGIVASASVQAAEIYNKDGNKLDVYGKVKAMHYMSDNASKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGGEDLVNYIDVGATYYFNKNMSAFVDYKINQLDSDNKLNINNDDIVAIGMTYQF

SEQ ID NO: 7352 - protein, 230 aa, Escherichia coli
  strain SE11
MMTKIKLLMLIIFYLIISASTHAAGGIALGATRIIYPADAQQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 7353 - protein, 869 aa, Escherichia coli
  strain SE11
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMSCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRVNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQATYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 7354 - protein, 365 aa, Escherichia coli
  strain SE11
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRSDFDNYTEGNGDGFGFSATYEYEGFGIGATYAKSDRTDTQVNAGKVLPEVFASGKNAEVWAAGLKYDANNIYLATTYSETQNMTVFADHFVANKAQNFEAVAQYQFDFGLRPSVAYLQSKGKDLGVWGDQDLVKYVDVGATYYFNKNMSTFVDYKINLLDKNDFTKALGVSTDDIVAVGLVYQF

SEQ ID NO: 7355 - protein, 746 aa, Escherichia coli
  strain SE11
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDIDLDDVMLHSEVNLPLDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 7356 - protein, 387 aa, Escherichia coli
  strain SE11
MKRKVLAMLVPALLVAGAANAAEIYNKNGNKLDLYGKVDARHTFSDNPGDDGDETIIELGFKGETQITDQLTGYGQALTKTKASDTEGSDNTYVKLAFAGLKFGEMGSFDYGRNYGVIYDVEAWTDMLPVFGGDSYTWTDNFMAGRANGVATYRNSDFFGLVEGLNFALQYQGNNEGSNAGEDQEGTKNGHEDVRFQNGDGFGLSTSYDFDFGLSLGAAYSNSDRTNSQVALGGYHYNEYSKFAGGDTAEAWTFGAKYDANNVYLAMMYAETRNMTPYGNVGIANKTQNFEAVAQYQFDFGLRPSLAYVYSKGKDLGGNDYNNNGHQEYVDQDLVNYVEIGATYYFNKNFSTYVDYKINLLDKDDDFYDNNGIATDDVVGVGLVYQF

SEQ ID NO: 7357 - protein, 334 aa, Escherichia coli
  strain SE11
MKKKQFLKESDVTAESVFFMKRRQVLKALGISAAALSLPHAAHADLLSWFKGNDRPPAPAGKPLEFSKPAAWQNNLPLTPVDKVSGYNNFYEFGLDKADPAANAGSLKTDPWTLKISGEVAKPLTLDHDDLTRRFPLEERIYRMRCVEAWSMVVPWIGFPLHKLLALAEPTSNAKYVAFETIYAPEQMPGQQDRFIGGGLKYPYVEGLRLDEAMHPLTLMTVGVYGKALPPQNGAPVRLIVPWKYGFKGIKSIVSIKLTRERPPTTWNLAAPDEYGFYANVNPHVDHPRWSQATERFIGSGGILDVQRQPTLLFNGYADQVASLYRGLDLRENF

SEQ ID NO: 7358 - protein, 193 aa, Escherichia coli; identical to SEQ ID NO: 6300
  strain SE11

SEQ ID NO: 7359 - protein, 828 aa, Escherichia coli; identical to SEQ ID NO: 6558
  strain SE11

SEQ ID NO: 7360 - protein, 162 aa, Escherichia coli; identical to SEQ ID NO: 5896
  strain SE11

SEQ ID NO: 7361 - protein, 360 aa, Escherichia coli
  strain SE11
MKKLTVAISAVAASVLIAMSAQAAEIYNKDSNKLDLYGKVNAGHYFSSNDKHDGDKTYARLGFKGETQINDKLTGFGQWEYEFKGNHAESQGSSADKTRLAFAGLKFGDYGSIDYGRNYGVAYDIGAWTNVLPEFGGDTWTQTDVFMTDRTTGVATYRNNDLFGLVDGLNFAAQYQGKNDRTDVTQANGDGFGFSTTYEYEGFGVGATYAKSDRTNNQVIYGNNSLNASGQNAEVWAAGLKYDASNIYLATTYSETQNMTVFGKNHIANKAQNFEVVAQYQFDFGLRPSVAYLQSKGKDLGVFGDQDLVKYVDVGATYYFNKNMSTFVDYKINLLDKNDFTRNLDINADDIVAVGMVYQF

SEQ ID NO: 7362 - protein, 231 aa, Escherichia coli; identical to SEQ ID NO: 6351
  strain SE11

SEQ ID NO: 7363 - protein, 838 aa, Escherichia coli
  strain SE11
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 7364 - protein, 678 aa, Escherichia coli
  strain SE11
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 7365 - protein, 368 aa, Escherichia coli
  strain SE11
MNKTITALAIMMASFAANASVLPETPVPFKSGTGAIDNNTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSATIDKINAHYFDKKAEDYFFNKFLLSFDPSTQQWSYAGESPWYGTAGAALVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVRDNKVTVQN

SEQ ID NO: 7366 - protein, 241 aa, Escherichia coli
  strain SE11
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKRENTLRILDATNNQLPQDRESLFWMNVKAIPSMDKSKLTENTLQLAIISRIKLYYRPAKLALPPDQAAEKLRFRRSANSLTLINPTPYYLTVTELNAGTRILENALVPPMGESTVKLPSDAGSNITYRTINDYGALTPKMTGVME

SEQ ID NO: 7367 - protein, 878 aa, Escherichia coli
  strain SE11
MSYLNLRLYQRNTQCLHIRKHRLAGFFVRLVVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGHRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 7368 - protein, 412 aa, Escherichia coli; identical to SEQ ID NO: 6284
  strain SE11

SEQ ID NO: 7369 - protein, 243 aa, Escherichia coli; identical to SEQ ID NO: 6145
  strain SE11

SEQ ID NO: 7370 - protein, 822 aa, Escherichia coli
  strain SE11
MIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEVAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 7371 - protein, 252 aa, Escherichia coli
  strain SE11
MKLMRYLNTKNLIAAGVLLACMSSIAWGAIIPDRTRIIMNESDKGEALKLTNQSKNLPYLAQTWIEDTKGNKSRDFIVTVPPMVRLNPSEQIQIRMISQEKIAQLPNDRETLFYFNVREIPPKTDKKNVMQVTMQHALKLFWRPKAIELEDDGVMSYEKVEIIRRNDGSIRFNNKMPYHVTLGYIGTNGITMLPQTQSLMVTPYSHADTQFKNVPSAFQVGYINDFGGLSFYEINCPTVNNSCNVSVAKRDK

SEQ ID NO: 7372 - protein, 208 aa, Escherichia coli; identical to SEQ ID NO: 5717
  strain SE11

SEQ ID NO: 7373 - protein, 274 aa, Escherichia coli
  strain SE11
MNKTAIALLALLASSASLAATPWQKITQPVPGSAQSIGSFSNGCIVGADTLPIQSEHYQVMRTDLRRYFGHPDLVMFIQRLSSQVSNLGMGTVLIGDMGMPAGGRFNGGHASHQTGLDVDIFLQLPKTRWTSAQLLRPQALDLVSRDGKHVVPTLWKPEIFSLIKLAAQDKDVTRIFVNPAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 7374 - protein, 250 aa, Escherichia coli; identical to SEQ ID NO: 6317
  strain SE11

SEQ ID NO: 7375 - protein, 880 aa, Escherichia coli
  strain SE11
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNMSVSLTGYRYEYDNRADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 7376 - protein, 472 aa, Escherichia coli
  strain SE11
MSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKDTKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 7377 - protein, 614 aa, Escherichia coli; identical to SEQ ID NO: 6387
  strain SE11

SEQ ID NO: 7378 - protein, 446 aa, Escherichia coli
  strain SE11
MMITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNQKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYNGDSKVNPNYGKAVPADFNGGSFGRGDSDEWTFGAQMEIWW

SEQ ID NO: 7379 - protein, 237 aa, Escherichia coli; identical to SEQ ID NO: 6458
  strain SE11

SEQ ID NO: 7380 - protein, 478 aa, Escherichia coli; identical to SEQ ID NO: 5711
  strain SE11

SEQ ID NO: 7381 - protein, 432 aa, Escherichia coli; identical to SEQ ID NO: 5727
  strain SE11

SEQ ID NO: 7382 - protein, 359 aa, Escherichia coli
  strain SE11
MKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRNFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 7383 - protein, 686 aa, Escherichia coli
  strain SE11
MFWRDITLSVWRKKTTGLKTKKRLLPLVLAAALCSSPVWAEEATFTANFKDTDLKSFIETVGANLNKTIIMGQGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 7384 - protein, 367 aa, Escherichia coli; identical to SEQ ID NO: 5777
  strain SE11

SEQ ID NO: 7385 - protein, 200 aa, Escherichia coli; identical to SEQ ID NO: 6311
  strain SE11

SEQ ID NO: 7386 - protein, 332 aa, Escherichia coli; identical to SEQ ID NO: 6321
  strain SE11

SEQ ID NO: 7387 - protein, 760 aa, Escherichia coli; identical to SEQ ID NO: 6455
  strain SE11

SEQ ID NO: 7388 - protein, 243 aa, Escherichia coli; identical to SEQ ID NO: 6463
  strain SE11

SEQ ID NO: 7389 - protein, 819 aa, Escherichia coli
  strain SE11
MDTVNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGVLMDYNLFASSYRPQDGSSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAIGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLNGVAENQKFTVVWGDSQHCSLHLPEHMEDTANRLILPCH

SEQ ID NO: 7390 - protein, 431 aa, Escherichia coli; identical to SEQ ID NO: 6791
  strain SE11

SEQ ID NO: 7391 - protein, 663 aa, Escherichia coli; identical to SEQ ID NO: 6307
  strain SE11

SEQ ID NO: 7392 - protein, 204 aa, Escherichia coli; identical to SEQ ID NO: 5755
  strain SE11

SEQ ID NO: 7393 - protein, 362 aa, Escherichia coli; identical to SEQ ID NO: 5809
  strain SE11

SEQ ID NO: 7394 - protein, 233 aa, Escherichia coli
  strain SE11
MKTCITKGIVTVSFTAILLSCSSAWAAGKGGIGLAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLGEAPAKLRCTSSADMVTVSNPTPYFITLTDLKIGGKVVKNQMISPFDKYQFSLPKGAKNSSVTYRTINDYGAETPQLNCKS

SEQ ID NO: 7395 - protein, 866 aa, Escherichia coli; identical to SEQ ID NO: 6328
  strain SE11

SEQ ID NO: 7396 - protein, 245 aa, Escherichia coli
  strain SE11
MPARHLYFIMTNTWNRLALLIFAVLSLLVAGELRAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQLSVNGKALSNAGVVPPKSQRQTSWCQAIAPCHVAWRAINDYGGLSAKKEQNLP

SEQ ID NO: 7397 - protein, 511 aa, Escherichia coli; identical to SEQ ID NO: 5749
  strain SE11

SEQ ID NO: 7398 - protein, 191 aa, Escherichia coli; identical to SEQ ID NO: 5748
  strain SE11

SEQ ID NO: 7399 - protein, 232 aa, Escherichia coli; identical to SEQ ID NO: 5747
  strain SE11

SEQ ID NO: 7400 - protein, 366 aa, Escherichia coli
  strain SE11
MVIKFLSALILLLVTTAAQAERIRDLTSVQGVRQNSLIGYGLVVGLDGTGDQTTQTPFTTQTLNNMLSQLGITVPTGTNMQLKNVAAVMVTASLPPFGRQGQTIDVVVSSMGNAKSLRGGTLLMTPLKGVDSQVYALAQGNILVGGAGASAGGSSVQVNQLNGGRITNGAVIERELPSQFGVGNTLNLQLNDEDFSMAQQIADTINRVRGYGSATALDARAIQVRVPSGNSSQVRFLADIQNMQVNVTPQDAKVVINSRTGSVVMNREVTLDSCAVAQGNLSVTVNRQANVSQPDTPFGGGQTVVTPQTQIDLRQSGGSLQSVRSSASLNNVVRALNALGATPMDLMSILQSMQSAGCLRAKLEII

SEQ ID NO: 7401 - protein, 729 aa, Escherichia coli
  strain SE11
MLSTQFNRDNQYQASTKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 7402 - protein, 213 aa, Escherichia coli; identical to SEQ ID NO: 5744
  strain SE11

SEQ ID NO: 7403 - protein, 565 aa, Escherichia coli; identical to SEQ ID NO: 6492
  strain SE11

SEQ ID NO: 7404 - protein, 207 aa, Escherichia coli; identical to SEQ ID NO: 5743
  strain SE11

SEQ ID NO: 7405 - protein, 551 aa, Escherichia coli; identical to SEQ ID NO: 5742
  strain SE11

SEQ ID NO: 7406 - protein, 700 aa, Escherichia coli
  strain SE11
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKQYVGSVIVNESNGRYYEPSPGRNYGVGMNIAWRFE

SEQ ID NO: 7407 - protein, 883 aa, Escherichia coli
  strain SE11
MTAIRAAFKAYRMHQVLIMPRFARLTIALGLATAVFPVDAEYYFNPRFLSNDLAESVDLSAFTKGREAPPGTYRVDIYLNDEFMTSRDITFIADDNNAELIPCLSTDLLVSLGIKKSALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYYSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 7408 - protein, 236 aa, Escherichia coli; identical to SEQ ID NO: 6472
  strain SE11

SEQ ID NO: 7409 - protein, 102 aa, Escherichia coli
  strain SE11
MKKVLGLVVAAAMGLSSAAFAAETATTPAPTATTTKAAPAKTTHHKKQHKAAPAQKAQAAKKHHKNTKAEQKAPEQKAQAAKKHAGKHSHQQPAKPAAQPAA

SEQ ID NO: 7410 - protein, 118 aa, Escherichia coli [sequence omitted]

SEQ ID NO: 7411 - protein, 254 aa, Escherichia coli
  strain SE11
MKYRKLQILNCVALGLIAFTVNAAPSDVTVSGKQYGVILGGSRVIYPLDSNGAVVSVDNPQDYPVLIQTRVFDENKSEAAPFVVTPPLFRLDAKQRSSLRLTQTGGSFSRDKESLQWLCVKGIPPKEDDLWVGDKGKEKSPGSGVGISLQIAIDNCIKIMVRPNELKGNPSQFAGDLVWKIDGQKLVAENLTPFYMNLGKVTFSGKEVLPHFVPPKSKWMFDLPKGTSGQGHVSWQIINDQGGLSQTYSKNVIF

SEQ ID NO: 7412 - protein, 123 aa, Escherichia coli
  strain SE11
MAEMAVLNNVMTTSAKKRKPGLLSRCLAVVNKSTAKALVKYVAAPLALWLAAQGMAQATDLASAGKADVEATFGEDSTMMYYFMIAEVFLVFMIYLRNHNPATFVLIPVFIVVTKVIFSMIAP

SEQ ID NO: 7413 - protein, 812 aa, Escherichia coli
  strain SE11
MKKYVTTKSVQPVAFRLTTLSLVMSAVLGSASVIAGEKLDMSFIQGGGGVNPEVWAALNGSYAPGRYLVDLSLNGKEAGKQILDVTPQDSNELCLTEAWLTKAGIYVSADYFREGYDATRQCYVLTKAPSVKVDFDVSTQSLALSLPQKGLVKMPENVDWDYGASAFRVNYNANANTGRNNTSAFGLADLKANIGHWVVSSSATASGGDSGDNSTTINMFTATRAIRALSADLAVGKTSTGDSLLGSTGTYGVSLSRNNSMKPGNLGYTPVFSGIANGPSRVTLTQNGRLLHSEMVPAGPFSITDVPLYTSGDVTMKITGEDGREQVQNFPLSVMAGQLSPGQHEFSVAAGLPDDDSDLKGGVFAASYGYGLDGLTLRAGGVFNQDWQGASAGVVAGLGYLGAVSADGAYATAKYRDGSHSGNKVQLSWSKQLETTNTGLRVSWSRQSEEYEGMSSFDPTELWSQSNHGRRTKDEWNAGISQPVGGLFSLSVSGWQRSYYPASMTGSYRYSDDNGKETGITGSLSTQIKGVSLNLGWSGSRNSRGENNWSASASVSVPFTLFDRRYSSSASVSTSKGGGTGFSTGVSGSLNDRFSYGLGGGRDGDGGTSSYLNASYSGDRAYLNGVLNHSQSGGTSGSVSVSGSVLAVPAAKDIMFSRTTGDTVAVVNVKDTPGVKVTSGDGQTDSDGNLVVPLNSYGWNTVTIDAGTLPLSTELTNTSQKVVPTDKAVVWMPFDALKVKRYLLQVKQRDGEFVPGGTWARDSKNTPLGFVANNGVLMINTVDAPGDITLGQCRIPAARLQDTEKLQEITCE

SEQ ID NO: 7414 - protein, 258 aa, Escherichia coli
  strain SE11
MSKRNAVTTFFTNRVTKALGMTLALMMTCQSAMASLAADQTRYIFRGDKDALTITVTNNDKERTFGGQAWVDNIVEKDTRPTFVVTPSFFKVKPNGQQTLRIIMASDHLPKDKESVYWLNLQDIPPALEGSGIAVALRSKLKLFYRPKALLEGRKGAEEGISLQSRPDGRTMLVNTTPYIFAIGSLLDGNGKKIATDNGTTQKLLMFMPGDEVQVKGNVVKVDSLNDYGELQTWTINKKKPAAPEAAKAEKADTAEQK

SEQ ID NO: 7415 - protein, 870 aa, Escherichia coli
  strain SE11
MKIKSTFKLHNLSVAIIACLSSAAYAEDYFDPDLLSLGNRDMSLTDLSAFSEQGYSAPGVYIVDIYVNGNYLKTDSIRFEHDKTNTLKPLFSLNDLNEIGVNLHSLKGTEHLPHDRASIDNLSLIPFSSFVFDNSKQRLNINVAQVHMQKETDNRLARKFWDQGIPALFVNYSYSGSQGQTRGNKNKSSTTSDFLSLNAGANLGAWRLRSNMNWTQSGFESEQYDTFEDAYRKQKSSQSKWDTGDTYLQRDVQFLNSELTIGDYRTTSITEQLIDGFQFRGVSLSSSEYMIPAALRGFAPVITGYARTNAEVIVTQNGYSIYQTHVAPGPFRIDDLPGGSSAGDIYVSVKESDGTVHGFRQAYSTLPEMQRQGDFKFEYSVGRYKQSGYSTYENTPLFSNTSFLYGLPHNVTAMGNLLYSGDYQSVSLGAAFSLGMLGTLSTSVTSSVTEGRDNDKLRGYSVNARYSKSLTETGTLFQLASYRYSTPDFRTFSEANVEEYRGSSYINYMLSGRRKDTWSLILNQSITSGLSVGVSGRRDNYWDRHSTTSLSAGLNGTFRQTSWSLNYNIDRVRGNGSWPENRELSLSVSVPFSAFMSSGSMSSANFNYRTAHNNQGRTTNMVSLNGSALEENRLSWNISENWSNSSRNYQRDENFSAGVSYDSQYARLYGGYGRTSQSNTYNYGASGSLLAHPGGVIVSRQNIGNAAALVHVPDVPGARVMNGRDIHTDNKGFALVPYVAIYEKNNITIDPVSLSDGIELSETSKATYPTKGAIVSVEYKVHSGQQALINLTHDGKPVPLGAFVTIGDQVFIVGHSGQVYVSGVPESGRLKVKWGDKESYVANYKLNAKSPRHSESDEKWRPLQEINVVL

SEQ ID NO: 7416 - protein, 241 aa, Escherichia coli
  strain SE11
MRLLSVGVCLLFSATTLAAEFPRNTFGFTSTRIIFNEKGNKGSSVSFVNNTNKTYLVAPAVYEADKNGNKSDVRSPAFVVSPFLKKSQPFSEDVLKIVRTGGRLPDDTESLFYLSSVLIPSRTSSVPERIAVDVGYRWNMKILYRPLSLKDENISKSLEKLKVLKEGNRIKLINNSPLWMTVVNVKVNDSTVNEGAAIMISPHSSALLNETAVSATSVSLQLVDESGHRIPRYGKRFTFDA

SEQ ID NO: 7417 - protein, 233 aa, Escherichia coli
  strain SE11
MVFRNFIIIILCFLVMSCAHAGIRLNKTRVIFNEKNPSTSITFSNTGKDNYLVEAAVIDPGLNKVSDSFMVIPPIFRSEGGQSSVLKIIRKGGELASDKESDYRLVLNAIPASERNTKERAARVSFSLGFSVKLFYRPESLKHTPDDAYKRLTFHRKDSTTVIARNDSEYNLSLSQLFLGKQQINLNKQPSMIRPFASVVFKTPEAVSEARWRLINDFGGETEEHLSRIQQGD

SEQ ID NO: 7418 - protein, 236 aa, Escherichia coli
  strain SE11
MNIIFSLFLFILTTTLSCAYAGVGLDATRIIYNEGEKAVNVGVRNTDSKLNYLIQPSVSTDLDKLNNAAPFVFSPSLFKLESGSESIVKIMVLNHAKLPEKQESLFWFSVTAIPSSEKRVGISDFDVLRGGVKIAVGNTIKLIYRPKNLPVSPKEGAENLKFGKTKEGMLKAENGSPYYINLSSLILGGRPVKSDNMMMIPPYGELVFKGIAPPKNLKEIQWNVINDNGGVENYRF

SEQ ID NO: 7419 - protein, 122 aa, Escherichia coli; identical to SEQ ID NO: 5737
  strain SMS-3-5 / SECEC

SEQ ID NO: 7420 - protein, 359 aa, Escherichia coli
  strain SMS-3-5 / SECEC
MKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDIGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 7421 - protein, 695 aa, Escherichia coli
  strain SMS-3-5 / SECEC
MRVTTLASVAIPCLGFSVSSMAAEDVMVVTASGYEKKLTSAAASVSVISQEDLRSSQYHDLGEALRSVEGVDVESGTGKTGGLEISIRGMPASYTLILIDGVRQGGSSDVTPNGYAAMNTGFMPPLAAIERIEIIRGPMSTLYGSDAMGGVVNIITKKNADKWRSSVNAGLNLQESNKWGNSSQFNFWSSGPLVDDSLSLQVRGSTQQRQGSSVTSLSDTSATRIPYPTESQNYNAGGRLDWKATDKDVLWIDMDIARQRYDNRDGQLGSLTGGYDRTLRYERNKISAGYDHTFTFGAWKSSLNWNETENKGRQLVRSVLQRDKWGLAGQPRELKESNLILSSLLFAPLGESHKVTVGGEYQNSSMKDGVVLASTGETFRQKSWSAFVEDEWYITDAFALTAGSRYERYEVFGGHFSPRAYMVWDVTDAWTLKGGVTTGYKAPSMGQLHKGISGVSGQGRTNLLGNPDLKPEESVSYEAGVYYDNHAGLNANITGFMTEFSNKIVSYSIDDNTRSYTNSGKARTQGVEFAGTLPLLSEDVTLSLNYTWTQSEQRDGDNKGAPLSYTPEHMVNAKLNWQITEEVTSWLGARYRGKTPRFTQNYSSLSAVQKKVYDEKGEYLKAWTVLDAGMSWKVTDALMLNAAVNNVLNKDYSDVSLYRAGSGTLYAGDYFQTGASTTGYVIPERNYWMSLNYQF

SEQ ID NO: 7422 - protein, 368 aa, Escherichia coli
  strain SMS-3-5 / SECEC
MNKTIMALAIMMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLDPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 7423 - protein, 216 aa, Escherichia coli
  strain SMS-3-5 / SECEC
MAMVVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 7424 - protein, 856 aa, Escherichia coli
  strain SMS-3-5 / SECEC
MAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAQLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTNNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNSVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 7425 - protein, 733 aa, Escherichia coli
  strain SMS-3-5 / SECEC
MMISKKYTLWALNPLLLTMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAAFLQSGYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTADLLGSYQLPVGTLSFSIENLFDRDYTTVWGQRAPLYYSPGYGPASLYGYKGRGRTFGLSYSVLF

SEQ ID NO: 7426 - protein, 686 aa, Escherichia coli
  strain SMS-3-5 / SECEC
MFWRDMTLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERRGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPILPAQNQALPPEVRAFLNAGRTR

SEQ ID NO: 7427 - protein, 713 aa, Escherichia coli
  strain SMS-3-5 / SECEC
MAMFTPSFSGLKGRALFSLLFAAPMIHATDSVTTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGKSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESVGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 7428 - protein, 222 aa, Escherichia coli
  strain SMS-3-5 / SECEC
MSKLGISSLFKSILLTAALAVSFTASAFTEGTDYMVLEKPIPNADKTLIKVFSYACPFCYKYDKAVTGPVSEKVKDIVAFTPFHLETKGEYGKQASEVFAVLINKDKAAGISLFDANSQFKKAKFAYYVAYHDKKERWSDGKDPAAFIKTGLDAAGMSQADFEAALKEPAVQETLEKWKASYDVAKIQGVPAYVVNGKYLIYTKSIKSIDAMADLIRELASK

SEQ ID NO: 7429 - protein, 340 aa, Escherichia coli
  strain SMS-3-5 / SECEC
MTLHRFKKIALLSALGIAAISMNVQAAERIAFIPKLVGVGFFTSGGNGAQQAGKELGVDVTYDGPTEPSVSGQVQLINNFVNQGYNAIIVSAVSPDGLCPALKRAMQRGVRVLTWDSDTKPECRSYYINQGTPAQLGGMLVDMAARQVNKDKAKVAFFYSSPTVTDQNQWVKEAKAKIAKEHPGWEIVTTQFGYNDATKSLQTAEGILKAYSDLDAIIAPDANALPAAAQAAENLKNDKVAIVGFSTPNVMRPYVERGTVKEFGLWDVVQQGKISVYVADALLKKGSMKTGDKLDIQGVGQVEVSPNSVQGYDYEADGNGIVLLPERVIFNKENIGKYDF

SEQ ID NO: 7430 - protein, 236 aa, Escherichia coli
  strain SMS-3-5 / SECEC
MQTTRIPYSISFMATVLLLLLFACHSTIANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDIPHAATGDISFQTINDYGALTPRIKATMQ

SEQ ID NO: 7431 - protein, 871 aa, Escherichia coli
  strain SMS-3-5 / SECEC
MHQVLLLPRFARLTIALGLATAVFPVDAEFYFNPRFLSNDLAESVDLSAFTKGREAPPGTYRVDIYLNDEFMTSRDITFIADDNNADLIPCLSTDLLVSLGIKKSALLDNKEHSAEKHVSDNSACTPLRDRLADASSEFNVGQQHLSLSVPQIYVGRMARGYVSPDLWEEGINAGLLNYSFNGNSINNRGNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARSTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSIKSVYSKSFYQTGTNIQVAGYRYSTQGFYNLSDSAYSRMSGYTVKPPTGDSNEQTQFIDYFNLFYSKRGQEQISISQQLGNYGTTFFSASRQSYWNTSRSDQQISFGLNVPFSDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNIGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPAVSPGTLLNQQTAICR

SEQ ID NO: 7432 - protein, 366 aa, Escherichia coli
  strain SMS-3-5 / SECEC
MKLKIVAVVVTGLLAANVAHAAEVYNKDGNKLDLYGKVTALRYFTDDKRDDGDKTYARLGFKGETQINDQMIGFGHWEYDFKGYNDEANGSRGNKTRLAYAGLKISEFGSLDYGRNYGVGYDIGSWTDMLPEFGGDTWSQKDVFMTYRTTGVATYRNYDFFGLIEGLNFAAQYQGKNERTDNGHLYGADYTRANGDGFGISSTYVYDGFGIGAVYTKSDRTNAQERAAANPLNASGKNAELWATGIKYDANNIYFAANYAETLNMTTYGDGYISNKAQSFEVVAQYQFDFGLRPSLAYLKSKGRDLGRYGDQDMIEYIDVGATYFFNKNMSTYVDYKINLIDESDFTRAVDIRTDNIVATGITYQF

SEQ ID NO: 7433 - protein, 700 aa, Escherichia coli
  strain SMS-3-5 / SECEC
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVITQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHHGELGVPVTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMNDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYVPEEGWYAGTEARYMGDIMADDENTAKAPSYTLVGLFTGYKYNYHNLTVDLFGRVDNLFDKGYVGSVIVNESNGRYYEPAPGRNYGVGMNIAWRFE

SEQ ID NO: 7434 - protein, 678 aa, Escherichia coli
  strain SMS-3-5 / SECEC
MVPSTFSRLKAARCLPVVLAALIFAGCGTHTPDQSTAYMQGTAQADSAFYLQQMQQSSDDTRINWQLLAIHALVKEGKTGQAVELFNQLPQELNDSQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRIWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRETTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 7435 - protein, 785 aa, Escherichia coli
  strain SMS-3-5 / SECEC
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLTQAGAGLMELDYLPSDKVYEDEHPEDSNSRRWLFYWQHSGVMDQVWRFNIDYTKVSDPTYFNDFDNKYGSSTDGYATQKFSVGYAVQNFDATLSTKQFQVFDDTSGNSYAAEPQLDVNYYHNDLGPFDTRVYGQAVHFVNTNSNMPEATRVHLEPTINLPLSNTWGSINTEAKLLATHYQQTNLDWYNSNPQNNKLADSVNRVMPQFKVDGKMVFERDMEMLAPGYTQTLEPRAQYLYVPYRDQSDIYNYDSSLLQSDYSGLFRDRTYGGLDRIASANQVTTGITTRVYDDAAVERFNISVGQIYYFTESRTGDDNITWENDDKTGSLVWAGDTYWRISERWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 7436 - protein, 539 aa, Escherichia coli; identical to SEQ ID NO: 6525
  strain SMS-3-5 / SECEC

SEQ ID NO: 7437 - protein, 866 aa, Escherichia coli
  strain SMS-3-5 / SECEC
MSRKIIKTHNNKLTYIASFCALLLSPCAISAEHVEYDNTFLMGQDAFNIDLSRYTEGNPTLPGVYDVSVYINDQPVINQSISFITLEGKKNAQACITLKNLLQFHINKPDINAENSILLQREGELGDCLDLANIIPQASVHYDVNDQRLDINVPQAWVMKNYQNYVDSSLWENGINAAMLAYNVNAYHSEIPDRKNDSVYAAFNGGINLGAWRLRATGNYNWMTNVGSDYDFQNRYLQRDLASLRSQLIVGESYTTGETFDAVSIRGIRLYSDSRMLPPALASFAPIIHGVANTNAKVTITQGGYKIYETTVPPGAFVIDDLSPSGYGSDLIITIEESDGIKRTFSQPFSSVIQMQRPGVGRWDISAGQVLKDDIQNEPNLFQASYYYGLNNYLTGYTGIQITDNNYTAGLLGLGLNTAYGAFSVDVTHSDVQIPDDKTYRGQSYRISWNKLFEDTRTSLNIAAYRYSTQNYLGLNDALTLIDEVKHPEQDLEPKNMRNYSRMKNQVTVSINQPLKFEKKDYGSFYLAGSWSDYWADGQNNTNYSIGYSNSASWGSYSISAQRSWSQDGGNEDSIYLSFSIPIEKLLGSEHRDSGFQSIDTQLNSDFNGSNQLSISSSGYSTENHISYSVNTGYSMMKSSDDLGYIGGYASYESPWGTLSSSVSASSDNSRQISFNTDGGFVLHSGGLTFSNDSFSDSDTLAVVQAPGAKGARINYGNSTIDRWGYGVTNALSPYHENRIALDINGLENDVELKSTSAITVPRQGSVVFAGFETVQGQSAIMNIKRTDGKNIPFAADIYDENGNIIGNVGQGGQAFVRGIEQQGNIRINWLDDGKPVTCLAHYQQSAAPEKIAQTIILNGISCQIQ

SEQ ID NO: 7438 - protein, 246 aa, Escherichia coli
  strain SMS-3-5 / SECEC
MFLNAKHTAAVCFATCMSLSASAIADIVISGTRVIYKSNEKSVNVRLENKGNNPLLVQSWLDTGDDSAEPGSITVPFTATPPVSRIDAKRGQTIKLMYTASSPLPKDRESVFWFNVLEVPPKPDADKVANQSLLQLAFRTRIKLFYRPEGLNGLPSDAPAALKWSWATSAGKTALRVANPTPYHVSFSSGDLVANGKTYPLDVKMVAPLSEETFDIKGMSGKASSAKVHFFAINDFGGAIEGNASL

SEQ ID NO: 7439 - protein, 752 aa, Escherichia coli
  strain SMS-3-5 / SECEC
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVAVGTRGASNTYDYLIIRGFAADGQSQNNYLNGLKMQGNFYNDAVIDPYMLERAEIMRGPVSVLYGKSSPGGLLNMVSKRPTTEPLKEIQFKAGTDSLFQTGFDFSDALDDDGVYSYRLTGIARSANAQQKGAEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAQNKVSQKSVYGYGMCSDPLYTKDDDALKASPCLSIPQSEWNHTLTRQYVIDNEKLENFSVDTQLQSKFATGSVEHTLLTGVDFMRMRNDIDSWFGYAGSVAPSDIYNLDRSDFDFGAHPDPSGPYRVLLKQKQTGLYVQDQAQWDKVLVTLGGRYDWAEQSSFNRDYGNKSDRDDKQFTWRGGVNYLFDNGVTPYFSYSESFEPASLTDANGDLFAPSKGKQYEVGVKYVPEDRPIVLTGALYQLTKTNNLMADPNNPNFSIEGGEIRARGVELEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 7440 - protein, 266 aa, Escherichia coli; identical to SEQ ID NO: 5772
  strain SMS-3-5 / SECEC

SEQ ID NO: 7441 - protein, 810 aa, Escherichia coli
  strain SMS-3-5 / SECEC
MAMKKLLIASLLFSSATVYGAEGFVVKDIHFEGLQRVAVGAALLSMPVRTGDTVNDEDISNTIRALFATGNFEDVRVLRDGDTLLVQVKERPTIASITFSGNKSVKDDMLKQNLEASGVRVGESLDRTTIADIEKGLEDFYYSVGKYSASVKAVVTPLPRNRVDLKLVFQEGVSAEIQQINIVGNHAFTTDELISHFQLRDEVPWWNVVGDRKYQKQKLAGDLETLRSYYLDRGYARFNIDSTQVSLTPDKKGIYVTVNITEGDQYKLSGVEVSGNLAGHSAEIEQLTKIEPGELYNGTKVTKMEDDIKKLLGRYGYAYPRVQSMPEINDADKTVKLRVNVDAGNRFYVRKIRFEGNDTSKDAVLRREMRQMEGAWLGSDLVDQGKERLNRLGFFETVDTDTQRVPGSPDQVDVVYKVKERNTGSFNFGIGYGTESGVSFQAGVQQDNWLGTGYAVGINGTKNDYQTYAELSVTNPYFTVDGVSLGGRLFYNDFQADDADLSDYTNKSYGTDVTLGFPINEYNSLRAGLGYVHNSLSNMQPQVAMWRYLYSMGEHPSTSDQDNSFKTDDFTFNYGWTFNKLDRGYFPTDGSRVNLTGKVTIPGSDNEYYKVTLDTATYVPIDDDHKWVVLGRTRWGYGDGLGGKEMPFYENFYAGGSSTVRGFQSNTIGPKAVYFPYSPNGYDPSNDYACATQDGAKDLCKSDDAVGGNAMAVASLEFITPTPFISDKYANSVRTSFFWDMGTVWDTNWDSSQYSGYPDYSDPSNIRMSAGIALQWMSPLGPLVFSYAQPFKKYDGDKAEQFQFNIGKTW

SEQ ID NO: 7442 - protein, 161 aa, Escherichia coli; identical to SEQ ID NO: 5769
  strain SMS-3-5 / SECEC

SEQ ID NO: 7443 - protein, 207 aa, Escherichia coli
  strain SMS-3-5 / SECEC
MPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTSDDAEEMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 7444 - protein, 565 aa, Escherichia coli
  strain SMS-3-5 / SECEC
MKSPTPSRPQKMALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRATENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQNTYDREKKLVEKYDVSATGTGGGGGEYPLQDGFGWTNGVTLKMLDLICPKEQPCDNVPATRPLSESTTQPLKQKEAEPTP

SEQ ID NO: 7445 - protein, 412 aa, Escherichia coli
  strain SMS-3-5 / SECEC
MKQWIAALLLMLIPGVQAAKPQKVTLMVDDVPVAQVLQALAEQEKLNLVVSPDVSGTVSLHLTDVPWKQALQTVVKSAGLITRQEGNILSVHSIAWQNDNIARQEAEQARAQANLPLENRNITLQYADAGELAKAGEKLLSAKGSMTVDKRTNRLLLRDNKTALSALEQWVAQMDLPVGQVELSAHIVTINEKSLRELGVKWTLADAQQAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 7446 - protein, 221 aa, Escherichia coli
  strain SMS-3-5 / SECEC
MKNYLWLVALLPLLSGCESQAILVKKDDAYFAPPTTEAPPPADGRAGGVFETGYNWSLTADRRAYRVGDILTVILEESTQSSKQAKTNFGKSNTVDIGAPTIFGHTKDKLSGSIDANRDFDGSATSQQQNSLRGEITVSVHAVQPNGILEIRGEKWLTLNQGDEYIRLSGLVRADDIQNDNSVSSQRIADARISYAGRGALSDANAAGWLTRLFNHPLFPI

SEQ ID NO: 7447 - protein, 371 aa, Escherichia coli
  strain SMS-3-5 / SECEC
MPESAMQNWIKAAVITVSLALPGVALAQSLESLVNVQGVRENQLVGYSLVVGLDGTGDKNQVKFTNQTITNMLRQFGVQLPNKIDPKVKNVAAVAVSATLPPMYSRGQTIDVTVSSIGDAKSIRGGTLLLTQLHGADGEVYALAQGSVVVGGMNATGASGSSVTVNTPTAGLIPNGATVEREIPSDFQMGDTITLNLKRPSFKDANNIAAAINASFGGIATAQSSTNVSVRAPTSPGARVAFMSQLDDVQVQAEKIRARVVFNSRTGTVVMGDGVALHAAAVSHGSLTVSINETSNVSQPNAFAGGRTAVTPQSNIAVNHARPGVVSLPESSSLKTLVNALNSLGATPDDIMSILQALHEAGALDADLEVI

SEQ ID NO: 7448 - protein, 351 aa, Escherichia coli
  strain SMS-3-5 / SECEC
MKKSTLALVVMGIVASASVQAAEIYNKDGNKLDIYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 7449 - protein, 656 aa, Escherichia coli
  strain SMS-3-5 / SECEC
MRLKKRYLCTALSLAFTQQAVAAQESDTLTVWSSPVSSTTTTVLDQPTMKALDKQNVAQALSVVPGVVLQKSGSRNEEQVKVRGFDSRQVPVYFEGVPIYVPYDGNLDLARILTNNLGAVEVSKGYSSLLQGPNQMGGAINITTQKPTKPLEANLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIAYTF

SEQ ID NO: 7450 - protein, 203 aa, Escherichia coli
  strain SMS-3-5 / SECEC
MKLRWFAFLIVLLAGCSSKHDYTNPPWNAKVPVQRAMQWMPISQKAGAAWGVDPQLITAIIAIESGGNPNAVSKSNAIGLMQIKASTSGRDVYRRMGWSGEPTTSELKNPERNISMGAAYLNILETGPLAGIEDPKVLQYALVVSYANGAGALLRTFSSDRKKAISKINDLDADEFLDHVARNHPAPQAPRYIYKLEQALDAM

SEQ ID NO: 7451 - protein, 213 aa, Escherichia coli; identical to SEQ ID NO: 5744
  strain SMS-3-5 / SECEC

SEQ ID NO: 7452 - protein, 729 aa, Escherichia coli
  strain SMS-3-5 / SECEC
MLSTQFNRDNQHQAIIKSSLLAGCIALALLPSAAFAAPVTEETVIVEGSATAPDDGENDYNVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLTPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRSTIKMFTSYRLPVMLELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 7453 - protein, 365 aa, Escherichia coli
  strain SMS-3-5 / SECEC
MIKFLSALILLLVTTAVQAERIRDLTSVQGVRQNSLIGYGLVVGLDGTGDQTTQTPFTTQTLNNMLSQLGITVPTGTNMQLKNVAAVMVTASLPPFGRQGQTIDVVVSSMGNAKSLRGGTLLMTPLKGVDSQVYALAQGNILVGGAGASAGGSSVQVNQLNGGRITNGAVIERELPSQFGVGNTLNLQLNDEDFSMAQQIADTINRVRGYGSATALDARTIQVRVPSGNSSQVRFLADIQNMQVNVTPQDAKVVINSRTGSVVMNREVTLDSCAVAQGNLSVTVNRQANVSQPDTPFGGGQTVVTPQTQIDLRQSGGSLQSVRSSASLNNVVRALNALGATPMDLMSILQSMQSAGCLRAKLEII

SEQ ID NO: 7454 - protein, 232 aa, Escherichia coli
  strain SMS-3-5 / SECEC
MQKNAAHTYAISSLLVLSLTGCAWIPSTPLVQGATSAQPVPGPTPVANGSIFQSAQPINYGYQPLFEDRRPRNIGDTLTIVLQENVSASKSSSANASRDGKSNFGFDTVPRYLQGLFGNARADVEASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 7455 - protein, 660 aa, Escherichia coli; identical to SEQ ID NO: 6837
  strain SMS-3-5 / SECEC

SEQ ID NO: 7456 - protein, 191 aa, Escherichia coli; identical to SEQ ID NO: 5748
  strain SMS-3-5 / SECEC

SEQ ID NO: 7457 - protein, 517 aa, Escherichia coli; identical to SEQ ID NO: 6817
  strain SMS-3-5 / SECEC

SEQ ID NO: 7458 - protein, 229 aa, Escherichia coli
  strain SMS-3-5 / SECEC
MALLIFAVLSLLVASELQAGVVVGGTRFIFPADRDSISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNAGVVPPKSQRQTSWCQAITPCHVSWRTINDYGGLSAKKEQNLP

SEQ ID NO: 7459 - protein, 866 aa, Escherichia coli
  strain SMS-3-5 / SECEC
MYRTQRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACAPLAEIIPDASVTFNVNKLRLEISVPQIAIKSNARGYVPPERWDEGINALLLGYSFSGANSIHSSAGSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQVTIKQNGYTIYQTYVSPGAFEISDLYSTSSSGDLLVEIKEADGSVNSYSVPFSSVPLLQRQGRIKYAVTLAKYRTNSNDQQESKFAQATLQWGGPRGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPKSNDSYTRKKNYAWMTSNTSIDNEGHTTQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGMPLRFGAMATLDGAQTISGIIDDDGSLYMSGLPAKGTITVRWGDAPDQICHISYELTEQQINAAITRMDSVCE

SEQ ID NO: 7460 - protein, 224 aa, Escherichia coli
  strain SMS-3-5 / SECEC
MTVSLTAILLSCSFTWAAGKGGVGLAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLAEAPAKLRCTSSADMVTVSNPTPYFITLTDLKIGGKVVKNQMISPFDKYQFSLPMGAKNSSVTYRTINDYGAETPQLNCKS

SEQ ID NO: 7461 - protein, 357 aa, Escherichia coli; identical to SEQ ID NO: 5807
  strain SMS-3-5 / SECEC

SEQ ID NO: 7462 - protein, 203 aa, Escherichia coli; identical to SEQ ID NO: 6414
  strain SMS-3-5 / SECEC

SEQ ID NO: 7463 - protein, 226 aa, Escherichia coli
  strain SMS-3-5 / SECEC
MKKINLMPVLALLLICFNSHAAFVLNSTRYIFAGDKDNISVQVNNESSQEYGGQIWIDNANARDQNVYFAPSPTFFKVSGGHKQILRLLKINDSLPKDKESLFWVNVQEIPKAPKEGTNSLAIALHTQVKMIYRPESLKEGREDAEKNIKIIHEGGNTILYNNSPYYFAVINVKQNGHDVKLSEETKNKIAAFAPFEKVSLGSKLSGKDISIVSFDDYGVDREYKL

SEQ ID NO: 7464 - protein, 785 aa, Escherichia coli
  strain SMS-3-5 / SECEC
MKKEIFIAAIIFHLLSKGALAEEFNYSFIRGGSKDIPDVLNSNKENVPGKYVVDVVFNGSKIASSTEMSIAKEDAEGICLSDEWLTENGIIINKDFYKNVYNSARQCYLLGNEANSKVAFDQSLQEVSIDLPQAGFQDAAKDGGVWDYGSNGFKIAYDVNTAKNSNQERTTYSSIDGQVNLGEWVLLGRGYAYQGENFDTNNLLLTRAIKSLKSDLQLGKTQLYNSLNNGFTFYGAQLKSNQDMYPWNSRAYSPVINGIARTHARVTIEQSGYTLKSIVVPPGPFVINDLNGVYSGDLIMKIYEEDGSVREQRFPVAVLPNLLRPGTYNYALAMGSKVNQDNGERDKESLFAQMSYDYGFEPFTLNSSLLLDKNYNNIGLGLIRSFGWFGAMSFSGNLSQAKYHNGKNLKGYSTSLKYAKALGDNANLQLIGYRFNSEDYIDYADFTYNSYSFIRNRPKQRYESIVTYQLPEKGMFLNFSAWKEDYWDNYNEVGANLSLTKSFDQITMTLNGGYSRLQNMDADYNVGLSLSVPLSLFDKTHYSFSNVNYDRRTGTSMNTGISGMINQRLSYNASVNQTRDTIGGTLSASYLFDWMQTSATYSQTGKNSSTSLQLGGSVIGVPEGGIIFTPVKNDQLAIVQMKDVPGVMFNGSLPGDKYGRAVIPLTAYNNNTISVNAEKLPKNIELTDNAINVTPTGNAIIYKNVKFKKINTYVVKLYGKNGYVVPMGSIAKNTQGKEVGYVNNGGILLMNLETHDEGVISLDQCQFNTQSLKKNYDQTQEIHCE

SEQ ID NO: 7465 - protein, 230 aa, Escherichia coli
  strain SMS-3-5 / SECEC
MMTKIKLLMLIIFYLIISTSAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 7466 - protein, 869 aa, Escherichia coli
  strain SMS-3-5 / SECEC
MKIPTTTDIPQRYTWCLAGICYSSLAILPSFLSYAESYFNPAFLLENGTSVADLSRFERGNHQPAGVYRVDLWRNDEFIGSQDIVFESTTVNTGDKSGGLMPCFNQALLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNNWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSPVRENSTGITSMVGDDGQVYLSGAPLSGELLVQWGDGANSRCIAHYVLPKQSLQQAVTVISAVCTHPGS

SEQ ID NO: 7467 - protein, 746 aa, Escherichia coli
  strain SMS-3-5 / SECEC
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKAAQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAAGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 7468 - protein, 641 aa, Escherichia coli
  strain SMS-3-5 / SECEC
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGYSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 7469 - protein, 828 aa, Escherichia coli; identical to SEQ ID NO: 5895
  strain SMS-3-5 / SECEC

SEQ ID NO: 7470 - protein, 162 aa, Escherichia coli; identical to SEQ ID NO: 5896
  strain SMS-3-5 / SECEC

SEQ ID NO: 7471 - protein, 364 aa, Escherichia coli; identical to SEQ ID NO: 5776
  strain SMS-3-5 / SECEC

SEQ ID NO: 7472 - protein, 243 aa, Escherichia coli
  strain SMS-3-5 / SECEC
MSRKSCLIRLFKTTVSCKLFTAIILSVFLVQPALTYAGVVIGGTRVVYLSNNPDKSISVFSKEEKIPYLIQAWVDPFNKEDKSKAPFTVIPPVSRLEPAQEKVLRIIHTKGVSLPDDRESVFWLNIKNIPPSASNKAANSLEIAVKTRIKLFWRPASIRLIPEDAAPKVKWHREGRNLIAENPNPIHISVMDVIVDGHDVPLNMLRPFETLTLPLPANSAGGQMIWRFINDYGAVSDPIKMTL

SEQ ID NO: 7473 - protein, 193 aa, Escherichia coli; identical to SEQ ID NO: 6300
  strain SMS-3-5 / SECEC

SEQ ID NO: 7474 - protein, 200 aa, Escherichia coli
  strain SMS-3-5 / SECEC
MLAFCRSSLKSKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRLLQCGNEIYSAIKDLQSKAPDKNIVIFTHNHCLTYIAKDKRDATFKPDYLDGLVMHVEKGKVYLDGEFVNH

SEQ ID NO: 7475 - protein, 274 aa, Escherichia coli; identical to SEQ ID NO: 5899
  strain SMS-3-5 / SECEC

SEQ ID NO: 7476 - protein, 431 aa, Escherichia coli; identical to SEQ ID NO: 6791
  strain SMS-3-5 / SECEC

SEQ ID NO: 7477 - protein, 331 aa, Escherichia coli; identical to SEQ ID NO: 6551
  strain SMS-3-5 / SECEC

SEQ ID NO: 7478 - protein, 760 aa, Escherichia coli
  strain SMS-3-5 / SECEC
MENNRNFPARQFHSLTFFAGLCIGITPVAQALAAEGQINADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTARSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISGAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 7479 - protein, 250 aa, Escherichia coli
  strain SMS-3-5 / SECEC
MSYKLSSSMVVSTALAALLSTVSLAAHASVTPDRTRLVFNESDKSISVTLRNNNEKLPYLAQSWLEDEKGNKITSPLAVLPPVQRIDAMMNGQVKIQALPDIHTLPSDRESLFYYNVREIPPKTGKANTLQIALQTRIKLFWRPKALEKIDMRKPWQFKVTLTRSGQDYTVNNPTPYHVIISDASTQKKGPTAAGFKPLVMSPKTSQPLKAKMDSAPVLTYINDYGARLPLIFRCEGDTCKVDEDQSSKG

SEQ ID NO: 7480 - protein, 882 aa, Escherichia coli
  strain SMS-3-5 / SECEC
MPNHSNFRLRGIACYIALAISGGSVNAWADDSIQFDPRFLELKGDTKIDLGKFSKKGYVDAGKYNLRVFINKQPLSDEYDINWYVSENDPTKTYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKNWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADEHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNVSISVTGYRYEYDDNADKGMYLSMSIPWSDSSTVTYNGSYGSGSDSSQVGYFKRVDDATHYQVNVGTSEQHGSVDGYLSHDGSLAKVDLSANYHEGEYRSAGIALQGGATLTAHGGALHRTQSMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNAGEHMTVFWEGSAQCEIVLPKPLPADLFSGLLLPCEQKGTAAPDSSAPEIKPVIQDQTRQVTPTEAPTSISATQ

SEQ ID NO: 7481 - protein, 208 aa, Escherichia coli
  strain SMS-3-5 / SECEC
MKKIWLALAGLVLAFSASAAQYEDGKQYTTLEKPVAGAPQVLEFFSFFCPHCYQFEEVLHISDNVKKKLPEGVKMTKYHVNFMGGDLGKDLTQAWAVAMALGVEDKVTVPLFEGVQKTQTIRSASDIRDVFINAGIKGEEYDAAWNSFVVKSLVAQQEKAAADVQLRGVPAMFVNGKYQLNPQGMDTSNMEVFVQQYADTVKYLSEKK

SEQ ID NO: 7482 - protein, 826 aa, Escherichia coli
  strain SMS-3-5 / SECEC
MLRMTPLASAIVALLLGIEAYAAEETFDTHFMIGGMKDQQVANIRLDDNQPLPGQYDIDIYVNKQWRGKYEIIVKDNPQETCLSREIIKRLGINTDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNSNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESRNYICQ

SEQ ID NO: 7483 - protein, 614 aa, Escherichia coli
  strain SMS-3-5 / SECEC
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRIEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVTVGHGNIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLNPEKSKQWEGAFEGLTAGVNWRISGYRNDVSDLIDYDDHTLKYYNEGKARIKGVEATANFDTGPLTHTVSYDYVDARNAITDVPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 7484 - protein, 518 aa, Escherichia coli
  strain SMS-3-5 / SECEC
MKKLKINYLFIGILALLLAVALWPSIPWFGKADNRIAAIQARGELRVSTINTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKETKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 7485 - protein, 446 aa, Escherichia coli
  strain SMS-3-5 / SECEC
MMITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYTGNANTNTNFGKAVPADFNGGSFGRGDSDEWTFGAQMEIWW

SEQ ID NO: 7486 - protein, 237 aa, Escherichia coli; identical to SEQ ID NO: 6384
  strain SMS-3-5 / SECEC

SEQ ID NO: 7487 - protein, 478 aa, Escherichia coli; identical to SEQ ID NO: 5711
  strain SMS-3-5 / SECEC

SEQ ID NO: 7488 - protein, 432 aa, Escherichia coli; identical to SEQ ID NO: 5727
  strain SMS-3-5 / SECEC

SEQ ID NO: 7489 - protein, 334 aa, Escherichia coli; identical to SEQ ID NO: 6452
  strain SMS-3-5 / SECEC

SEQ ID NO: 7490 - protein, 387 aa, Escherichia coli; identical to SEQ ID NO: 7356
  strain SMS-3-5 / SECEC

SEQ ID NO: 7491 - protein, 119 aa, Escherichia coli; identical to SEQ ID NO: 6116
  strain SMS-3-5 / SECEC

SEQ ID NO: 7492 - protein, 207 aa, Escherichia coli; identical to SEQ ID NO: 7443
  strain UM146

SEQ ID NO: 7493 - protein, 565 aa, Escherichia coli
  strain UM146
MKSPAPSRPQKMALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPKPYVVPGGRFREVYYWDSYFTMLGLAESGHWDKVADMVANFAHEIDNYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAIGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPLKQKEAEPTP

SEQ ID NO: 7494 - protein, 656 aa, Escherichia coli
  strain UM146
MRLKKRYLCTVLTLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 7495 - protein, 203 aa, Escherichia coli; identical to SEQ ID NO: 7450
  strain UM146

SEQ ID NO: 7496 - protein, 138 aa, Escherichia coli
  strain UM146
MFLGKTNLPTDRETLYWMNVKAIPPTDEKNTQKNTLQLALQNKIKLFYRPENLPVQPGKARNMLRFKYEGKQLKVINPSPYYLTLTGIKVQGSKLPNMFVPPKSDITVSSPVTLAGEITYQTINDFGATTERQKGIMQ

SEQ ID NO: 7497 - protein, 862 aa, Escherichia coli
  strain UM146
MTIKSTNHLTHIATFCALLYSNSALCAELVEYDHTFLMGKDASNIDLSRYTEGNPTLPGIYDVSVYVNDQPIMSQSIAFAVIEGKKNAQACITQKNLLQFHISSPDKNSEKAILLKRDDDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVRIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAIMNIVRSDGKNIPFAADIYDEQNNIIGNVGQGGQAFVRGIGQEGNIRITWIEEGKPVSCFAHYQQNTTSEKIAQSIILNGLRCQIQ

SEQ ID NO: 7498 - protein, 246 aa, Escherichia coli; identical to SEQ ID NO: 5857
  strain UM146

SEQ ID NO: 7499 - protein, 747 aa, Escherichia coli
  strain UM146
MAPSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLDLYNPVNTDFDFNAKDPDNSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 7500 - protein, 266 aa, Escherichia coli
  strain UM146
MAKSLFRALVALSFLAPLWLNAAPRVITLSPANTELAFAAGITPVGVSSYSDYPPQAQKIGQVSTWQGMNLERIVALKPDLVIAWRGGNAERQVDQLASLGIKVMWVDATSIEQIANALRQLAPWSPQPDKAEQAAQSLLDQYAQLKAQYADKPKKRVFLQFGINPPFTSGKESIQNQVLEVCGGENIFKDSRVPWPQVSREQVLARSPQAIVITGGPDQIPKIKQYWGEQLKIPVIPLTSDWFERASPRIILAAQQLCNALSQVD

SEQ ID NO: 7501 - protein, 161 aa, Escherichia coli; identical to SEQ ID NO: 5769
  strain UM146

SEQ ID NO: 7502 - protein, 882 aa, Escherichia coli
  strain UM146
MPNHSNFRLRGIACYIALAISGGSVNAWADDSIQFDPRFLELKGDTKIDLGKFSKKGYVDAGKYNLRVFINKQPLSDEYDINWYVSENDPTKNYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKNWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSVDGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNAGEHMMVFWEGSAQCEIVLPKPLPADLFSGLLLPCEQKGTAAPDSSAPEIKPVIQDQTRQVTPTEAPTSISATQ

SEQ ID NO: 7503 - protein, 250 aa, Escherichia coli
  strain UM146
MSYKLSCPMLVSTALMALLTTASLTAHASVTPDRTRLVFNESDKSISVTLRNNTEKLPYLAQSWLEDEKGNKITSPLAVLPPVQRIDAMMNGQVKIQALPDIHTLPSDRESLFYYNVREIPPKSGKANTLQIALQTRIKLFWRPKALEKIDMRRPWQFKVTLTRSGQDYTVNNPTPYHVIISDASTQKKGLTAAGFKPLVMPPKTSQPLKAKMASAPVLTYINDYGARMPLIFRCEGNTCKVDEDQSSKG

SEQ ID NO: 7504 - protein, 274 aa, Escherichia coli; identical to SEQ ID NO: 5899
  strain UM146

SEQ ID NO: 7505 - protein, 380 aa, Escherichia coli
  strain UM146
MNIYRAVTSFFNNSSKKGRTMKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTDGQVAYGKSKFNASGKNAEVWAAGLKYDANNIYLATTYSETQNMTVFGNNHIANKAQNFEAVAQYQFDFGLRPSVAYLQSKGKDLGVHGDRDLVKYVDVGATYYFNKNMSTFVDYKINLIDDSKFTKTAGIDTDDIVAVGLVYQF

SEQ ID NO: 7506 - protein, 660 aa, Escherichia coli; identical to SEQ ID NO: 6109
  strain UM146

SEQ ID NO: 7507 - protein, 200 aa, Escherichia coli; identical to SEQ ID NO: 5898
  strain UM146

SEQ ID NO: 7508 - protein, 363 aa, Escherichia coli
  strain UM146
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGGAISSSKRTDDQNSPLYIGNGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNQFTRDAGINTDNIVALGLVYQF

SEQ ID NO: 7509 - protein, 162 aa, Escherichia coli
  strain UM146
MKTILPAVLFAAFATTSAWAAESVQPLEKIAPYPQAEKGMKRQVIQLTQQEDESTLKVELLIGQTLEVDCNLHRLGGKLESKTLEGWGYDYYVFDKVSSPVSTMMACPDGKKEKKFVTAYLGDAGMLRYNSKLPIVVYTPDNVDVKYRIWKAEEKIDNAVVR

SEQ ID NO: 7510 - protein, 828 aa, Escherichia coli
  strain UM146
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEDKFKTALKEKGPESIGMFGSGQWTIWEGYAASKLFKAGFRSNNIDPNARHCMASAVVGFMRTFGMDEPMGCYDDIEQADAFVLWGSNMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 7511 - protein, 213 aa, Escherichia coli; identical to SEQ ID NO: 5744
  strain UM146

SEQ ID NO: 7512 - protein, 729 aa, Escherichia coli; identical to SEQ ID NO: 6821
  strain UM146

SEQ ID NO: 7513 - protein, 366 aa, Escherichia coli
  strain UM146
MVIKFLSALILLLVTTAAQAERIRDLTSVQGVRQNSLIGYGLVVGLDGTGDQTTQTPFTTQTLNNMLSQLGITVPTGTNMQLKNVAAVMVTASLPPFGRQGQTIDVVVSSMGNAKSLRGGTLLMTPLKGVDSQVYALAQGNILVGGAGASAGGSSVQVNQLNGGRITNGAVIERELPSQFGVGNTLNLQLNDEDFSMAQQIADTINRVRGYGSATALDARTIQVRVPSGNSSQVRFLADIQNMQVNVTPQDAKVVINSRTGSVVMNREVTLDSCAVAQGNLSVTVNRQANVSQPDTPFGGGQTVVTPQTQIDLRQSGGSLQSVRSSASLNNVVRALNALGATPMDLMSILQSMQSAGCLRAKLEII

SEQ ID NO: 7514 - protein, 232 aa, Escherichia coli; identical to SEQ ID NO: 5747
  strain UM146

SEQ ID NO: 7515 - protein, 191 aa, Escherichia coli; identical to SEQ ID NO: 5748
  strain UM146

SEQ ID NO: 7516 - protein, 517 aa, Escherichia coli; identical to SEQ ID NO: 6817
  strain UM146

SEQ ID NO: 7517 - protein, 663 aa, Escherichia coli; identical to SEQ ID NO: 5894
  strain UM146

SEQ ID NO: 7518 - protein, 656 aa, Escherichia coli
  strain UM146
MYMNVIRTVICTLIILPVGLQAATSHSSMVKDTITIVATGNQNTVFETPSMVSVVTNDTPWSQNAVTSAGMLKGVAGLSQTGAGRTNGQTFNLRGYDKSGVLVLVDGVRQLSDMAKSSGTYLDPALVKRIEVVRGPNSSLYGSGGLGGVVDFRTADAADFLPPGETNGLSLWGNIASGDHSTGSGLTWFGKTGKTDALLSVIMRKRGNIYQSDGERAPNKEKPAALFAKGSVGITDSNKAGASLRLYRNNTTEPGNSTQTHGDSGLRDRKTVQNDVQFWYQYAPVDNSLINVKSTLYLSDITIKTNGHNKTAEWRNNRTSGVNVVNRSHTLIFPGAHQLSYGAEYYRQQQKPEGSATLYPEGNIDFTSLYFQDEMTMKSYPVNIIVGSRYDRYKSFNPRAGELKAERLSPRAAISVSPTDWLMMYGSISSAFRAPTMAEMYRDDVHFYRKGKPNYWVPNLNLKPENNITREIGAGIQLDGLLTDNDRLQLKGGYFGTDARNYIATRVDMKRMRSYSYNVSRARIWGWDMQGNYQSDYVDWMLSYNRTESMDASSREWLGSGNPDTLISDISIPFGHRGVYAGWRAELSASATHVKKGDPHQAGYTIHSFSLSYKPVSVKGFEASVTLDNAFNKLAMNGKGVPLSGRTVSLYTRYQW

SEQ ID NO: 7519 - protein, 725 aa, Escherichia coli; identical to SEQ ID NO: 6197
  strain UM146

SEQ ID NO: 7520 - protein, 876 aa, Escherichia coli
  strain UM146
MFSGDGGQLLSDKSLTGSAGGGNNRMKFNILPLAFFIGIIVSPARAELYFNPRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQLYMSNQARGYIAPEYWDNGITAALLNYDFSGNRVRDSYGGTSDYAYLNLKTGLNIGSWRLRDNTSWSYSAGKGYSQNNWQHINTWLERDIVPLRSRLTMGDSYTRGDIFDGVNFRGIQLASDDNMVPDSQRGYAPTIHGISRGTSRISIRQNGYEIYQSTLPPGPFEINDIYPAGSGGDLQVTLQEADGSVQRFNVPWSSVPVLQREGHLKYALSAGEFRSGGHQQDNPRFAEGTLKYGLPAGWTVYGGAWIAERYRAFNLGMGKNMGWLGAVSLDATRANARLPDESRHDGQSYRFLYNKSLTETGTNIQLIGYRYSTRGYFSFADTAWKKMSGYSVLTQDGVIQIQPKYTDYYNLAYNKRGRVQVSISQQTGESSTLYLSGSHQSYWGTDRTDRQLNAGFNSSVNDISWSLNYSLSRNAWQHETDRILSFDVSIPFSHWMRSDSTSAWRNASARYSQTLEAHGQAASTAGLYGTSLGDNNLGYSIQSGYTRGGYEGSSKTGYASLNYRGGYGNASAGYSHSGGYRQLYYGLSGGILAHANGLTLSQPLGDTLILVRAPGASDTRIENQTGVSTDWRGYAVLPYATDYRENRVALDTNTLADNVDIENTVVSVVPTHGAVVRADYKTRVGVKVLMTLMRNGKAVPFGSVVTARNGGSSIAGENGQVYLSGMPLSGQVSVKWGSQTTDQCTADYKLPKESAGQILSHVTVSCR

SEQ ID NO: 7521 - protein, 231 aa, Escherichia coli
  strain UM146
MMKHMRIWAVLASFLVFFYIPQSYAGVALGATRVIYPEGQKQVQLAVTNNDDKSSYLIQSWIENVEGKKDARFVITPPLFSMQGKKENTLRIIDATNGQMPEDRESLFWVNVKAIPAMDKAKTGENYLQFAIVSRIKLLYRPQGLVIPPEQAPGKLEFTRENGGLTLFNPTPYYLTVTDLKAGNKSLENTMVPPQGKVTVNIPGGYTGGDITYKTINDYGALTEQVRGVVK

SEQ ID NO: 7522 - protein, 224 aa, Escherichia coli; identical to SEQ ID NO: 5893
  strain UM146

SEQ ID NO: 7523 - protein, 826 aa, Escherichia coli
  strain UM146
MLRMPPLASAIVALLIGIEAYAAEETFDTHFMIGGMKDQQVSNIRLEDNQPLPGQYDIDIYVNKQWRGKYEIIVKDNPQETCLSREMIKRLGINTDSFASGKQCLTFKQLIQGGSYTWDIGVFRLDFSVPQAWVEELESGYVPPENWERGINAFYTSYYMSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQVGHQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESRNYICQ

SEQ ID NO: 7524 - protein, 362 aa, Escherichia coli; identical to SEQ ID NO: 5874
  strain UM146

SEQ ID NO: 7525 - protein, 678 aa, Escherichia coli
  strain UM146
MVPSTFSRLKAARCLPVVLAALIFAGCGTHTPDQSTAYMQGTAQADSAFYLQQMQQSSDDTRINWQLLAIRALVKEGKTGQAVELFNQLPQELNDTQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVVAQVAAAPAADVAEQPQPQTVDGVASPAQASVSDLTGEQPAAQSVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRETTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 7526 - protein, 721 aa, Escherichia coli; identical to SEQ ID NO: 6807
  strain UM146

SEQ ID NO: 7527 - protein, 203 aa, Escherichia coli; identical to SEQ ID NO: 6414
  strain UM146

SEQ ID NO: 7528 - protein, 208 aa, Escherichia coli; identical to SEQ ID NO: 5869
  strain UM146

SEQ ID NO: 7529 - protein, 249 aa, Escherichia coli
  strain UM146
MNIMKSPLITTGMICLLGICNFAQATVSPDRTRIIFNASNKSATVRLTNQSKIDPYLAQSWIEDASGKKTRDYISTLPPMERIEPDEQIQIRLMALASLNDLPQDRETLFYYNVREIPPRAKEQNVMQIAMQSRLKLFWRPKAIELKEGEMIPLQKVTITRTAAGLTLNNPTPYHITVGYIGTNGKTLMPGADSIMVVPFTSATQHLSSLPSTFQLGFVADYGGLEMFKVECNSIQSLCQSSPAKKGKI

SEQ ID NO: 7530 - protein, 840 aa, Escherichia coli
  strain UM146
MNNKNTFSRDKLSHAIKNALSGVVCSLLFVLPVHAVEFNVDMIDAEDRENIDISRFEKKGYIPPGRYLVRVQINKNMLPQTLILEWVKADNESGSLLCLTKENLTNFGLNTEFIESLQNIAGSECLDLSQRQELTTRLDKATMILSLSVPQAWLKYQATNWTPPEFWDTGIAGFILDYNVYASQYAPHHGDSTQNVSSYGTLGFNLGAWRLRSDYQYNQNFADGRSVNRDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGLLDVTVEEEDGRTSTFQVGSASIPYLTRKGQVRYKTSLGKPTSVGHNDINNPFFWTAEASWGWLNNVSLYGGGMFTADDYQAITTGIGFNLNQFGSLSFDVTGADASLQQQNSGNLRGYSYRFNYAKHFESTGSQITFAGYRFSDKDYVSMSEYLSSRNGDESIDNEKESYVISLNQYFETLELNSYLNVTRNTYWDSASNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTATRHGIALHDYSYGDNARMMVDTDGISGIEINSNRTVTNGLGIAVIPSLSNYTTSMLRVNNNDLPEGVDVENSVIRTTLTQGAIGYAKLNATTGYQIVGVIRQENGRFPPLGVNVTDKATGKDVGLVAEDGFVYLSGIQENSTLHLTWGDNTCEVTPPNQSNISESAIILPCKTVK

SEQ ID NO: 7531 - protein, 222 aa, Escherichia coli
  strain UM146
MSKLGISSLFKTILLTAALAVSFTASAFTEGTDYMVLEKPIPNADKTLIKVFSYACPFCYKYDKAVTGPVSEKVKDIVAFTPFHLETKGEYGKQASEVFAVLINKDKAAGISLFDANSQFKKAKFAYYAAYHDKKERWSDGKDPAAFIKTGLDAAGMSQADFEAALKEPAVQETLKKWKASYDVAKIQGVPAYVVNGKYLIYTKSIKSIDAMADLIRELASK

SEQ ID NO: 7532 - protein, 715 aa, Escherichia coli; identical to SEQ ID NO: 6806
  strain UM146

SEQ ID NO: 7533 - protein, 673 aa, Escherichia coli
  strain UM146
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMSQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 7534 - protein, 334 aa, Escherichia coli
  strain UM146
MKKNQFLKESDVTAESVFFMKRRQVLKALGISAAALSLPHAAHADLLSWFKGNDRPPAPAGKALEFSKPAAWQNNLPLTPADKVSGYNNFYEFGLDKADPAANAGSLKTDPWTLKISGEVAKPLTLDHDDLTRRFPLEERIYRMRCVEAWSMVVPWIGFPLHKLLALAEPTSNAKYVAFETIYAPEQMPGQQDRFIGGGLKYPYVEGLRLDEAMHPLTLMTVGVYGKALPPQNGAPVRLIVPWKYGFKGIKSIVSIKLTRERPPTTWNLAAPDEYGFYANVNPHVDHPRWSQATERFIGSGGILNVQRQPTLLFNGYAEQVASLYRGLDLRENF

SEQ ID NO: 7535 - protein, 760 aa, Escherichia coli
  strain UM146
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNIYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 7536 - protein, 331 aa, Escherichia coli
  strain UM146
MKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPNKPYHGQIGFVSPTAEFTPKTVETPDLRTDLVYRLRIVVTDADDALRQGMPVTVQFGDEAGHE

SEQ ID NO: 7537 - protein, 713 aa, Escherichia coli; identical to SEQ ID NO: 6056
  strain UM146

SEQ ID NO: 7538 - protein, 360 aa, Escherichia coli; identical to SEQ ID NO: 5891
  strain UM146

SEQ ID NO: 7539 - protein, 430 aa, Escherichia coli; identical to SEQ ID NO: 5758
  strain UM146

SEQ ID NO: 7540 - protein, 614 aa, Escherichia coli
  strain UM146
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDHPGTEISAGWGSNSYQNYDVSTQQQLGDKTRVTLLGDYAHTHGYDVVAYGNTGTQAQPDNDGFLSKTLYGALEHNFTDVWSGFVRGYGYDNRTNYDAYYSPGLPLVDTRKLYSQSWDAGLRYNGELIKSQLITSYSHSKDYNYDPHYGRYDSSATLDEMKQYTVQWANNIIIGHGNIGAGVDWQKQSTAPGTAYVEDGYDQRNTGIYLTGLQQVGDFTFEGAGRSDDNSQFGRHGTWQTSAGWEFIEGYRFIASYGTSYKAPNLGQLYGTYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 7541 - protein, 445 aa, Escherichia coli
  strain UM146
MITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYTGSSSTNPYYGKAVSADFNGGSFGRGDSDEWTFGAQMEIWW

SEQ ID NO: 7542 - protein, 686 aa, Escherichia coli
  strain UM146
MFWRDMTLSIWRKKTTGLKTKKRLLPLMLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPVIGNLFKSTADKKEKRNLMVFIRPTILRDGMAADGVSQRKYNYMRAEQIYRDEQGLSLMPHTAQPILPAQNQALPPEVRAFLNAGRTR

SEQ ID NO: 7543 - protein, 359 aa, Escherichia coli; identical to SEQ ID NO: 5847
  strain UM146

SEQ ID NO: 7544 - protein, 118 aa, Escherichia coli [sequence omitted]

SEQ ID NO: 7545 - protein, 193 aa, Escherichia coli; identical to SEQ ID NO: 6300
  strain UM146

SEQ ID NO: 7546 - protein, 237 aa, Escherichia coli
  strain UM146
MRKITQALSAVCLLFALNSSAVALASSPSPLNPGTNVAKLAEQAPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPATNMNPVIFAGDKPGQNTKSQWLQDKNIRIFYGDSDNDITAARDVGARGIRILRASNSTYKPLPQAGAFGEEVIVNSEY

SEQ ID NO: 7547 - protein, 478 aa, Escherichia coli; identical to SEQ ID NO: 6796
  strain UM146

SEQ ID NO: 7548 - protein, 746 aa, Escherichia coli; identical to SEQ ID NO: 6783
  strain UM146

SEQ ID NO: 7549 - protein, 432 aa, Escherichia coli; identical to SEQ ID NO: 5727
  strain UM146

SEQ ID NO: 7550 - protein, 111 aa, Escherichia coli; identical to SEQ ID NO: 5889
  strain UM146

SEQ ID NO: 7551 - protein, 244 aa, Escherichia coli; identical to SEQ ID NO: 6111
  strain UM146

SEQ ID NO: 7552 - protein, 836 aa, Escherichia coli
  strain UM146
MKDRIPFAVNNITCVILLSLFCNAASAVEFNTDVLDAADKKNIDFTRFSEAGYVLPGQYLLDVIVNGQSISPASLQISFVEPALSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGMPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 7553 - protein, 844 aa, Escherichia coli
  strain UM146
MNANNLSCLIYCRCSLLLFAALGLTVTNHSFAAEEAEFDSEFLHLDKGINAIDIRRFSHGNPVPEGRYYSDIYVNNVWKGKADLQYLRTANTGAPTLCLTPELLSLIDLVKDTMSGNTSCFPASTGLSSARINFDLSTLRLNIEIPQALLNTRPRGYISPAQWQSGVPAAFINYDANYYQYSSSGTSNEQTYLGLKAGFNLWGWALRHRGSESWNNSYPAGYQNIETSIMHDLAPLRAQFTLGDFYTNGELMDSLSLRGVRLASDERMLPGSLRGYAPAVRGIANSNAKVTIYQNAHILYETTVPAGPFVINDLYPSGYAGDLLVKITESNGQTRMFTVPFAAVAQLIRPGFSRWQMSVGKYRYANKTYNDLIAQGTYQYGLTNDITLNSGLTTASGYTAGLAGLAFNTPLGAIASDITLSRTAFRYSGVTRKGYSLHSSYSINIPASNTNITLAAYRYSSKDFYHLKDALSANHNAFIDDVSVKSTAFYRPRNQFQISINQELGEKWGGMYLTGTTYNYWGHKGSRNEYQMGYSNFWKQLGYQIGLSQSRDNEQQRRDDRFYINFTLPLGGSVQSPVFSTVLNYSKEEKNSIQTSISGTGGEDNQFSYGISGNSQENGPSGYAMNGGYRSPYVNITTTVGHDTQNNNQRSFGASGAVVAHPYGVTLSNDLSDTFAIIHAEGAQGAVINNASGSRLDFWGNGVVPYVTPYEKNQISIDPSNLDLNVELSATEQEIIPRANSATLVKFDTKTGRSLLFDIRMSTGNPPPMASEVLDEHGQLAGYVAQAGKVFTRGLPEKGHLSVVWGPDNKDRCSFVYHVAHNKDDMQSQLVPVLCIQHPNQEKT

SEQ ID NO: 7554 - protein, 134 aa, Escherichia coli
  strain UM146
MFWIFQQSPGQKKDSDNSEQRNNNYLQLAIRSRIKFFFRPAHLKLTPNDAYLKVTWHQEEGRIKAVNPTPYYITYNKIAVDQNKHLTPVEHGGMIPPFSSTVFALKGRTAPASKVSWVIVNDYGGYQQGESVLE

SEQ ID NO: 7555 - protein, 1024 aa, Escherichia coli
  strain UM146
MPTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGSAENIGDNLGKAGSVLSTFQNFLGTALSSMKIDELIKKQKSGSNVSSSELAKASIELINQLVDTAASINNNVNSFSQQLNKLGSVLSNTKHLNGVGNKLQNLPNLDNIGAGLDTVSGILSAISASFILSNADADTGTKAAAGVELTTKVLGNVGKGISQYIIAQRAAQGLSTSAAAAGLIASVVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDMLIGELASVTRNGDKTLSGKSYIDYYEEGKRLERRPKEFQQQIFDPLKGNIDLSDSKSSTLLKFVTPLLTPGEEIRERRQSGKYEYITELLVKGVDKWTVKGVQDKGSVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGKNLTETDNLYSVEELIGTTRADKFFGSKFTDIFHGADGDDHIEGNDGNDRLYGDKGNDTLRGGNGDDQLYGGDGNDKLIGGTGNNYLNGGDGDDELQVQGNSLAKNVLSGGKGNDKLYGSEGADLLDGGEGNDLLKGGYGNDIYRYLSGYGHHIIDDEGGKDDKLSLADIDFRDVAFKREGNDLIMYKAEGNVLSIGHKNGITFKNWFEKESDDLSNHQIEQIFDKDGRVITPDSLKKAFEYQQSNNKVSYVYGHDASTYGSQDNLNPLINEISKIISAAGNFDVKEERSAASLLQLSGNASDFSYGRNSITLTASA

SEQ ID NO: 7556 - protein, 421 aa, Escherichia coli
  strain UM146
  MOD_RES (402)..(402): Any amino acid
MRSVIVAFLFACSFCVSAETVNLNNSSVRSFVQWYSSKTGKPVIVNPDIKGNVTVFNADVNPTNIDDFFKSVLNANGFVMLSGNPAVVSLPSKLPSQMVSDSDDSDNQSYDTFPSEPSYQPVPVALTVRNFKLTKVRSSDVQQLIKIYLDSNGGGNVVDYPGNNSLIVSAPDELLPVLSDFINSVDVARDQVLIQSLMFETSLSDGVDLSFAAGSASGHKVAGGFNTSALGSALSTAGGSFGIFDGNVLALSLRAVQSNSRSKVISTPRILTQSGQTGYISVGKNVPFITGKVTGESAGVNNPFQTIERHDVGVSLKVTPVVMGNGQLVLTIDTRADSISNDDQASDIITNQRQIQTTVQIKDGQTLLLGGLIDSSFSNAERSVPVISKIPLIGWIFSSKAXSNEQRIMYILLTAHIIRPL

SEQ ID NO: 7557 - protein, 239 aa, Escherichia coli; identical to SEQ ID NO: 5888
  strain UM146

SEQ ID NO: 7558 - protein, 883 aa, Escherichia coli
  strain UM146
MTAFRAAFKAYRMHQVLILPRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDNKEHSADKHVPDNSACTPLQDRLADASSEFDVGQQHLSLSVPQIYVGRMAHGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGNLQVTIKEADGSIQTLYVPYSSVPVLQRAGYTRYALAMGEYRSGNNLQSTPKFVQASLMHGLKGNWTPYGGMQIAEDYQAFNLGIGKDLGLFGAFSFDITQANTTLADDTRHSGQSVKFVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFHNSNASYSMSNDLKGGMTNLSGVYGTLLPDNNLNYSVQVGNTQGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVDYKLPVVSPGTLLNQQTAICR

SEQ ID NO: 7559 - protein, 700 aa, Escherichia coli
  strain UM146
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNRGVPEYGQKGELRRDERNLMWNVDPYLQTQWQLTDKLSLDAGVRYSSVWFDSNDHYVTPGNGDDSGDASYHKWLPAGSLKYAMTDAWNVYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMAFASIGYIPEDGWYAGTEARYMGDIMADDENTAKAPSYTLVGLFTGYKYNYHNLTVDLFGRVDNLFDKEYVGSVIVNESNGRYYEPAPGRNYGVGINIAWRFE

SEQ ID NO: 7560 - protein, 351 aa, Escherichia coli
  strain UM146
MKKSTLALVVMGIVASVSVQAAEIYNKDGNKLDVYGKVKAMHYMSDNDSKDGDQSYIRFGFKGETQINVQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPISGGFANKTQNFEAVAQYQFDFGLRPSLGYVLSKGKDIEGIGDEDLVNYVDVGATYYFNKNMSAFVDYKINQLDSDNKLNINNDDIVAVGMTYQF

SEQ ID NO: 7561 - protein, 368 aa, Escherichia coli
  strain UM146
MNKTITALTIIMASFATNASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTTIDKINAHYFDKKAEDYFFNKFLLSFDPSTQQWSYAGESPWYGTAGAAVVNKGDKTWLINGEAKPGLRTDAVFELDFTGNNLKWNKLAPVASPDGVAGGFAGMSNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 7562 - protein, 241 aa, Escherichia coli; identical to SEQ ID NO: 6139
  strain UM146

SEQ ID NO: 7563 - protein, 878 aa, Escherichia coli
  strain UM146
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAQLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 7564 - protein, 539 aa, Escherichia coli
  strain UM146
MAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKNQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 7565 - protein, 518 aa, Escherichia coli
  strain UM146
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKDTKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 7566 - protein, 654 aa, Escherichia coli; identical to SEQ ID NO: 6816
  strain UM146

SEQ ID NO: 7567 - protein, 900 aa, Escherichia coli
  strain UM146
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSTSNTPASNTPANGASATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEITQYGNPASCSVKPDNNGGAVTPVDPTPETPETPVTPTPDNNEPSTPADSSNDYSLQAWSGQEGSEIYHVIFNGNVYQNAWWVGSEDCPRGTSVENSNNPWRLVRTATAAEMSQYGNPTTCEIDNGGVIIADGFQASKAYSANSIVDYNDAHYKTSVDQDAWGFVPGGDNPWKKYEPAKAWSASTVYVKGDRVVVDGQAYEALFWTQSDNPALIANQNATGSNSRPWKPLGKTQSYSNEELNNAPQFNPETLYASDTLIRFNGENYISQSKVQKVSPSDSNPWRVFVDWTGTKERVGTPKKAWPKHVYAPYVDFTLNTIPDLAALAKSHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 7568 - protein, 784 aa, Escherichia coli; identical to SEQ ID NO: 6829
  strain UM146

SEQ ID NO: 7569 - protein, 386 aa, Escherichia coli; identical to SEQ ID NO: 5860
  strain UM146

SEQ ID NO: 7570 - protein, 230 aa, Escherichia coli
  strain UM146
MIGGTRFAYPENQSSISVELKNTSDRDMLVKVAVSPDDARQLTGTVESLPSYSETVFIATPPLFVLKPDKNTKIRINRVGGSLSADRESLFILNVAALPTLENSHSVKTDNQLQIAVRNRMKIFYRPSNLSEDPNMSYQKLRWARKNEIVTVYNPGPRYVTLYNLHVDGKVIDGGMVAPFSHRQQSWCKSQGVCEIAWQTLDVYNNVLPAWKVKMNLLQMDVSGLQVKTD

SEQ ID NO: 7571 - protein, 170 aa, Escherichia coli; identical to SEQ ID NO: 5855
  strain UM146

SEQ ID NO: 7572 - protein, 119 aa, Escherichia coli; identical to SEQ ID NO: 5803
  strain UM146

SEQ ID NO: 7573 - protein, 656 aa, Escherichia coli
  strain UM146
MYMNVIRNVICTLIILPIGLQAETSHSSMAKDTITVVATGNQNTVFETPSMVSVVTNDTPWSQNAVTSAGMLKGVAGLSQTGAGRTNGQTFNLRGYDKSGVLVLVDGIRQLSDMAKSSGTYLDPALVKRIEVVRGPNSSLYGSGGLGGVVDFRTADAADFLPPGETNGLSLWGNIASGDHSTGSGLTWFGKTGKTDALLSVIMRKRGNIYQSDGERAPNKEKPAALFAKGSVGITDSNKAGASLRLYRNNTTEPGNPTQTHGDSGLRDRKTVQNDVQFWYQYAPVDNSLINVKSTLYLSDITIKTNGHNKTAEWRNNRTSGVNVVNRSHTLIFPGAHQLSYGAEYYRQQQKPEGSATLYPEGNIDFTSLYFQDEMTMKSYPVNIIVGSRYDRYKSFNPRAGELKAERLSPRAAISVSPTDWLMMYGSISSAFRAPTMAEMYRDDVHFYRKGKPNYWVPNLNLKPENNITREIGAGIQLDGLLTGNDRLQLKGGYFGTDARNYIATRVDMKRMRSYSYNVSRARIWGWDMQGNYQSDYFDWMLSYNRTESMDASSREWLGSGNPDTLISDISIPVGHGGVSAGWRAELSAAATHVKKGDPHQAGYAVHSFSLSYKPVSVKGFEASVTLDNAFNKLAMNGKGVPLSGRTVSLYTRYQW

SEQ ID NO: 7574 - protein, 753 aa, Escherichia coli; identical to SEQ ID NO: 5801
  strain UM146

SEQ ID NO: 7575 - protein, 119 aa, Escherichia coli; identical to SEQ ID NO: 5803
  strain UTI89 / UPEC

SEQ ID NO: 7576 - protein, 656 aa, Escherichia coli; identical to SEQ ID NO: 7573
  strain UTI89 / UPEC

SEQ ID NO: 7577 - protein, 753 aa, Escherichia coli; identical to SEQ ID NO: 5801
  strain UTI89 / UPEC

SEQ ID NO: 7578 - protein, 878 aa, Escherichia coli; identical to SEQ ID NO: 7563
  strain UTI89 / UPEC

SEQ ID NO: 7579 - protein, 241 aa, Escherichia coli; identical to SEQ ID NO: 6139
  strain UTI89 / UPEC

SEQ ID NO: 7580 - protein, 368 aa, Escherichia coli; identical to SEQ ID NO: 7561
  strain UTI89 / UPEC

SEQ ID NO: 7581 - protein, 1024 aa, Escherichia coli; identical to SEQ ID NO: 7555
  strain UTI89 / UPEC

SEQ ID NO: 7582 - protein, 241 aa, Escherichia coli
  strain UTI89 / UPEC
MLRFVLFFFTLSVSAVVQGSVVIMGTRVVYPATQKSISIRLNNDNESPALVQSWLDDGDAAAPPESVHVPFIITPPIFRMDSKSGQTVRIVYTGESLPKDRESLFYLNVLDIPAKPRAKKDSDNSEQRNNNYLQLAIRSRIKFFFRPAHLKLTPNDAYLKVTWHQEEGRIKAVNPTPYYITYNKIAVDQNKHLTPVEHGGMIPPFSSTVFALKGRTAPASKVSWVIVNDYGGYQQGESVLE

SEQ ID NO: 7583 - protein, 861 aa, Escherichia coli
  strain UTI89 / UPEC
MITEDISKENLFWSKVIMNANNLSCLIYCRCSLLLFAALGLTVTNHSFAAEEAEFDSEFLHLDKGINAIDIRRFSHGNPVPEGRYYSDIYVNNVWKGKADLQYLRTANTGAPTLCLTPELLSLIDLVKDTMSGNTSCFPASTGLSSARINFDLSTLRLNIEIPQALLNTRPRGYISPAQWQSGVPAAFINYDANYYQYSSSGTSNEQTYLGLKAGFNLWGWALRHRGSESWNNSYPAGYQNIETSIMHDLAPLRAQFTLGDFYTNGELMDSLSLRGVRLASDERMLPGSLRGYAPAVRGIANSNAKVTIYQNAHILYETTVPAGPFVINDLYPSGYAGDLLVKITESNGQTRMFTVPFAAVAQLIRPGFSRWQMSVGKYRYANKTYNDLIAQGTYQYGLTNDITLNSGLTTASGYTAGLAGLAFNTPLGAIASDITLSRTAFRYSGVTRKGYSLHSSYSINIPASNTNITLAAYRYSSKDFYHLKDALSANHNAFIDDVSVKSTAFYRPRNQFQISINQELGEKWGGMYLTGTTYNYWGHKGSRNEYQMGYSNFWKQLGYQIGLSQSRDNEQQRRDDRFYINFTLPLGGSVQSPVFSTVLNYSKEEKNSIQTSISGTGGEDNQFSYGISGNSQENGPSGYAMNGGYRSPYVNITTTVGHDTQNNNQRSFGASGAVVAHPYGVTLSNDLSDTFAIIHAEGAQGAVINNASGSRLDFWGNGVVPYVTPYEKNQISIDPSNLDLNVELSATEQEIIPRANSATLVKFDTKTGRSLLFDIRMSTGNPPPMASEVLDEHGQLAGYVAQAGKVFTRGLPEKGHLSVVWGPDNKDRCSFVYHVAHNKDDMQSQLVPVLCIQHPNQEKT

SEQ ID NO: 7584 - protein, 836 aa, Escherichia coli; identical to SEQ ID NO: 7552
  strain UTI89 / UPEC

SEQ ID NO: 7585 - protein, 239 aa, Escherichia coli; identical to SEQ ID NO: 5991
  strain UTI89 / UPEC

SEQ ID NO: 7586 - protein, 478 aa, Escherichia coli; identical to SEQ ID NO: 6796
  strain UTI89 / UPEC

SEQ ID NO: 7587 - protein, 237 aa, Escherichia coli; identical to SEQ ID NO: 7546
  strain UTI89 / UPEC

SEQ ID NO: 7588 - protein, 446 aa, Escherichia coli; identical to SEQ ID NO: 5873
  strain UTI89 / UPEC

SEQ ID NO: 7589 - protein, 614 aa, Escherichia coli; identical to SEQ ID NO: 7540
  strain UTI89 / UPEC

SEQ ID NO: 7590 - protein, 208 aa, Escherichia coli; identical to SEQ ID NO: 5869
  strain UTI89 / UPEC

SEQ ID NO: 7591 - protein, 538 aa, Escherichia coli
  strain UTI89 / UPEC
MFRRNIITSAILLMAPLAFSAQSLAESLTVEQRLELLEKALRETQSELKKYKDEEKKKYTPATVNRSVSTNDQGYAANPFPTSRAAKPDAVLVKNEEKNASETGSIYSSMTLKDFSKFVKDEIGFSYNGYYRSGWGTASHGSPKSWAIGSLGRFGNEYSGWFDLQLKQRVYNENGKRVDAIVMMDGNVGQQYSTGWFGDNAGGENFMQFSDMYVTTKGFLPFAPEADFWVGKHGAPKIEIQMLDWKTQRTDAAAGVGLENWKVGPGKIDIALVREDVDDYDRSLQNKQQINTNTIDLRYKDIPLWDKVTLMVSGRYVTANESASEKDNQDNNGYYDWKDTWMFGTSLTQKFDKGGFNEFSFLVANNSIASNFGRYAGASPFTTFNGRYYGYHTGGTAVRLTSQGEAYIGDHFIVANAIVYSFGNDIYSYETGAHSDFESIRAVVRPAYIWDQYNQTGVELGYFTQQNKDANSNKFNESGYKTTLFHTFKVNTSMLTSRPEIRFYATYIKALENELDGFTFEDNKDDQFAVGAQAEIWW

SEQ ID NO: 7592 - protein, 660 aa, Escherichia coli; identical to SEQ ID NO: 6109
  strain UTI89 / UPEC

SEQ ID NO: 7593 - protein, 438 aa, Escherichia coli
  strain UTI89 / UPEC
MKPLRYTASALALGLALMANAQAVTTIPFWHSMEGELGKEVDSLAQRFNAENPDYKIVPTYKGNYEQNLSAGIAAFRTGNAPAILQVYEVGTATMMASKAIKPVYDVFKEAGIQFDESQFVPTVSGYYSDSKTGHLLSQPFNSSTPVLYYNKDAFKKAGLDPEQPPKTWQDLADYAAKLKASGMKCGYASGWQGWIQLENFSAWNGLPFASKNNGFDGTDAVLEFNKPEQVKHIAMLEEMNKKGDFSYVGRKDESTEKFYNGDCAMTTASSGSLANIREYAKFNYGVGMMPYDADAKDAPQNAIIGGASLWVMQGKDKETYTGVAKFLDFLAKPENAAEWHQKTGYLPITKAAYDLTREQGFYEKNPGADIATRQMLNKPPLPFTKGLRLGNMPQIRVIVDEELESVWTGKKTPQQALDTAVERGNQLLRRFEKSTKS

SEQ ID NO: 7594 - protein, 259 aa, Escherichia coli; identical to SEQ ID NO: 6832
  strain UTI89 / UPEC

SEQ ID NO: 7595 - protein, 266 aa, Escherichia coli
  strain UTI89 / UPEC
MSNQGMQMRQYRLLSPMIKVVIVLFSLLFSTAQAGLVIGGTRFAYPENQSSISVELKNTSDRDMLVKVAVSPDDARQLTGTVESLPSYSETVFIATPPLFVLKPDKNTKIRINRVGGSLSADRESLFILNVAALPTLENSHSVKTDNQLQIAVRNRMKIFYRPSNLSEDPNMSYQKLRWARKNEIVTVYNPGPRYVTLYNLHVDGKVIDGGMVAPFSHRQQSWCKSQGVCEIAWQTLDVYNNVLPAWKVKMNLLQMDVSGLQVKTD

SEQ ID NO: 7596 - protein, 412 aa, Escherichia coli
  strain UTI89 / UPEC
MKQWIAALLLMLIPGVQAAKPQKVTLMVDDVPVAQVLQVLAEQEKLNLVVSPDVSGTVSLHLTDVPWKQALQTVVKSAGLITRQEGNILSVHSVAWQNDNIARQEAEQTRAQANLPLENRNITLQYADAGELAKAGEKLLSAKGSMTVDKRTNRLLLRDNKTALSTLEQWVSQMDLPVGQVELSAHIVTINEKSLRELGVKWTLADAQQAGGVGQVTTLGSDLSVATATTHIGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 7597 - protein, 900 aa, Escherichia coli; identical to SEQ ID NO: 7567
  strain UTI89 / UPEC

SEQ ID NO: 7598 - protein, 654 aa, Escherichia coli; identical to SEQ ID NO: 6816
  strain UTI89 / UPEC

SEQ ID NO: 7599 - protein, 249 aa, Escherichia coli; identical to SEQ ID NO: 7529
  strain UTI89 / UPEC

SEQ ID NO: 7600 - protein, 840 aa, Escherichia coli; identical to SEQ ID NO: 7530
  strain UTI89 / UPEC

SEQ ID NO: 7601 - protein, 222 aa, Escherichia coli; identical to SEQ ID NO: 7531
  strain UTI89 / UPEC

SEQ ID NO: 7602 - protein, 713 aa, Escherichia coli; identical to SEQ ID NO: 6056
  strain UTI89 / UPEC

SEQ ID NO: 7603 - protein, 686 aa, Escherichia coli; identical to SEQ ID NO: 7542
  strain UTI89 / UPEC

SEQ ID NO: 7604 - protein, 359 aa, Escherichia coli; identical to SEQ ID NO: 5847
  strain UTI89 / UPEC

SEQ ID NO: 7605 - protein, 432 aa, Escherichia coli; identical to SEQ ID NO: 5727
  strain UTI89 / UPEC

SEQ ID NO: 7606 - protein, 518 aa, Escherichia coli; identical to SEQ ID NO: 7565
  strain UTI89 / UPEC

SEQ ID NO: 7607 - protein, 884 aa, Escherichia coli
  strain UTI89 / UPEC
MCMPNHSNFRLRGIACYIALAISGGSVNAWADDSIQFDPRFLELKGDTKIDLGKFSKKGYVDAGKYNLRVFINKQPLSDEYDINWYVSENDPTKNYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKNWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSVDGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNAGEHMMVFWEGSAQCEIVLPKPLPADLFSGLLLPCEQKGTAAPDSSAPEIKPVIQDQTRQVTPTEAPTSISATQ

SEQ ID NO: 7608 - protein, 250 aa, Escherichia coli; identical to SEQ ID NO: 7503
  strain UTI89 / UPEC

SEQ ID NO: 7609 - protein, 274 aa, Escherichia coli; identical to SEQ ID NO: 5899
  strain UTI89 / UPEC

SEQ ID NO: 7610 - protein, 200 aa, Escherichia coli; identical to SEQ ID NO: 5898
  strain UTI89 / UPEC

SEQ ID NO: 7611 - protein, 363 aa, Escherichia coli; identical to SEQ ID NO: 7508
  strain UTI89 / UPEC

SEQ ID NO: 7612 - protein, 162 aa, Escherichia coli; identical to SEQ ID NO: 7509
  strain UTI89 / UPEC

SEQ ID NO: 7613 - protein, 828 aa, Escherichia coli; identical to SEQ ID NO: 7510
  strain UTI89 / UPEC

SEQ ID NO: 7614 - protein, 690 aa, Escherichia coli
  strain UTI89 / UPEC
MLPYARGRKEDVSDTHFIFVVTSWRYGMFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 7615 - protein, 224 aa, Escherichia coli; identical to SEQ ID NO: 5893
  strain UTI89 / UPEC

SEQ ID NO: 7616 - protein, 831 aa, Escherichia coli
  strain UTI89 / UPEC
MQELPMLRMPPLASAIVALLIGIEAYAAEETFDTHFMIGGMKDQQVSNIRLEDNQPLPGQYDIDIYVNKQWRGKYEIIVKDNPQETCLSREMIKRLGINTDSFASGKQCLTFKQLIQGGSYTWDIGVFRLDFSVPQAWVEELESGYVPPENWERGINAFYTSYYMSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQVGHQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESRNYICQ

SEQ ID NO: 7617 - protein, 721 aa, Escherichia coli; identical to SEQ ID NO: 6807
  strain UTI89 / UPEC

SEQ ID NO: 7618 - protein, 715 aa, Escherichia coli; identical to SEQ ID NO: 6806
  strain UTI89 / UPEC

SEQ ID NO: 7619 - protein, 673 aa, Escherichia coli; identical to SEQ ID NO: 7533
  strain UTI89 / UPEC

SEQ ID NO: 7620 - protein, 334 aa, Escherichia coli; identical to SEQ ID NO: 7534
  strain UTI89 / UPEC

SEQ ID NO: 7621 - protein, 342 aa, Escherichia coli
  strain UTI89 / UPEC
MSAQAAEIYNKDSNKLDLYGKVNAKHYFSSNDADDGDTTYVRLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNDQVIYGNNSLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVGLVYQF

SEQ ID NO: 7622 - protein, 122 aa, Escherichia coli; identical to SEQ ID NO: 5737
  strain UTI89 / UPEC

SEQ ID NO: 7623 - protein, 111 aa, Escherichia coli; identical to SEQ ID NO: 5889
  strain UTI89 / UPEC

SEQ ID NO: 7624 - protein, 236 aa, Escherichia coli
  strain UTI89 / UPEC
MQTTRTPYSVSFMATVLLLLLFACHSTIANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTHLAMAPEEAPAMLRFRRSGSKLTLINPTPYFITVTNMKAGNSNLPNTMVPPKGEVSVDIPHAVTGDISFQTINDYGALTPRIKATMQ

SEQ ID NO: 7625 - protein, 516 aa, Escherichia coli
  strain UTI89 / UPEC
MTAFRAAFKAYRMHQVLILPRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDNKEHSADKHVPDNSACTPLQDRLADASSEFDVGQQHLSLSVPQIYVGRMAHGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGNLQVTIKEADGSIQTLYVPYSSVPVLQRAGYTRYALAMGEYRSGNNLQSTPKFVQASLMHGLKGNWTPYGGMQIAEDYQAFNLGIGKDLGLFGAFSFDITQANTTLADDTRHSGQSVKFVYSKSFYQTGTNIQVAGYRYSTQGFYNLSDSAYSRMSGYTDYFVINRLSD

SEQ ID NO: 7626 - protein, 700 aa, Escherichia coli; identical to SEQ ID NO: 7559
  strain UTI89 / UPEC

SEQ ID NO: 7627 - protein, 551 aa, Escherichia coli; identical to SEQ ID NO: 5885
  strain UTI89 / UPEC

SEQ ID NO: 7628 - protein, 229 aa, Escherichia coli
  strain UTI89 / UPEC
MANGNASIKGYNCNVSQGLVIIMPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTSDDAEEMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 7629 - protein, 565 aa, Escherichia coli; identical to SEQ ID NO: 7493
  strain UTI89 / UPEC

SEQ ID NO: 7630 - protein, 663 aa, Escherichia coli
  strain UTI89 / UPEC
MLNGIYSMRLKKRYLCTVLTLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 7631 - protein, 203 aa, Escherichia coli; identical to SEQ ID NO: 7450
  strain UTI89 / UPEC

SEQ ID NO: 7632 - protein, 380 aa, Escherichia coli; identical to SEQ ID NO: 7505
  strain UTI89 / UPEC

SEQ ID NO: 7633 - protein, 214 aa, Escherichia coli
  strain UTI89 / UPEC
MMTKMSRYALITALAMFLAGCVGQREPAPVEEVKPAPEQPAEPQQPVPTVPSVPTIPQQPGPIEHEDQTAPPAPHIRHYDWNGAMQPMVSKMLGADGVTAGSVLLVDSVNNRTNGSLNAAEATETLRNALANNGKFTLVSAQQLSMAKQQLGLSPQDSLGTRSKAIGIARNVGAHYVLYSSASGNVNAPTLQMQLMLVQTGEIIWSGKGAVSQQ

SEQ ID NO: 7634 - protein, 729 aa, Escherichia coli; identical to SEQ ID NO: 6821
  strain UTI89 / UPEC

SEQ ID NO: 7635 - protein, 366 aa, Escherichia coli; identical to SEQ ID NO: 7513
  strain UTI89 / UPEC

SEQ ID NO: 7636 - protein, 237 aa, Escherichia coli
  strain UTI89 / UPEC
MKMIAMQKNAAHTYAISSLLVLSLTGCAWIPSTPLVQGATSAQPVPGPTPVANGSIFQSAQPINYGYQPLFEDRRPRNIGDTLTIVLQENVSASKSSSANASRDGKTNFGFDTVPRYLQGLFGNARADVEASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 7637 - protein, 191 aa, Escherichia coli; identical to SEQ ID NO: 5748
  strain UTI89 / UPEC

SEQ ID NO: 7638 - protein, 517 aa, Escherichia coli; identical to SEQ ID NO: 6817
  strain UTI89 / UPEC

SEQ ID NO: 7639 - protein, 656 aa, Escherichia coli; identical to SEQ ID NO: 7518
  strain UTI89 / UPEC

SEQ ID NO: 7640 - protein, 725 aa, Escherichia coli; identical to SEQ ID NO: 6197
  strain UTI89 / UPEC

SEQ ID NO: 7641 - protein, 892 aa, Escherichia coli
  strain UTI89 / UPEC
MCLAADFIFSLSVGADMFSGDGGQLLSDKSLTGSAGGGNNRMKFNILPLAFFIGIIVSPARAELYFNPRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQLYMSNQARGYIAPEYWDNGITAALLNYDFSGNRVRDSYGGTSDYAYLNLKTGLNIGSWRLRDNTSWSYSAGKGYSQNNWQHINTWLERDIVPLRSRLTMGDSYTRGDIFDGVNFRGIQLASDDNMVPDSQRGYAPTIHGISRGTSRISIRQNGYEIYQSTLPPGPFEINDIYPAGSGGDLQVTLQEADGSVQRFNVPWSSVPVLQREGHLKYALSAGEFRSGGHQQDNPRFAEGTLKYGLPAGWTVYGGAWIAERYRAFNLGMGKNMGWLGAVSLDATRANARLPDESRHDGQSYRFLYNKSLTETGTNIQLIGYRYSTRGYFSFADTAWKKMSGYSVLTQDGVIQIQPKYTDYYNLAYNKRGRVQVSISQQTGESSTLYLSGSHQSYWGTDRTDRQLNAGFNSSVNDISWSLNYSLSRNAWQHETDRILSFDVSIPFSHWMRSDSTSAWRNASARYSQTLEAHGQAASTAGLYGTSLGDNNLGYSIQSGYTRGGYEGSSKTGYASLNYRGGYGNASAGYSHSGGYRQLYYGLSGGILAHANGLTLSQPLGDTLILVRAPGASDTRIENQTGVSTDWRGYAVLPYATDYRENRVALDTNTLADNVDIENTVVSVVPTHGAVVRADYKTRVGVKVLMTLMRNGKAVPFGSVVTARNGGSSIAGENGQVYLSGMPLSGQVSVKWGSQTTDQCTADYKLPKESAGQILSHVTVSCR

SEQ ID NO: 7642 - protein, 231 aa, Escherichia coli; identical to SEQ ID NO: 7521
  strain UTI89 / UPEC

SEQ ID NO: 7643 - protein, 423 aa, Escherichia coli
  strain UTI89 / UPEC
MQYEDENGVNEPSRRRLLKGIGALALAGSCPVAHAQKTQSAPGTLSPDARNEKQPFYGEHQAGILTPQQAAMMLVAFDVLASDKADLERLFRLLTQRFAFLTQGGAAPETPNPRLPPLDSGILGGYIAPDNLTITLSVGHSLFDERFGLAPQMPKKLQKMTRFPNDSLDAALCHGDVLLQICANTQDTVIHALRDIIKHTPDLLSVRWKREGFISDHAARSKGKETPINLLGFKDGTANPDSQNDKLMQKVVWVTADQQEPAWTIGGSYQAVRLIQFRVEFWDRTPLKEQQTIFGRDKQTGAPLGMLHEHDVPDYASDPEGKVIALDSHIRLANPRTAESESSLMLRRGYSYSLGVTNSGQLDMGLLFVCYQHDLEKGFLTVQKRLNGEALEEYVKPIGGGYFFALPGVKDANDYLGSALLRV

SEQ ID NO: 7644 - protein, 375 aa, Escherichia coli
  strain UTI89 / UPEC
MTINFRRNALQLSVAALFSSAFMANAADIPQVKVTVTDKQCEPMTITVNAGKTQFIIQNHSQKALEWEILKGVMVVEERENIAPGFSQKMTANLQPGEYDMTCGLLTNPKGKLIVKGEATADAAQSDALLSLGGAITAYKAYVMAETTQLVTDTKAFTDAIKAGDIEKAKALYAPTRQHYERIEPIAELFSDLDGSIDAREDDYEQKAADPKFTGFHRLEKALFGDNTTKGMDKYADQLYTDVVDLQKRISELAFPPSKVVGGAAGLIEEVAASKISGEEDRYSHTDLWDFQANVEGSQKIVDLLRPQLQKANPELLAKVDANFKKVDTILAKYRTKDGFENYDKLTDADRNALKGPITALAEDLAQLRGVLGLD

SEQ ID NO: 7645 - protein, 362 aa, Escherichia coli; identical to SEQ ID NO: 5874
  strain UTI89 / UPEC

SEQ ID NO: 7646 - protein, 204 aa, Escherichia coli; identical to SEQ ID NO: 5755
  strain UTI89 / UPEC

SEQ ID NO: 7647 - protein, 512 aa, Escherichia coli
  strain UTI89 / UPEC
MARAVHRSGLVALGIATALMASCAFAAKEVVVAVGSNFTTLDPYDANDTLSQAVAKSFYQGLFGLDKEMKLKNVLAESYTVSDDGLTYTVKLREGIKFQDGTDFNAAAVKANLDRASDPANHLKRYNLYKNIAKTEAIDPTTVKITLKQPFSAFINILAHPATAMISPAALEKYGKEIGFHPVGTGPYELDTWNQTDFVKVKKFAGYWQPGLPKLDSITWRPVADNNTRAAMLQTGEAQFAFPIPYEQAALLEKNKNIELMASPSIMQRYISMNVTQKPFDNPKVREALNYAINRPALVKVAFAGYATPATGVVPPSIAYAQSYKPWPYDPVKARELLKEAGYPNGFSTTLWSSHNHSTAQKVLQFTQQQLAQVGIKAQVTAMDAGQRAAEVEGKGQKESGVRMFYTGWSASTGEADWALSPLFASQNWPPTLFNTAFYSNKQVDDFLAQALKTNDPAEKTRLYKAAQDIIWQESPWIPLVVEKLVSAHSKNLTGFWIMPDTGFSFEDADLQ

SEQ ID NO: 7648 - protein, 760 aa, Escherichia coli; identical to SEQ ID NO: 7535
  strain UTI89 / UPEC

SEQ ID NO: 7649 - protein, 332 aa, Escherichia coli
  strain UTI89 / UPEC
MMKKPVVIGLAVVVLAAVVAGGYWWYQSRQDNGLTLYGNVDIRTVNLSFRVGGRVESLAVDEGDAIKAGQVLGELDHNPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPNKPYHGQIGFVSPTAEFTPKTVETPDLRTDLVYRLRIVVTDADDALRQGMPVTVQFGDEAGHE

SEQ ID NO: 7650 - protein, 430 aa, Escherichia coli; identical to SEQ ID NO: 5758
  strain UTI89 / UPEC

SEQ ID NO: 7651 - protein, 193 aa, Escherichia coli; identical to SEQ ID NO: 6300
  strain UTI89 / UPEC

SEQ ID NO: 7652 - protein, 186 aa, Escherichia coli
  strain UTI89 / UPEC
MNVSKYVAIFFFVFIQLISVGKVFANADEWMTTFRENIAQTWQQPEHYDLYIPAITWHARFAYDKEKTDRYNERPWGGGFGQSRWDEKGNWHGLYAMAFKDSWNKWEPIAGYGWESTRRPLADENFHLGLGFTAGVTARDNWNYIPLPVLLPLASVGYGPATFQMTYIPGTYNNGNVYFAWMRFQF

SEQ ID NO: 7653 - protein, 746 aa, Escherichia coli; identical to SEQ ID NO: 6783
  strain UTI89 / UPEC

SEQ ID NO: 7654 - protein, 353 aa, Escherichia coli
  strain UTI89 / UPEC
MKMKKSTLALVVMGIVASVSVQAAEIYNKDGNKLDVYGKVKAMHYMSDNDSKDGDQSYIRFGFKGETQINVQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPISGGFANKTQNFEAVAQYQFDFGLRPSLGYVLSKGKDIEGIGDEDLVNYVDVGATYYFNKNMSAFVDYKINQLDSDNKLNINNDDIVAVGMTYQF

SEQ ID NO: 7655 - protein, 161 aa, Escherichia coli; identical to SEQ ID NO: 5769
  strain UTI89 / UPEC

SEQ ID NO: 7656 - protein, 810 aa, Escherichia coli; identical to SEQ ID NO: 6345
  strain UTI89 / UPEC

SEQ ID NO: 7657 - protein, 266 aa, Escherichia coli; identical to SEQ ID NO: 7500
  strain UTI89 / UPEC

SEQ ID NO: 7658 - protein, 747 aa, Escherichia coli; identical to SEQ ID NO: 7499
  strain UTI89 / UPEC

SEQ ID NO: 7659 - protein, 246 aa, Escherichia coli; identical to SEQ ID NO: 5857
  strain UTI89 / UPEC

SEQ ID NO: 7660 - protein, 862 aa, Escherichia coli; identical to SEQ ID NO: 7497
  strain UTI89 / UPEC

SEQ ID NO: 7661 - protein, 170 aa, Escherichia coli; identical to SEQ ID NO: 5855
  strain UTI89 / UPEC

SEQ ID NO: 7662 - protein, 784 aa, Escherichia coli; identical to SEQ ID NO: 6829
  strain UTI89 / UPEC

SEQ ID NO: 7663 - protein, 428 aa, Escherichia coli; identical to SEQ ID NO: 7118
  strain UTI89 / UPEC

SEQ ID NO: 7664 - protein, 412 aa, Escherichia coli 101-1; identical to SEQ ID NO: 6495

SEQ ID NO: 7665 - protein, 826 aa, Escherichia coli 101-1; identical to SEQ ID NO: 6373

SEQ ID NO: 7666 - protein, 239 aa, Escherichia coli 101-1; identical to SEQ ID NO: 6428

SEQ ID NO: 7667 - protein, 641 aa, Escherichia coli 101-1
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 7668 - protein, 828 aa, Escherichia coli 101-1; identical to SEQ ID NO: 6558

SEQ ID NO: 7669 - protein, 162 aa, Escherichia coli 101-1; identical to SEQ ID NO: 6365

SEQ ID NO: 7670 - protein, 367 aa, Escherichia coli 101-1; identical to SEQ ID NO: 5789

SEQ ID NO: 7671 - protein, 200 aa, Escherichia coli 101-1; identical to SEQ ID NO: 6363

SEQ ID NO: 7672 - protein, 274 aa, Escherichia coli 101-1; identical to SEQ ID NO: 6362

SEQ ID NO: 7673 - protein, 250 aa, Escherichia coli 101-1; identical to SEQ ID NO: 6714

SEQ ID NO: 7674 - protein, 881 aa, Escherichia coli 101-1; identical to SEQ ID NO: 6713

SEQ ID NO: 7675 - protein, 236 aa, Escherichia coli 101-1; identical to SEQ ID NO: 6472

SEQ ID NO: 7676 - protein, 111 aa, Escherichia coli 101-1
MKKQIEGMTMKKVLALVVAAAMGLSSAAFAAETATTPAPTATTTKAAPAKTTHHKKQHKAAPAQKAQAAKKHHKNAKAEQKAPEQKAQAAKKHAGKHSHQQPAKPAAQPAA

SEQ ID NO: 7677 - protein, 539 aa, Escherichia coli 101-1; identical to SEQ ID NO: 6391

SEQ ID NO: 7678 - protein, 700 aa, Escherichia coli 101-1; identical to SEQ ID NO: 6678

SEQ ID NO: 7679 - protein, 249 aa, Escherichia coli 101-1; identical to SEQ ID NO: 6407

SEQ ID NO: 7680 - protein, 834 aa, Escherichia coli 101-1
MYKKLKLTTISELIKNIYCSLSVIIIGCASAYAVEFNKDLIEAEDRENVNLSQFETDGQLPVGKYSLSTLINNKRTPIHLDLQWVLIDNQTAVCVTPEQLTLLGFTDEFIEKTQQNLIDGCYPIEKEKQITTYLDKGKMQLSISAPQAWLKYKDANWTPPELWNHGIAGAFLDYNLYASHYAPHQGDNSQNISSYGQAGVNLGAWRLRTDYQYDQSFNNGKSQATNLDFPRIYLFRPIPAMNAKLTIGQYDTESSIFDSFHFSGISLKSDENMLPPDLRGYAPQITGVAQTNAKVTVSQNNRIIYQENVPPGPFAITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNEISHTASWYDSSDRNNSWSVSASGDNDEFKDMKASLRASYQHNTENGRLYLSGTSQRDSYYSLNASWNGSFTATRHGAAFHDYSGSADSRFMIDADGTEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTAILPCISQN

SEQ ID NO: 7681 - protein, 686 aa, Escherichia coli 101-1; identical to SEQ ID NO: 6339

SEQ ID NO: 7682 - protein, 359 aa, Escherichia coli 101-1; identical to SEQ ID NO: 5847

SEQ ID NO: 7683 - protein, 203 aa, Escherichia coli 101-1; identical to SEQ ID NO: 6396

SEQ ID NO: 7684 - protein, 565 aa, Escherichia coli 101-1; identical to SEQ ID NO: 6395

SEQ ID NO: 7685 - protein, 207 aa, Escherichia coli 101-1; identical to SEQ ID NO: 5743

SEQ ID NO: 7686 - protein, 446 aa, Escherichia coli 101-1 [sequence omitted]

SEQ ID NO: 7687 - protein, 478 aa, Escherichia coli 101-1; identical to SEQ ID NO: 5711

SEQ ID NO: 7688 - protein, 869 aa, Escherichia coli 101-1
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRFYSSDNMYPDSQQGFAPTVHGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 7689 - protein, 230 aa, Escherichia coli 101-1; identical to SEQ ID NO: 6360

SEQ ID NO: 7690 - protein, 746 aa, Escherichia coli 101-1; identical to SEQ ID NO: 6710

SEQ ID NO: 7691 - protein, 360 aa, Escherichia coli 101-1; identical to SEQ ID NO: 5879

SEQ ID NO: 7692 - protein, 510 aa, Escherichia coli 101-1; identical to SEQ ID NO: 6653

SEQ ID NO: 7693 - protein, 368 aa, Escherichia coli 101-1
MNKTITALAIIMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTTIDKINAHYFDKKAEDYFFNKFLLSFDPSTQQWSYAGESPWYGTAGAAVVNKGDKTWLINGEAKPGLRTDAVFELDFTGNNLKWNKLAPVASPDGVAGGFAGMSNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 7694 - protein, 774 aa, Escherichia coli 101-1
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPISLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDHFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 7695 - protein, 121 aa, Escherichia coli 101-1
MDAVLSVQGASAPVKKKSFFSKFTRLNMLRLARAVIPAAVLMMFFPQLAMAAGSSGQDLMASGNTTVKATFGKESSVVKWVVLAEVLVGAVMYMMTKNVKFLAGFAIISVFIAVGMAIVGL

SEQ ID NO: 7696 - protein, 232 aa, Escherichia coli 101-1; identical to SEQ ID NO: 5747

SEQ ID NO: 7697 - protein, 191 aa, Escherichia coli 101-1; identical to SEQ ID NO: 5748

SEQ ID NO: 7698 - protein, 517 aa, Escherichia coli 101-1; identical to SEQ ID NO: 6406

SEQ ID NO: 7699 - protein, 351 aa, Escherichia coli 101-1; identical to SEQ ID NO: 5767

SEQ ID NO: 7700 - protein, 614 aa, Escherichia coli 101-1; identical to SEQ ID NO: 6387

SEQ ID NO: 7701 - protein, 331 aa, Escherichia coli 101-1; identical to SEQ ID NO: 6551

SEQ ID NO: 7702 - protein, 760 aa, Escherichia coli 101-1; identical to SEQ ID NO: 6703

SEQ ID NO: 7703 - protein, 203 aa, Escherichia coli 101-1; identical to SEQ ID NO: 6414

SEQ ID NO: 7704 - protein, 362 aa, Escherichia coli 101-1; identical to SEQ ID NO: 5809

SEQ ID NO: 7705 - protein, 224 aa, Escherichia coli 101-1
MTVSLTAILLSCSSAWAAGKGGIGLAATRLVYSEGEEQISLGVRNTSPDVPYLIQSWVMTPDNKKSADFIITPPLFVLNPANENLLRIMYIGAPLAKDRETLFFTSVRAVPSTTKRKEGNTLKIATQSVIKLFWRPKGLAYPLGEAPAKLRCTSSADMVTVSNPTPYFITLTDLKIGGKVVKNQMISPFDKYQFSLPKGAKNSSVTYRTINDYGAETPQLNCKS

SEQ ID NO: 7706 - protein, 851 aa, Escherichia coli 101-1
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNFGDFGAISFDATQAKSTLADQSEHKGQSYRFLYAKTLNHLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGISWNYSKSRGQPDADQVFALNFSLPLNLLLPRSNDSYTRKKNYAWMTSNTSIDNEGHTTQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGVQANSGIIDDDGSLYMAGLPAKGTISVRWGEAPDQICHINYELTEQQINSAITRMDAICR

SEQ ID NO: 7707 - protein, 229 aa, Escherichia coli 101-1
MALLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNVGVVPPKSQRQTSWCQAIAPCHVAWRAINDYGGLSAKKEQNLP

SEQ ID NO: 7708 - protein, 231 aa, Escherichia coli 101-1; identical to SEQ ID NO: 6690

SEQ ID NO: 7709 - protein, 838 aa, Escherichia coli 101-1
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFTPTVRGIANSSAIVTIRQNGYVIYQSNVPAGAFEINDLYPSSNSGDLEVTIEESDGTQRRFIQPYSSLPMMQRPGHLKHSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWDYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 7710 - protein, 678 aa, Escherichia coli 101-1; identical to SEQ ID NO: 6688

SEQ ID NO: 7711 - protein, 118 aa, Escherichia coli 101-1 [sequence omitted]

SEQ ID NO: 7712 - protein, 747 aa, Escherichia coli 101-1; identical to SEQ ID NO: 6511

SEQ ID NO: 7713 - protein, 266 aa, Escherichia coli 101-1
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLLDQYAQLKAQYADKPKKRVFLQFGINPPFTSGKESIQNQVLEVCGGENIFKDSRIPWPQVSREQVLARSPQAIVITGGPDQIPKIKQYWGEQLKIPVIPLTSDWFERASPRIILAAQQLCNALSQVD

SEQ ID NO: 7714 - protein, 866 aa, Escherichia coli 101-1
MTIKPTKNYHNHLTRIATFCALLYCNSAFCAELVEYDHTFLMGQNASNIDLSRYSEGNPAIPGMYDVSVYVNDQPIINQSITFIEIEGKKNAQACITLKNLLQFHINSPDINNEKAVLLARDETLGNCLNLTKIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 7715 - protein, 246 aa, Escherichia coli 101-1; identical to SEQ ID NO: 6342

SEQ ID NO: 7716 - protein, 816 aa, Escherichia coli 101-1
MNIYRLSFVSCLVMAMPCALAVEFNLNVLDKSMRDRIDISLLKEKGVIAPGEYFVSVAVNNNQISNGQKINWQKKGDKTIPCINDSLVDKFGLKPDIRQSLPQIDRCIDFSSRPEMLFNFDQANQQLNISIPQAWLAWHSENWAPPSTWKEGVAGVLMDYNLFASNYRPQDGSSSTNLNAYGTTGINAGSWRLRSDYQLNNTDSEDSHEQSGGISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGMADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 7717 - protein, 243 aa, Escherichia coli 101-1; identical to SEQ ID NO: 6708

SEQ ID NO: 7718 - protein, 729 aa, Escherichia coli 101-1; identical to SEQ ID NO: 6531

SEQ ID NO: 7719 - protein, 213 aa, Escherichia coli 101-1; identical to SEQ ID NO: 5744

SEQ ID NO: 7720 - protein, 193 aa, Escherichia coli 101-1; identical to SEQ ID NO: 6300

SEQ ID NO: 7721 - protein, 654 aa, Escherichia coli 101-1; identical to SEQ ID NO: 6425

SEQ ID NO: 7722 - protein, 897 aa, Escherichia coli 101-1; identical to SEQ ID NO: 6749

SEQ ID NO: 7723 - protein, 121 aa, Escherichia coli 101-1
MNTVLSVQGASAPVKKKSFFSKFTRLNMLRLARAVIPVAVLMMLFPELAMASAGKGTDLMAKGNDTVKATFGKDSSIVKWVVLAEVLVGAVMYMMTKNVKFLVGFAIISVFIAVGMTVVGL

SEQ ID NO: 7724 - protein, 208 aa, Escherichia coli 101-1; identical to SEQ ID NO: 5717

SEQ ID NO: 7725 - protein, 111 aa, Escherichia coli 1827-70; identical to SEQ ID NO: 5738

SEQ ID NO: 7726 - protein, 130 aa, Escherichia coli 1827-70
MLSPESLCYGEKHEKRGAFLGLLLVSACASVFAANNETSKSVTFPKCEGLDAAGIAASVKRDYQQNRVARWADDQKIVGQADPVAWVSLQDIQGKDDKWSVPLTVRGKSADIHYQVSVDCKAGMAEYQRR

SEQ ID NO: 7727 - protein, 774 aa, Escherichia coli 1827-70
MTPLRVFRKTTPLVNTIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLSPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQIADLNLAFGVKNIFDQDYFIRSYDDNNKGIYAGQPRTLYMQGSLKF

SEQ ID NO: 7728 - protein, 368 aa, Escherichia coli 1827-70
MNKTITALAIMMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLDPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 7729 - protein, 170 aa, Escherichia coli 1827-70
MGGKCRWCKGWSFYRDATSVCDEGKKENTLRILDATNNQLPQDRESLFWMNVKAIPSMDKSKLTENTLQLVIISRIKLYYRPAKLALPPDQAAEKLRFRRSANSLTLINPTPYYLTVTELNAGTRILENALVPPMGESTVKLPSDAGSNITYRTINDYGALTPKMTGVME

SEQ ID NO: 7730 - protein, 863 aa, Escherichia coli 1827-70
MHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDSNWTLSYSLTKNAWQKGRDQMLALNVNIPFSHWLRSDSKSQWRHASASYSMSHDLNGRMTNLVGVYGTLLEDNNLSYSVQTGYAGGGDGNSGSTGYATLNYRGGYGNANIGYSHSDDIKQLYYGVSGGILAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 7731 - protein, 241 aa, Escherichia coli 1827-70; identical to SEQ ID NO: 6512

SEQ ID NO: 7732 - protein, 747 aa, Escherichia coli 1827-70; identical to SEQ ID NO: 6511

SEQ ID NO: 7733 - protein, 266 aa, Escherichia coli 1827-70; identical to SEQ ID NO: 5772

SEQ ID NO: 7734 - protein, 161 aa, Escherichia coli 1827-70; identical to SEQ ID NO: 5769

SEQ ID NO: 7735 - protein, 170 aa, Escherichia coli 1827-70 [sequence omitted]

SEQ ID NO: 7736 - protein, 230 aa, Escherichia coli 1827-70
MMTKIKLLMLIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRLIQLQELPAEAPDTLKFSRSGNYINVHNPSPFYVTLVNLQVGNQKLGNAMAAPRVNSQIPLPSGVQGKLKFQTVNDYGSVTPVREVNLN

SEQ ID NO: 7737 - protein, 780 aa, Escherichia coli 1827-70
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERISLNSSALPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGIRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGTVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKILAALCRRKARWFVPILIPA

SEQ ID NO: 7738 - protein, 746 aa, Escherichia coli 1827-70; identical to SEQ ID NO: 6561

SEQ ID NO: 7739 - protein, 351 aa, Escherichia coli 1827-70; identical to SEQ ID NO: 6367

SEQ ID NO: 7740 - protein, 193 aa, Escherichia coli 1827-70
MRYLATLLLSLAVLITAGCGWHLRDTTQMPATMKVMILDSGDPNGPLSRAVRNQLRLNGVELLDKETTRKDVPSLRLGKVSIAKDTASVFRNGQTAEYQMIMTVNATVLIPGRDIYPISAKVFRSFFDNPQMALAKDNEQDMIVKEMYDRAAEQLIRKLPSIRAADIRSDEEQTSTTTDTPATPARVSTTLGN

SEQ ID NO: 7741 - protein, 331 aa, Escherichia coli 1827-70; identical to SEQ ID NO: 6551

SEQ ID NO: 7742 - protein, 760 aa, Escherichia coli 1827-70; identical to SEQ ID NO: 6415

SEQ ID NO: 7743 - protein, 203 aa, Escherichia coli 1827-70; identical to SEQ ID NO: 6414

SEQ ID NO: 7744 - protein, 361 aa, Escherichia coli 1827-70
MKRNILAVIVPALLVAGTANAAEIYNKDGNKVDLYGKAVGLHYFSKDNGVNSYGGNGDKTYARLGFKGETQINSDLTGYGQWEYNFQGNNSEGADAQTGNKTRLAFAGLKYADIGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGNGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 7745 - protein, 224 aa, Escherichia coli 1827-70
MTVSLTAILLSCSSAWAAGKGGIGLAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLAEAPAKLRCTSSADMVTVSNPTPYFITLTDLKIGGKVVKNQMISPFDKYQFSLPKGAKNSSVTYRTINDYGAETPQLNCKS

SEQ ID NO: 7746 - protein, 591 aa, Escherichia coli 1827-70
MPSFIGGLVVFVSAAFNAQAETWFDPAFFKDDPSMVADLSRFEKGQKITPGVYRVDIVLNQTIVDTRNVNFVELTPEKGIAACLTTESLDAMGVNTDAFPAFKQLDKQACALLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGGSWNYSKSRGQPDADQVFALNFSLPLNLLLPRSNDSYTRKKITPG

SEQ ID NO: 7747 - protein, 243 aa, Escherichia coli 1827-70; identical to SEQ ID NO: 6708

SEQ ID NO: 7748 - protein, 819 aa, Escherichia coli 1827-70; identical to SEQ ID NO: 6707

SEQ ID NO: 7749 - protein, 430 aa, Escherichia coli 1827-70; identical to SEQ ID NO: 5758

SEQ ID NO: 7750 - protein, 128 aa, Escherichia coli 1827-70
MDRETLFELSIASVPSGKVENQSVKVAMRSVFKLFWRPEGLPGDPLEAYQQLRWTRNSQGVQLTNPTPYYINLIQVSVNGKALSNVGVVPPKSQRQTSWCQAIAPCHVAWRAINDYGGLSAKKEQNLP

SEQ ID NO: 7751 - protein, 360 aa, Escherichia coli 1827-70
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTQANGDGFGFSTTYEYEGFGVGATYAKSDRTNNQVIYGNNSLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVGMVYQF

SEQ ID NO: 7752 - protein, 191 aa, Escherichia coli 1827-70; identical to SEQ ID NO: 6537

SEQ ID NO: 7753 - protein, 232 aa, Escherichia coli 1827-70; identical to SEQ ID NO: 5747

SEQ ID NO: 7754 - protein, 729 aa, Escherichia coli 1827-70
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRNDVNSPTWGGLPRWNTDGSSNSYDRARSTAPDWAYNDKEINKVFMTLKQRFADTWQATLNATHSEVEFDSKMMYVDAYVNKADGMLVGPYSNYAPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTNTVTPYGTFRAEQGSYALVDLFTRYQVTKNFSLQGNVNNLFDKTYDTNVEGSIVYGTPRNFSITSTYQF

SEQ ID NO: 7755 - protein, 213 aa, Escherichia coli 1827-70; identical to SEQ ID NO: 5744

SEQ ID NO: 7756 - protein, 539 aa, Escherichia coli 1827-70; identical to SEQ ID NO: 6525

SEQ ID NO: 7757 - protein, 700 aa, Escherichia coli 1827-70
MKIFSVRQTVLPALLALSPVVFAADEQTMIVSAAPQVVSELDTPAAVSVVDGEEMRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTKAEWKANPQQAPRAEQYDTRKTIKQTQAGLRYERSLSSRDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYITPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFTSIGYVPEDGWYAGTEARYMGDIMADDENTAKAPSYTLIGLFTGYKYNYHNLTVDLFGRVDNLFDKEYVGSVIVNESNGRYYEPAPGRNYGVGVNIAWRFE

SEQ ID NO: 7758 - protein, 236 aa, Escherichia coli 1827-70; identical to SEQ ID NO: 6472

SEQ ID NO: 7759 - protein, 51 aa, Escherichia coli 1827-70
MKVGESILGSRPEIRFYGTYINILDNELSNFKFNENSKDEFMAGIQAEVWW

SEQ ID NO: 7760 - protein, 203 aa, Escherichia coli 1827-70; identical to SEQ ID NO: 6396

SEQ ID NO: 7761 - protein, 207 aa, Escherichia coli 1827-70; identical to SEQ ID NO: 5743

SEQ ID NO: 7762 - protein, 614 aa, Escherichia coli 1827-70; identical to SEQ ID NO: 6387

SEQ ID NO: 7763 - protein, 386 aa, Escherichia coli 1827-70
MVDDVPVAQVLQALAEQEKLNLVVSPDVSGTVSLHLTDVPWKQALQTVVKSAGLITRQEGNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGNDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPLFGQLFRHDGKEDERRELVVFITPRLVSSE

SEQ ID NO: 7764 - protein, 888 aa, Escherichia coli 1827-70
MIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEISQYGNPGSCSVKPDNNGGAVTPVDPTPETPVTPTPDNSEPSTPADSGNDYSLQAWSGQEGSEIYHVIFNGNVYKNAWWVGSKDCPRGTSAENSNNPWRLERTATAAELSQYGNPTTCEIDNGGVIVADGFQASKAYSADSIVDYNDAHYKTSVDQDAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLIRFNGVNYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 7765 - protein, 650 aa, Escherichia coli 1827-70
MKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNARKPSSSGAMDNVAITADEQTNSLVITADQSVQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLPGDIPLVGQLFRYTSTERAKRNLMVFIRPTIIRDDDVYRSLSKEKYTRYRQEQQQRIDGKSKALVGSEDLPVLDENTFNSHAPAPSSR

SEQ ID NO: 7766 - protein, 678 aa, Escherichia coli 1827-70
MVPSTFSRLKAARCLPVVLAALIFAGCGTHTPDQSTAYMQGTAQADSAFYLQQMQQSSDDTRINWQLLAIRALVKEGKTGQAVELFNQLPQELNDAQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITLRATTDSGMTTNNPTLQTTPTDDQFTNNGGRIDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPVS

SEQ ID NO: 7767 - protein, 721 aa, Escherichia coli 1827-70
MDEIPALAENDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWNYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSVNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 7768 - protein, 94 aa, Escherichia coli 1827-70
MIYDASRKEAALPVANKGAETPYLLQSWVDNIDGKSRAPFIITPPLFRLEAGDDSSLRIIKTADNLPENKESLFYINVRAIPAKKNQMMLMLTS

SEQ ID NO: 7769 - protein, 107 aa, Escherichia coli 1827-70
MNSIAWGAIIPDRTRIIMNESDKGEALKLTNQSKKLPYLAQTWIEDTKGNKSRDFIVTVPPMVRLNPNEQIQIRMITQEKIAQLPKDRETLFYFNVREIPPKTDKKM

SEQ ID NO: 7770 - protein, 546 aa, Escherichia coli 1827-70
MYKKLKLTTISELIKNIYCSLSVIIIGCASAYAVEFNKDLIEAEDRENVNLSQFETDGQLPVGKYSLSTLINNKRTPIHLDLQWVLIDNLTAVCVTPEQLTLLGFTDEIIEEAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFSITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLATGVGFNLNSLGSLSFDVTRSDAQLHNQNKETGYSYRANYSKRFESTGSQLTFAGYRFSDKNFVSMNEYINDTNHYTNYQNEKESYIVTFNQYLESLRLNTYVSLARNTHWDASSNVNYSLSLSRDFDIGPLKTYPPH

SEQ ID NO: 7771 - protein, 613 aa, Escherichia coli 1827-70
MFWRDITLSVWRKKTTCLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSSNVVNYDPSNVIMLTGRASVVERLTEVIQRVDHAGNRTEEVIPLDNASASEIARVLESLTKNSGENQPAPLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKKT

SEQ ID NO: 7772 - protein, 360 aa, Escherichia coli 1827-70; identical to SEQ ID NO: 6645

SEQ ID NO: 7773 - protein, 432 aa, Escherichia coli 1827-70; identical to SEQ ID NO: 5727

SEQ ID NO: 7774 - protein, 518 aa, Escherichia coli 1827-70; identical to SEQ ID NO: 6358

SEQ ID NO: 7775 - protein, 597 aa, Escherichia coli 1827-70
MLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSEMVRTGNDKEMYTATYNQNFRDAGVSVYLNYTRHTYWDREEQTNYNIMLSHYFNMGSIRNMSVSLTGYRYEYDNRADKGMYISLSMPWGDNSTVSYNGNYGSGTDSSQVGYFSRVDDATHYQLNVGTSDKHTSVDGYYSHDGSLAQVDLCANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMRVFWSGVAHCDINLPDPLPADLFNGLLLPCQHKGNVAPVTSPAVKPAIQEQTQRVTPTEPPTSISVNQ

SEQ ID NO: 7776 - protein, 250 aa, Escherichia coli 1827-70; identical to SEQ ID NO: 6548

SEQ ID NO: 7777 - protein, 274 aa, Escherichia coli 1827-70
MNKTAIALLALLASSASLAATPWQKITQPVPGSAQSIGSFSNGCIVGADTLPIQSEHYQVMRTDQRRYFGHPDLVMFIQRLSSQVSNLGMGTVLIGDMGMPAGGRFNGGHASHQTGLDVDIFLQLPKTRWTSAQLLRPQALDLVSRDGKHVVSTLWKPEIFSLIKLAAQDKDVTRIFVNPAIKQQLCFDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 7778 - protein, 200 aa, Escherichia coli 1827-70; identical to SEQ ID NO: 6363

SEQ ID NO: 7779 - protein, 368 aa, Escherichia coli 1827-70
MKVKVLSLLVPALLVAGAANAAEVYNKDGNKLDLYGKVDGLHYFSDNKSEDGDQTYVRLGFKGETQVTDQLTGYGQWEYQIQGNTSEDNKENSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRDALRQNGDGVGGSITYDYEGFGIGAAVSSSKRTDAQNTAAYIGNGDRAETYTGGLKYDANNIYLAAQYTQTYNATRVGSLGWANKAQNFEAVAQYQFDFGLRPSVAYLQSKGKNLGTIGTRNYDDEDILKYVDVGATYYFNKNMSTYVDYKINLLDDNQFTRDAGINTDNIVALGLVYQF

SEQ ID NO: 7780 - protein, 162 aa, Escherichia coli 1827-70; identical to SEQ ID NO: 6365

SEQ ID NO: 7781 - protein, 828 aa, Escherichia coli 1827-70; identical to SEQ ID NO: 6558

SEQ ID NO: 7782 - protein, 641 aa, Escherichia coli 1827-70; identical to SEQ ID NO: 7667

SEQ ID NO: 7783 - protein, 224 aa, Escherichia coli 1827-70; identical to SEQ ID NO: 6372

SEQ ID NO: 7784 - protein, 823 aa, Escherichia coli 1827-70
MTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYLSQYYSDYKASGNNKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDLAAGRSHIEGASKQSDFVQAGYQYGFNNLLTLYGGSMVANNYYAFTLGAGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVTTPRRQIYMSNSTTFDDQGFASNNTGLSGTVGSRDQFNYGVNLSYQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLTFGYEVNDIHGHNIGVVGQGSQLFIRTNEIPPSVNVAINKQHGLSCTITFGKEIDESRNYICQ

SEQ ID NO: 7785 - protein, 237 aa, Escherichia coli 1827-70; identical to SEQ ID NO: 6533

SEQ ID NO: 7786 - protein, 446 aa, Escherichia coli 1827-70; identical to SEQ ID NO: 6459

SEQ ID NO: 7787 - protein, 307 aa, Escherichia coli 2362-75
MVNTVASENPDEAGRYSMDVEYGQYSVILLVEGFPPSHAGTITVYEDSQPGTLNDFLGAMSEDDVRPEALRRFELMVEEVARHAEEAKKNAGEAETSARNAGISASQAEESAANADTSAGEASESARQAAESAASAKQSEDASSSSASAAAQKASESSQSAAEAELSRKTAESAAGNAARDATTATEKARESAESAQSAEQSRIAAEEAVNRIPTVVGPPGPKGEPGPAGPQGPKGDKGERGDTGPAGATGERGPAGDAGPAGPQGPKGDRGERGETGLTGNAGPQGPKGDTGAAGPAGPQGPKGET

SEQ ID NO: 7788 - protein, 746 aa, Escherichia coli 2362-75
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKAAQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGYDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 7789 - protein, 351 aa, Escherichia coli 2362-75
MKKSTLALVVMGIVASVSVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 7790 - protein, 360 aa, Escherichia coli 2362-75; identical to SEQ ID NO: 6702

SEQ ID NO: 7791 - protein, 432 aa, Escherichia coli 2362-75; identical to SEQ ID NO: 5727

SEQ ID NO: 7792 - protein, 193 aa, Escherichia coli 2362-75; identical to SEQ ID NO: 6300

SEQ ID NO: 7793 - protein, 430 aa, Escherichia coli 2362-75; identical to SEQ ID NO: 5758

SEQ ID NO: 7794 - protein, 445 aa, Escherichia coli 2362-75; identical to SEQ ID NO: 7541

SEQ ID NO: 7795 - protein, 518 aa, Escherichia coli 2362-75; identical to SEQ ID NO: 7565

SEQ ID NO: 7796 - protein, 237 aa, Escherichia coli 2362-75; identical to SEQ ID NO: 7546

SEQ ID NO: 7797 - protein, 368 aa, Escherichia coli 2362-75
MNKTITALTIIMASFAANASVLPETPVPFKSGTGAIDNDTVYIGLGSAGTAWYKLDTQAKDKRWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTTIDKINAHYFDKKAEDYFFNKFLLSFDPSTQQWSYAGESPWYGTAGAAVVNKGDKTWLINGEAKPGLRTDAVFELDFTGNNLKWNKLAPVASPDGVAGGFAGMSNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 7798 - protein, 241 aa, Escherichia coli 2362-75; identical to SEQ ID NO: 6140

SEQ ID NO: 7799 - protein, 856 aa, Escherichia coli 2362-75
MAGFFVRLFVACAFAAQAPLSSAELYFNPRFLADDPQAVADLSRFENGQELPPGTYRVDIYLNNGYMATRDVSFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLCDNTTWSYNSSDSSSGSKNKWQHINTWLERDIIPLRSRLTLGDGYTQGDIFDGINFRGAQLASDDNMLPDSQRGFAPVIHGIAHGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGIYGTLLEDNDLSYSVQTGYAGGGDGNSGSTGYATLNYRGGYGNANIGYSHSDDIKRLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSVECR

SEQ ID NO: 7800 - protein, 784 aa, Escherichia coli 2362-75
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYKDEHPNDDSSRRWLFYWKHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTRLAESANRVMPQFKVDGRMVFERDMEMLAPGYTQTLEPRAQYLYVPYRDQSKIYNYDSSLLQSDYSGLFRDRTYGGLDRIASANQVTTGVTSRIYDDAAVERFNISVGQIYYFTESRTGDDNITWENDDKTGSLVWAGDTYWRISDRWGLRGGIQFDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 7801 - protein, 170 aa, Escherichia coli 2362-75
MSGILTRWRQFGKRYFWPHLLLGMVAASLGLPALSNAAEPNAPAKATTRNHEPSAKVNFGQLALLEANTRRPNSNYSVDYWHQHAIRTVIRHLSFAMAPQTLPVAEESLPLQAQHLALLDTLSALLTQEGTPSEKGYRIDYAHFTPQAKFSTPVWISHAQGIRAGPQRLS

SEQ ID NO: 7802 - protein, 790 aa, Escherichia coli 2362-75
MSQSIAFTVIEGKKNAQACITQKNLLQFHISSPDKNSGKAILLKRDDDLGDCLNLAEMISQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLDTDHRSSGFQSIDTQLNSDFKGNNQLNISSSGYSDTNRISYSVNTGYMMNKSSDDLSYIGGHASYESPWGTLSGSASASSDNSRQFSLNTDGGFVLHSGGLTFSNDSFSDSDTLAVIQAPGAKGARINYGNSTVDRWSYGVTSALSPYHENRIALDINDLENDVELKSTSTVAIPRQGAVVFADFETVQGQSAIMNIVRSDGKNIPFAEDIYDEQNNIIGNVGQGGQAFVHGIEQEENIRITWIEEGKPVSCFAHYQQNTASEKIAQSIILNGLRCQIQ

SEQ ID NO: 7803 - protein, 200 aa, Escherichia coli 2362-75
MENKGNNPLLVQSWLDTGDDNAEPGSITVPFTATPPVSRIDAKRGQTIKLMYTASSALPKDRESVFWFNVLEVPPKPDAAKASNQSLLQLAFRTRIKLFYRPEGLSGMPSDAPLALKWSWATSEGKAALRVDNPTPYYVSFSSGDLEANGKRYPLDMTMIAPFSNDVIKVNGMSGRTSSAKVHFFAINDFGGSIEGNANL

SEQ ID NO: 7804 - protein, 238 aa, Escherichia coli 2362-75
MSVFFRVCLGITVLLTALQVQASVVLGGTRIIYPSNQNEVQITLKNKDAYARYLVQSWVSNIDGSKAPFLITPPVYKLEENRQTLLHIVFTGDKDKLPQDRESLFLANVKSVSAMPEELKDKNILQFAMKARLKLFWRPVSLDNNDALTAWEKLKFHKEAGKLIVKNPTPFYISFNDLTVSGKNIVPVDTKSEPGALLMMVGPFSEQRFSLPAGAGNVVEWSVITDYGSSSGKRKQKL

SEQ ID NO: 7805 - protein, 731 aa, Escherichia coli 2362-75
MARSKTAQPKHSLRKIAVVVATAVSGMSVYAQAAVEPKEDTITVTAAPAPQESAWGPAATIAAKHSATATKTDTPIEKTPQSISVVTREEMDIKQPATVKEALDYTPSVFSTRGSSTTYDVVSIRGFTTASTVNTNQYLDGLKLQGDNYSEASIDPYFLERVELLRGPVSVLYGKSHPGGVVSMVSKRPSTDPIKEIQFKMGTDNLWQTGFDFSDAIDDDGVWSYRLTGLGRSQDAQQKYAKTTRYAVAPSFSWRPDDKTDFTFLSNFQSDPDAGYYGWLPRQGTVVPYQDANGSWHKLPTDFNEGEKDNKMSRRQQLIGYSFAHEFNDTFTVRQNLRYTRIHTLYDAVYGNGYIAPAQISRAYVRSDEDLNSFTVDTQLQSNFAIGAVAHTLLTGVDYLRMRNDIDANYGTANPISMTDPQYGNANININFPYAVINRQEQTGLYIQDQSEWNKWVLTLGGRYDFAKTSTYTRSTSSLDEINDQQFTWRGGINYLFDNGISPYFSYSESFEPVSGATKEGKPFDPSRGKQYEAGVKYVPKDTPVTVTASVFQLTKDKNLTADPSNTLFSVQGGEIRSRGFEIEAKAAVNANINVTAAYSYTDAEYTKDTLYKGKRPAEVPRNMASLWADYTFHETALSGLSLGAGARYFGDTSSFYTTGDKTNQTFNVGGYTLVDAMIKYDIARFGMPGSSVGVNVNNLFDREYVSSCYRDYACYWGAERQVVATATFRF

SEQ ID NO: 7806 - protein, 266 aa, Escherichia coli 2362-75
MAKSLFRALVALSFLAPLWLYAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEKAAQSLLDQYAQLKAQYADKSKKRVFLQFGINPPFTSGKESIQNQVLEVCGGENIFKDSRVPWPQVSREQVLARSPQAIVITGGPDQIPKIKQYWGEQLKIPVIPLTSDWFERASPRIILAAQQLCNALSQVD

SEQ ID NO: 7807 - protein, 161 aa, Escherichia coli 2362-75; identical to SEQ ID NO: 5769

SEQ ID NO: 7808 - protein, 774 aa, Escherichia coli 2362-75; identical to SEQ ID NO: 6673

SEQ ID NO: 7809 - protein, 203 aa, Escherichia coli 2362-75
MKLRWFAFLIVLLAGCSSKHDYTNPPWNAKVPVQRAMQWMPISQKAGAAWGVDPQLITAIIAIESGGNPNAVSKSNAIGLMQIKASTSGRDVYRRMGWSGEPTTSELKNPERNISMGAAYLNILETGPLAGIEDPKVLQYALVVSYANGAGALLRTFSSDRKKAISKINDLDADEFLEHVARNHPAPQAPRYIYKLEQALDAM

SEQ ID NO: 7810 - protein, 656 aa, Escherichia coli 2362-75
MRLKKRYLCTALSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAVSSDLGYLQVSGSQLKQDFLGLPHGVNNDIAGKHGKMINSSADDKRGIVKLGFTPRENDEYTLTYIKQDGEKDNPPYSRNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKINDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 7811 - protein, 565 aa, Escherichia coli 2362-75
MKSPAPSRPQKMALIPACIFLCFAALSVQAEETSVTPQPPDILLGPLFNDVQNAKLFPDPKTFADAVPNSYPLMILADYRMQQNQSGFDLRHFVNVNFTLPKEGEKYVPPEGQSLREHIDGLWPVLTRSTENTEKWDSLLPLPKPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILSRASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLMEKYDVSTTGTGGSGGEYPLQDGFGWTNGVTLKMLDLICPKEQPCDNVPATRPLSESTTQPLKQKEAEPTP

SEQ ID NO: 7812 - protein, 207 aa, Escherichia coli 2362-75
MPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTSDDAEEMIGKLTGMPIPLNSLRQWILGLPGDATDYKLDDQYRLSEITYSQNGKNWKVVYGGYDTKTQPAMPANMELTDGGQRIKLKMDNWVVK

SEQ ID NO: 7813 - protein, 102 aa, Escherichia coli 2362-75
MKKVLALVVAAAMGLSSAAFAAETATTPAPTATTTKAAPAKTTHHKKQHKAAPAQKAQAAKKHHKNAKAEQKAPEQKAQAAKKHARKHSHQQPAKPAAQPAA

SEQ ID NO: 7814 - protein, 236 aa, Escherichia coli 2362-75
MQTTRTPYSISFMATVLLLLLFACHSTVANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDIPHAATGDISFQTINDYGALTPRIKATMQ

SEQ ID NO: 7815 - protein, 118 aa, Escherichia coli 2362-75 [sequence omitted]

SEQ ID NO: 7816 - protein, 274 aa, Escherichia coli 2362-75; identical to SEQ ID NO: 5899

SEQ ID NO: 7817 - protein, 249 aa, Escherichia coli 2362-75
MTKYLSAKTLTTVLSLLAATVSFSTQASVTPDRTRLIFNESDKSISVTLRNNDPKLPYLAQSWIEDEKGVKISSPLAVLPPVQRIEAMMNGQVKIQGLPDIHKLPADRESMFYFNVREIPPKSNKSNTLQIALQTRIKLFWRPKALEKNTTQNPWQHKVTLTRNGQEFTVNNPTPYYVIFSNASAQKNGNPAAGFSPIVMSPKTSAPLNVKMESVPVLTYVNDYGARMPLFFTCNGNSCQVDEEQSRKG

SEQ ID NO: 7818 - protein, 879 aa, Escherichia coli 2362-75
MPEHSFLRLRGLSWWIALAISGSPFNALADDTIQFDGRFLDLKGNTKIDLGRFSQKGYVEPGKYNLRVHVNNQPLPDDYDIYWYATENDPNKSYACLSPELVAQFGLKEDIAKNLQWIRDGQCLNTALLAGTEISGDLGQSALLVSVPQAYLEYTDSEWDPPSRWDDGIPGLIADYSINAQTRHENGGDDTNDISGNGTVGVNVGPWRLRADWQSDYQHTRSNDDGDTDDSGTQKNWEWSRYYAWRALPSLKAKLSLGEDYLNSDIFDGFSYIGGSISTDDQMLPPNLRGYAPDISGVAHTTAKVTVTQMGRVIYETQVPAGPFRIQDIGDSVSGTLHVRIEEQNGQVQEYDVSTASMPFLTRPGQVRYKVTMGRPQNWDHQVAGSFFSGGEASWGIANGWSLYGGALADENYQSAALGLGRDLALLGALAFDVTHSRVQLDDNSVYGNKTLDGNSYRVSYAKDFDELNSRVTFAGYRFSEKNYMTMSEYLDANDDDRARTGNDKEMYTVTYNQNFTDARVSVYLNYSHHTYWDRQDQTNYNMMLSHYFNLGSLRNLSVSLTGYRYEYDKSADKGVYLSLSLPWGDNSTISYNGNYGSGADSNQVSLYHRIDDASHYTLSAGTSENHSSVDGYYSHDGTLAKVDLSANYHEGQYTSAGISLQGGATLTAHGGALHRTQNMGGTRLLIDADGVANVPVEGNGSAVYTNMFGKAVVADVNDYYRNQAYIDLNKLPENAEATKSVVQATLTEGAIGYRKFAVISGEKAMAVLRLQDGSHPPFGAEVKNDNQQQVGLVDDEGNVYLAGVKPGEHMTVFWEGESHCDISLPDPLPNDLFNGLLLPCQQKGGSSPVIPHDIQPVIQEQTQQVTPMEPPMSVSSNQ

SEQ ID NO: 7819 - protein, 641 aa, Escherichia coli 2362-75
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKIENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 7820 - protein, 828 aa, Escherichia coli 2362-75
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGSNMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPLSELAEDQLNDESHELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 7821 - protein, 162 aa, Escherichia coli 2362-75; identical to SEQ ID NO: 5896

SEQ ID NO: 7822 - protein, 371 aa, Escherichia coli 2362-75
MKVKVLSLLVPALLVAGAANAAEIYNKDGNKLDLYGKVDGLHYFSDNDSKDGDKTYMRLGFKGETQVTDQLTGYGQWEYQIQGNEPESDNSSWTRVAFAGLKFQDVGSFDYGRNYGVVYDVTSWTDVLPEFGGDTYDSDNFMQQRGNGFATYRNTDFFGLVDGLNFAVQYQGKNGSPSGEGMTGVTNNGRDVLEQNGDGVGGSITYDIGEGFSFGGAISSSKRTAEQNNYGIGNGDRAETYTGGLKYDANNVYLAAQYTQTYNATLAGDLGWANKAQNFEVVAQYQFDFGLRPSVAYLQSKGKNLNANIAGRTYDDEDLLKYVDVGATYYFNKNMSTYVDYKINLLDDNQFTRAAGINTDDIVALGLVYQF

SEQ ID NO: 7823 - protein, 192 aa, Escherichia coli 2362-75
MKSKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRFLQCGNEIYSAIKDLQRKAPDKNIVIFTHNHCLTYIAKDKRDATFKPDYLDGLVMHVEKGKVYLDGEFVNH

SEQ ID NO: 7824 - protein, 512 aa, Escherichia coli 2362-75; identical to SEQ ID NO: 6120

SEQ ID NO: 7825 - protein, 199 aa, Escherichia coli 2362-75
MIYDGNKKEASLTVQNKNKSEEFLIQSWVDDATGSKKTPFIITPPLFKLEPGKNNILRIVNVNPSLPQDRESVYWVNVKAIPSQNEENEGKNVLQIAVRTRIKLFYRPAGLKGDIKSSPGELRFTRNGKQIKVDNPTVFNITFSDVFINGHEIEKSGMVPAKGALNIYLPAGVNSASQIKYNTINDFGSSGEYLTREIN

SEQ ID NO: 7826 - protein, 853 aa, Escherichia coli 2362-75
MSWMVVSRTYTSFFPFSLSVLALTVAGSFSATAGKFNPRFLEDTAGINQHVDLSMYETDHGAQLPGTYRVSLIVNEQKMETRTLEFKAATESQRKEMGEFLIPCLSRTQLADMGVRVDSFSALNLIPAEACVAFNEIIPQATSHFDFSEQKLVMSFPQAAMQQVARGTVPESRWDDGVPALLLDYSFSGSNSSHDTKSYNRYIDENGNHHQDKNETSQTNDSYYLSMRSGLNLGAWRLRNYSNWSYSNGEKQWDNIGTYVTRAIVPLKAQLTLGDTATPSDIFDSVQMRGALLASDEEMLPDSQRGFAPVVRGIAKSNAEVSIEQNGYVIYRAFVQPGAFEINDLYPTANSGDLTVIVKEADGSEQRFIQPFSSVAVFQREGHLKYSLSAGEYRAGNYDSANPRFGQFNAMYGLPFGMTTYGGALISKDYNAFALGLGKNFGSIGAISVDITQAKSTLNNNATDQGQSYRFLYSKSFASGTDFRLLGYKYSTSGFYTFQEATDVRSGADSDYGRYHKRSEIQGNLTQQLGTYGSVYFNMTQQDYWNDDGKRLSLATGYNGRIGRVNYSIAYSWNKSPEWDENDQLWSFNISIPFGRAWSNYRVTTDQDGRTIQQLGVNGTLLEDRNLSYNVQEGYSSNGVGNSGNASLAYQGGAGNISVGYSYGKDYQQTNYSLRGGIVAHSEGISLSQPLGETIAIVSAPGARGAKVLNNSGVSVDWQGNAVVPYLSIYRENDVSIRSETLNDSVDMNSAFQTIVPTRGAVVRAHFDTRVGYRVLMTLIRQNGVSVPFGATATLVSDTTEQISGIVGEDGQLYISGMPKTGNVKIVWGKDTSQQCVAKYELPVEEKIPVLFP

SEQ ID NO: 7827 - protein, 613 aa, Escherichia coli 2362-75
MMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFSVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 7828 - protein, 386 aa, Escherichia coli 2362-75
MVDDVSVAQVLQALAEQEKLNLVVSPDVSGTVSLHLTDVPWKQALQTVVKSAGLITRQEGNILSVHSVAWQNDNIARQEAEQTRAQANLPLENRNITLQYADAGELAKAGEKLLSAKGSMTVDKRTNRLLLRDNKTALSTLEQWVSQMDLPVGQVELSAHIVTINEKSLRELGVKWTLADAQQAGGVGQVTTLGSDLSVATATTHIGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 7829 - protein, 678 aa, Escherichia coli 2362-75
MVPSTFSRLKAARCLPVVLAALIFAGCGTHTPDQSTAYMQGTAQADSAFYLQQMQQSSDDTRINWQLLAIRALVKEGKTGQAVELFNQLPQELNDTQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPAATTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 7830 - protein, 689 aa, Escherichia coli 2362-75
MIHATDSVTTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESVGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 7831 - protein, 686 aa, Escherichia coli 2362-75
MFWRDMTLSIWRKKTTGLKTKKRLLPLMLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPILPAQNQALPPEVRAFLNAGRTR

SEQ ID NO: 7832 - protein, 213 aa, Escherichia coli 2362-75; identical to SEQ ID NO: 5744

SEQ ID NO: 7833 - protein, 729 aa, Escherichia coli 2362-75
MLSTQFNRDNQHQTTSKPSLLAACIALALLPSAAFAAPATEETVIVEGSATTPVDDENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSGNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQKDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTIKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 7834 - protein, 232 aa, Escherichia coli 2362-75; identical to SEQ ID NO: 5747

SEQ ID NO: 7835 - protein, 191 aa, Escherichia coli 2362-75; identical to SEQ ID NO: 5748

SEQ ID NO: 7836 - protein, 826 aa, Escherichia coli 2362-75
MLRMTPLASAIVALLIGIEAYAAEETFDTHFMIGGMKDQQVANIRLDDNQPLPGQYDIDIYVNKQWRGKYEIIVKDNPQETCLSREMIKRLGINTDNFASGKQCLTFKQLIQGGSYTWDIGVFRLDFSVPQAWVEELESGYVPPENWERGINAFYTSYYMSQYYSDYKASGNSKSTYVRFNSGLNLLGWQLHSDASFSKTNNNPGVWKSNTLYLERGFAQLLGMLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWCYSSRDYRTFNDHVWANNKDNYRRDENDIYDIADYYQNDFGRKNSFSANMSQSLPEGWGSVSLSTLWRDYWGRSGSSKGYQLSYSNNLRRISYTLAASHAYDENHHEEKRFNIFISIPFDWGDDVTTPRRQIYMSNSTTFDDQGVASNNTGLSGTVGSRDQFNYGVNLSYQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVLLVNFDTDQRKPCFIKALRADGQPLTFGYEVNDLHGHNIGVVGQGSQLFIRTNEVPPSVNVAIDKQQGLSCTITFGKEIDESRNYICQ

SEQ ID NO: 7837 - protein, 165 aa, Escherichia coli 2362-75
MKGLLALLISSMVLPAHAGIVIYGTRIIYPAEHKEVMVQLMNQGNRSSLMQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKK

SEQ ID NO: 7838 - protein, 355 aa, Escherichia coli 2362-75
MKRNILAVVVPALLVAGTANAAEIYNKDGNKLDLYGKAVGLHYFSKGNGENSYGGNGDKTYARLGFKGETQINSDLTGYGQWEYNFQGNNSEGDDAQNGNKTRLAFAGLKFADAGSFDYGRNYGVVYDALGYTDMLPEFGGDTAYSDDFFVGRVGGVATYRNSNFFGLVDGLNFAVQYLGKNERDTARRSNGDGVGGSVSYEFEGFGIVGAYGAADRTNLQEDSTLGKGKKAEQWATGLKYDANNIYLAANYGETRNATPITGGFANKTQDILLVAQYQFDFGLRPSIAYTKSKAKDVEGIGDVDLVNYIEVGATYYFNKNMSTYVDYAINQIDSDNKLGVGSDDTVAVGIVYQF

SEQ ID NO: 7839 - protein, 203 aa, Escherichia coli 2362-75; identical to SEQ ID NO: 6414

SEQ ID NO: 7840 - protein, 660 aa, Escherichia coli 2362-75
MGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRNKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 7841 - protein, 331 aa, Escherichia coli 2362-75
MKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENTRSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGDEAGHE

SEQ ID NO: 7842 - protein, 646 aa, Escherichia coli 2362-75
MRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDFDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTLSTGLNYENMSENRKGYNNFRLNRGVPEYGQKGELRRDERNLMWNVDPYLQTQWQLTDKLSLDAGVRYSSVWFDSNDHYVTPGNGDDSGDASYHKWLPAGSLKYAMTDAWNVYLAAGRGFETPTINELSYRADGQSGMNFGLKPSTNDTIEIGSKTRIGDGLLSLALFQTDTDDEIVVDSSSGGRTIYKNAGKTRRQGAELAWDQRFAGDFRVKASWTWLDATYRSNVCNEQDCNGNRMPGIARNMAFASIGYIPEDGWYAGTEARYMGDIMADDENTAKAPSYTLVGLFTGYKYNYHNLTVDLFGRVDNLFDKEYVGSVIVNESNGRYYEPAPGRNYGVGINIAWRFE

SEQ ID NO: 7843 - protein, 551 aa, Escherichia coli 2362-75
MDRRRFIKGSMAMAAVCGTSGIASLFSQAAFAADSDIADGQTQRFDLSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKNQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 7844 - protein, 208 aa, Escherichia coli 2362-75; identical to SEQ ID NO: 5869

SEQ ID NO: 7845 - protein, 214 aa, Escherichia coli 2534-86
MTEGDVRPEALRRFELMVEEVARHAEEAKKNAGEAETSARNAGISVSQAEASAANADTSAGEASESARQAAESAASAKQSEDASSSSASAAAQKASESSQSAAEAELSKKTAESAAGNAARDATTATEKARESAESAQSAEQSRIAAEEAVNRIPTVVGPPGPKGEQGPAGPQGPKGDKGERGDTGPVGATGERGPAGDAGPAGPQGPKGDRGE

SEQ ID NO: 7846 - protein, 89 aa, Escherichia coli 2534-86; identical to SEQ ID NO: 6232

SEQ ID NO: 7847 - protein, 89 aa, Escherichia coli 2534-86; identical to SEQ ID NO: 6233

SEQ ID NO: 7848 - protein, 461 aa, Escherichia coli 2534-86
MTERELSIIRALGEEFSTVLADLQRTFEGKMASQAQAFEEKLTSLSAVLQKHVTVDEVRPVLQAMVDDAVGAIPVPRDGRDYDPDVLQQAVNDAVANIPQPADGKSLTPDDVRPMLEQMVKEAVSHIPVPRDGRDYDPEVLKQAVNDAVANIPQPADGKSLTPDDVRPMLEQMVKEAVSHIPVPRDGRDYDPDVLQKAVNDAVANIPQPADGKSLTPDDVRPMLEQMVKEAVSHIPVPRDGRDYDPEVLQKAVNDAVANIPVPADGKSITPDDVRPMLEQMVKEAVSHIPVPRDGRDYDPDVLQKAVLDAVRALPAPQDGRDATALEIIPAIDDQKSFPRGTYATHLGGLWRAYEKTHGMRGWECLVDGVADIDVSMTGERSFTVVVRQSSGQRTEKTFSLPVMLYRGVFRAGETYHPGDTVTWGGSLWHCNSMTGDKPGEAHSSGWTLAAKRGRDAGGGK

SEQ ID NO: 7849 - protein, 368 aa, Escherichia coli 2534-86
MNKTITALAIMMASFAANASVLPETPVPFKSGTGAIDNDTVYIGLGSAGTAWYKLDTQAKDKKWTALAAFPGGPRDQATSAFIDGNLYVFGGIGKNSKGLTQVFNDVHKYNPKTNSWVKLMSHAPMGMAGHVTFVHNGKAYVTGGVNQNIFNGYFEDLNEAGKDSATIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 7850 - protein, 241 aa, Escherichia coli 2534-86
MSNKNVNVRKSQEITFCLLAGILMFMAMMVAGRAEAGVALGATRVIYPAGQKQVQLAVTNNDENSTYLIQSWVENADDVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 7851 - protein, 863 aa, Escherichia coli 2534-86
MHIRKHRLAGFFVRLFVACAFAAQTPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNRSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 7852 - protein, 784 aa, Escherichia coli 2534-86
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYRNIAPNMDATITPHYMHRRGNIMWENEFRYLSQAGAGLMELDYLPSDKVYEDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLDESVNRVMPQFKVDGKMVFERDMEMLAPGYTQTLEPRAQYLYVPYRDQSDIYNYDSSLLQSDYSGLFRDRTYGGLDRIASANQVTTGVTSRIYDDAAVERFNISVGQIYYFTESRTGDDNITWENDDKTGSLVWAGDTYWRISERWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 7853 - protein, 170 aa, Escherichia coli 2534-86 [sequence omitted]

SEQ ID NO: 7854 - protein, 765 aa, Escherichia coli 2534-86
MQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESNPVSCLAHYQQSSEAEKIAQSIILNGIRCQIQ

SEQ ID NO: 7855 - protein, 230 aa, Escherichia coli 2534-86
MAFSSSSIADIVISGTRVIYKSDQKSVNVRLENKGNNPLLVQSWLDTGDDNAEPGSITVPFTATPPVSRIDAKRGQTIKLMYTASTSLPKDRESVFWFNVLEVPPKPDAEKVANQSLLQLAFRTRIKLFYRPDGLKGNPSEAPLALKWFWSGSEGKASLRVTNPTPYYVSFSSGDLEASGKRYPIDVKMIAPFSDEVMKVTGLNGKASSAKVHFYAINDFGGAIEGNASL

SEQ ID NO: 7856 - protein, 747 aa, Escherichia coli 2534-86; identical to SEQ ID NO: 6343

SEQ ID NO: 7857 - protein, 266 aa, Escherichia coli 2534-86; identical to SEQ ID NO: 5772

SEQ ID NO: 7858 - protein, 161 aa, Escherichia coli 2534-86; identical to SEQ ID NO: 5769

SEQ ID NO: 7859 - protein, 221 aa, Escherichia coli 2534-86
MKNYLWLVALLPLLSGCESQAILVKKDDAYFAPPKTEAPPPADGRAGGVFETGYNWSLTADRRAYRVGDILTVILEESTQSSKQAKTNFGKSNTVDIGAPTIFSHTKDKLSGSIDANRDFDGSATSQQQNSLRGEITVSVHAVQPNGILEIRGEKWLTLNQGDEYIRLSGLVRADDIQNDNSVSSQRIADARISYAGRGALSDANAAGWLTRLFNHPLFPI

SEQ ID NO: 7860 - protein, 351 aa, Escherichia coli 2534-86; identical to SEQ ID NO: 6367

SEQ ID NO: 7861 - protein, 230 aa, Escherichia coli 2534-86
MMTKIKLLMLIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRLIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 7862 - protein, 869 aa, Escherichia coli 2534-86
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERISLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGIRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGTVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGGGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGRKPVPFGSLVRENSTGITSMVGDDGQVYLSGAPLSGELLVQWGDGANSRCIAHYVLPKQSLQQAVTVISAVCTHPGS

SEQ ID NO: 7863 - protein, 746 aa, Escherichia coli 2534-86; identical to SEQ ID NO: 6296

SEQ ID NO: 7864 - protein, 193 aa, Escherichia coli 2534-86
MRYLATLLLSLAVLITAGCGWHLRDTTQVPSTMKVMILDSGDPNGPLSRAVRNQLRLNGVELLDKETTRKDVPSLRLGKVSIAKDTASVFRNGQTAEYQMIMTVNATVLIPGRDIYPISAKVFRSFFDNPQMALAKDNEQDMIVKEMYDRAAEQLIRKLPSIRAADIRSDKEQTSTTTDTPATPARVSTTLGN

SEQ ID NO: 7865 - protein, 243 aa, Escherichia coli 2534-86; identical to SEQ ID NO: 6463

SEQ ID NO: 7866 - protein, 833 aa, Escherichia coli 2534-86
MAALSPPFIKYLSGMDTVNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGVLMDYNLFASSYRPQDGSSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAIGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 7867 - protein, 430 aa, Escherichia coli 2534-86; identical to SEQ ID NO: 5758

SEQ ID NO: 7868 - protein, 361 aa, Escherichia coli 2534-86
MKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGNGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 7869 - protein, 224 aa, Escherichia coli 2534-86
MTVSLTAILLSCSSAWAAGKGGIGLAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLGEAPAKLRCTSSADMVTVSNPTPYFITLTDLKIGGKVVKNQMISPFDKYQFSLPKGAKNSSVTYRTINDYGAETPQLNCKS

SEQ ID NO: 7870 - protein, 591 aa, Escherichia coli 2534-86
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKITPG

SEQ ID NO: 7871 - protein, 128 aa, Escherichia coli 2534-86
MDRETLFELSIASVPSGKVENQSVKVAMRSVFKLFWRPEGLPGDPLEAYQQLRWTRNSQGVQLTNPTPYYINLIQLSVNGKALSNAGVVPPKSQRQTSWCQAIAPCHVAWRAINDYGGLSAKKEQNLP

SEQ ID NO: 7872 - protein, 331 aa, Escherichia coli 2534-86; identical to SEQ ID NO: 6456

SEQ ID NO: 7873 - protein, 760 aa, Escherichia coli 2534-86
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGVNANGQTDTFAIYAFDTLQITRDFELNGGIRLDNYHTEYDSATACGGSGRGAITCPTGVAKGSPVTTVDTAKSGNLVNWKAGALYHLTENGNVYINYAVSQQPPGGNNFALAQSGSGNSVNRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 7874 - protein, 203 aa, Escherichia coli 2534-86; identical to SEQ ID NO: 6414

SEQ ID NO: 7875 - protein, 696 aa, Escherichia coli 2534-86; identical to SEQ ID NO: 6320

SEQ ID NO: 7876 - protein, 191 aa, Escherichia coli 2534-86; identical to SEQ ID NO: 5748

SEQ ID NO: 7877 - protein, 232 aa, Escherichia coli 2534-86; identical to SEQ ID NO: 5747

SEQ ID NO: 7878 - protein, 729 aa, Escherichia coli 2534-86
MLSTQFNRDNQYQASTKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQHIDVNSPTWGGLPRWNTDGSSNSYDRARSTAPDWAYNDKEINKVFMTLKQRFADTWQATLNATHSEVEFDSKMMYVDAYVNKADGMLIGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 7879 - protein, 565 aa, Escherichia coli 2534-86; identical to SEQ ID NO: 6492

SEQ ID NO: 7880 - protein, 207 aa, Escherichia coli 2534-86; identical to SEQ ID NO: 5743

SEQ ID NO: 7881 - protein, 539 aa, Escherichia coli 2534-86; identical to SEQ ID NO: 6525

SEQ ID NO: 7882 - protein, 646 aa, Escherichia coli 2534-86
MRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 7883 - protein, 236 aa, Escherichia coli 2534-86; identical to SEQ ID NO: 6472

SEQ ID NO: 7884 - protein, 512 aa, Escherichia coli 2534-86; identical to SEQ ID NO: 5697

SEQ ID NO: 7885 - protein, 111 aa, Escherichia coli 2534-86
MKKQIEGMTMKKVLALVVAAAMGLSSAAFAAETATTPAPTATTTKAAPAKTTHHKKQHKAAPAQKAQAAKKHHKNTKAEQKAPEQKAQAAKKHAGKHSHQQPAKPAAQPAA

SEQ ID NO: 7886 - protein, 118 aa, Escherichia coli 2534-86 [sequence omitted]

SEQ ID NO: 7887 - protein, 380 aa, Escherichia coli 2534-86
MLVPALLVAGAANAAEIYNKNGNKLDLYGKVDARHTFSDNPGDDGDETIIELGFKGETQITDQLTGYGQALTKTKASDTEGSDNTYVKLAFAGLKFGEMGSFDYGRNYGVIYDVEAWTDMLPVFGGDSYTWTDNFMAGRANGVATYRNSDFFGLVEGLNFALQYQGNNEGSNAGEDQEGTKNGHEDVRFQNGDGFGLSTSYDFDFGLSLGAAYSNSDRTNSQVALGGYHYNEYSKFAGGDTAEAWTFGAKYDANNVYLAMMYAETRNMTPYGNVGIANKTQNFEAVAQYQFDFGLRPSLAYVYSKGKDLGGNDYNNNGHQEYVDQDLVNYVEIGATYYFNKNFSTYVDYKINLLDKDDDFYDNNGIATDDVVGVGLVYQF

SEQ ID NO: 7888 - protein, 823 aa, Escherichia coli 2534-86
MTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGGWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 7889 - protein, 224 aa, Escherichia coli 2534-86; identical to SEQ ID NO: 6435

SEQ ID NO: 7890 - protein, 641 aa, Escherichia coli 2534-86; identical to SEQ ID NO: 7667

SEQ ID NO: 7891 - protein, 828 aa, Escherichia coli 2534-86
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKYPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 7892 - protein, 162 aa, Escherichia coli 2534-86; identical to SEQ ID NO: 5896

SEQ ID NO: 7893 - protein, 363 aa, Escherichia coli 2534-86
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGREALRQNGDGVGGSITYDYEGFGIGAAVSSSKRTDDQNSPLYIGNGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNQFTRDAGINTDNIVALGLVYQF

SEQ ID NO: 7894 - protein, 192 aa, Escherichia coli 2534-86
MKSKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRLLQCGNEIYSAIKDLQSKAPDKNIVIFTHNHCLTYIAKNKRDATFKPDYLDGLVMHVEKGKVYLDGEFVNH

SEQ ID NO: 7895 - protein, 274 aa, Escherichia coli 2534-86
MNKTAIALLALLASSASLAATPWQKITQPVPGSAQSIGSFSNGCIVGADTLPIQSEHYQVMRTDQRRYFGHPDLVMFIQRLSSQVSNLGMGTVLIGDMGMPAGGRFNGGHASHQTGLDVDIFLQLPKTRWTSAQLLRPQALDLVSRDGKHVVSSLWKPEIFSLIKLAAQDKNVTRIFVNPAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 7896 - protein, 250 aa, Escherichia coli 2534-86
MFNLTNTAKIVVPALALLATAVSFSSHASVTPDRTRLVFNESDKSISVTLRNNDPTLPYLAQSWIEDAKGNKISSPLAVLPPVQRIDAMMNGQVKVQGLPDINKLPADRESVFYFNVREIPPKSNKPNTLQIALQTRIKLFWRPKALENTSMKSPWQHKVTLIRNGQDFTVNNPTPYYVIISNASAKKGGNPPAGFTPLMMEPKTSAPLNAKMDSVPVLTYINDYGARMPLYFICTGNSCQVDEEQSRKG

SEQ ID NO: 7897 - protein, 862 aa, Escherichia coli 2534-86
MSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNRLPENAEATQSVVQATLTEGAIGYRKFAVISGQKAMAVLRLSDGSHPPFGAEVKNDNEQTVGLVDDDGNVYLAGVKPGEHMSVFWSGVAHCDINLPDPLPADLFNGLLLPCQHKGNVAPITSPAVKPAIQEQTQRVTPTEPPTSISVNQ

SEQ ID NO: 7898 - protein, 518 aa, Escherichia coli 2534-86; identical to SEQ ID NO: 6358

SEQ ID NO: 7899 - protein, 66 aa, Escherichia coli 2534-86
MVGPPGPKGEQGPAGPQGPKGDKGERGDTGPVGATGERGPAGDAGPAGPQGPKGDRGEGESGERPV

SEQ ID NO: 7900 - protein, 432 aa, Escherichia coli 2534-86; identical to SEQ ID NO: 5727

SEQ ID NO: 7901 - protein, 360 aa, Escherichia coli 2534-86; identical to SEQ ID NO: 6702

SEQ ID NO: 7902 - protein, 686 aa, Escherichia coli 2534-86; identical to SEQ ID NO: 6453

SEQ ID NO: 7903 - protein, 834 aa, Escherichia coli 2534-86
MYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEEAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGCFVYLNGIQDDSKLTLRWGDKSCFIQPPNSSNLTTGTVILPCISQN

SEQ ID NO: 7904 - protein, 125 aa, Escherichia coli 2534-86
MRYLNTKNLIAAGVLLACMSSIAWGAIIPDRTRIIMNESDKGEALKLTNQSKNLPYLAQTWIEDTKGNKSRDFIVTVPPMVRLNPSEQIQIRMISQEKIAQLPNDRETLFYFNVREIPPKTDKKM

SEQ ID NO: 7905 - protein, 231 aa, Escherichia coli 2534-86; identical to SEQ ID NO: 6351

SEQ ID NO: 7906 - protein, 838 aa, Escherichia coli 2534-86; identical to SEQ ID NO: 7363

SEQ ID NO: 7907 - protein, 678 aa, Escherichia coli 2534-86; identical to SEQ ID NO: 6353

SEQ ID NO: 7908 - protein, 386 aa, Escherichia coli 2534-86
MVDDVPVAQVLQALAEQEKLNLVVSPDVSGTVSLHLTDVPWKQALQTVVKSAGLITRQEDNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 7909 - protein, 843 aa, Escherichia coli 2534-86
MHWMHLPLYHYRAHFSFSLLALTIASSLPAYGGKFNPKFLENVQGIDQHIDLSVYDSPVGQQIPGKYRVSVFVNEEKMASRTLDFSTASEAKRKASGESLMPCLSRVQLEEMGVRVDSFPALKMSPPEACVAFDEIIPQATSRFDFNTQTLHLSFPQAAMMMTARGTVDPSRWDEGIPALLLDYSFSGSNGRNEGTGSSSDSTSDSYYLNLRSGLNVGPWRLRNNSIWNRTDGKNQWDNVGTSLNRAIIPLKSQITLGDTATPGEIFDSVQMRGALLASDDEMLPDSQRGFAPVVRGIAKSNAEVSIEQNGYVIYRTFVQPGAFEINDLYATSGSGDLTVIIKEADGSEQRFIQPFSAVAIFQREGYLKYSLAAGEYRAGNYDSDKPHFGQFTAMYGLPWGMTAYGGALLSADYNALALGLGKNFGTIGAVSVDVTQAKSQLRNNEKEEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSVAYTWTRSPEWEEDDRLWSFSVSIPLGGAWSSYRMTTDQNGKTSQQASVSGTLLEDRNLSYNVQQGYTSNGVGYSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNVELQEAFQKVVPTRGAVVRSRFDTRVGYRVLMSLKQANGNAVPFGATAALIDESKPASSIVGEEGQLYISGMPEEGELQVSWGNEQAQRCRVPFRLPENKDNAAIVMVNAVCEK

SEQ ID NO: 7910 - protein, 228 aa, Escherichia coli 2534-86; identical to SEQ ID NO: 6185

SEQ ID NO: 7911 - protein, 243 aa, Escherichia coli 2534-86; identical to SEQ ID NO: 6145

SEQ ID NO: 7912 - protein, 208 aa, Escherichia coli 2534-86; identical to SEQ ID NO: 5717

SEQ ID NO: 7913 - protein, 614 aa, Escherichia coli 2534-86
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVENGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGASLWDLAVAYPVTSHLTVRGKIANLFDKDYETVYGYQTAGREYTLSGSYTF

SEQ ID NO: 7914 - protein, 446 aa, Escherichia coli 2534-86; identical to SEQ ID NO: 6459

SEQ ID NO: 7915 - protein, 699 aa, Escherichia coli 2534-86
MSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLRQELVGQVYYRDESLRFYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLPLTKSVNVSDSKLEGVKVDSYELGWRFTGDNLRTQIAAYYSLSNKSVERNKDLTISVKDDRRRIYGVEGAVDYLIPDTDWSTGVNFNVLKTESKVNGQWQKYDVKESSPSKATAYISWAPEPWSLRVQSTTSFDVSDAEGNDINGYTTVDFISSWLLPVGTLSFSVENLFDRDYTTVWGQRAPLYYSPGYGPASLYDYKGRGRTFGLNYSVLF

SEQ ID NO: 7916 - protein, 784 aa, Escherichia coli 3030-1; identical to SEQ ID NO: 6283

SEQ ID NO: 7917 - protein, 170 aa, Escherichia coli 3030-1 [sequence omitted]

SEQ ID NO: 7918 - protein, 866 aa, Escherichia coli 3030-1
MTIKPTKNYHNHLTRIATFCALLYCNSAFCAELVEYDHTFLMGQNASNIDLSRYSEGNPAIPGVYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGSLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 7919 - protein, 230 aa, Escherichia coli 3030-1; identical to SEQ ID NO: 7855

SEQ ID NO: 7920 - protein, 747 aa, Escherichia coli 3030-1; identical to SEQ ID NO: 6343

SEQ ID NO: 7921 - protein, 266 aa, Escherichia coli 3030-1; identical to SEQ ID NO: 5772

SEQ ID NO: 7922 - protein, 161 aa, Escherichia coli 3030-1; identical to SEQ ID NO: 5769

SEQ ID NO: 7923 - protein, 351 aa, Escherichia coli 3030-1; identical to SEQ ID NO: 6367

SEQ ID NO: 7924 - protein, 222 aa, Escherichia coli 3030-1
MLIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKWGNAMAAPRVSSQIPLPSGVQGKLKFQTVNDYGSVTPVREVNLN

SEQ ID NO: 7925 - protein, 820 aa, Escherichia coli 3030-1
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQITLLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYATLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSIGITSMWVMTGKFI

SEQ ID NO: 7926 - protein, 746 aa, Escherichia coli 3030-1
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYQQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTNF

SEQ ID NO: 7927 - protein, 193 aa, Escherichia coli 3030-1; identical to SEQ ID NO: 6300

SEQ ID NO: 7928 - protein, 240 aa, Escherichia coli 3030-1
MKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPAPEKNSDHAVLQVAIQSRIKVFWRPAALRKKAGEKVELQLQVSQQGNQLTLKNPTAYYLTIAYLGRNEKGVLPGFKTVMVAPFSTVNTNTGNYSGSQFYLGYMDDYGALRMTTLNCSGQCHLQAVEAKK

SEQ ID NO: 7929 - protein, 819 aa, Escherichia coli 3030-1; identical to SEQ ID NO: 6642

SEQ ID NO: 7930 - protein, 430 aa, Escherichia coli 3030-1
MKQALRVAFGFLILWASVLHAEVRIVIDSGVDSGRPIGVVPFQWAGPGAAPEDIGGIVAADLRNSGKFNPLDRARLPQQPGSAQEVQPAAWSALGIDAVVVGQVTPNPDGSYNVAYQLVDTGGAPGTVLAQNSYKVNKQWLRYAGHTASDEVFEKLTGIKGAFRTRIAYVVQTNGGQFPYELRVSDYDGYNQFVVHRSPQPLMSPAWSPDGSKLAYVTFESGRSALVIQTLANGSVRQVASFPRHNGAPAFSPDGSKLAFALSKTGSLNLYVMDLASGQIRQVTDGRSNNTEPTWFPDSQNLAFTSDQAGRPQVYKVNINGGAPQRITWEGSQNQDADVSSDGKFMVMVSSNGGQQHIAKQDLATGGVQVLSSTFLDETPSLAPNGTMVIYSSSQGMGSVLNLVSTDGRFKARLPATDGQVKFPAWSPYL

SEQ ID NO: 7931 - protein, 365 aa, Escherichia coli 3030-1
MKKLTVAISAVAASVLMAMSAQAAEIYNKDSNKLDLYGKVNAKHYFSSNDADDGDTTYVRLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRSDFDNYTEGNGDGFGFSATYEYEGFGIGATYAKSDRTDTQVNAGKVLPEVFASGKNAEVWAAGLKYDANNIYLATTYSETQNMTVFADHFVANKAQNFEAVAQYQFDFGLRPSVAYLQSKGKDLGVWGDQDLVKYVDVGATYYFNKNMSTFVDYKINLLDKNDFTKALGVSTDDIVAVGLVYQF

SEQ ID NO: 7932 - protein, 331 aa, Escherichia coli 3030-1; identical to SEQ ID NO: 6456

SEQ ID NO: 7933 - protein, 760 aa, Escherichia coli 3030-1; identical to SEQ ID NO: 6455

SEQ ID NO: 7934 - protein, 226 aa, Escherichia coli 3030-1
MIFAVLSLLVAGELRAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQLSVNGKALSNAGVVPPKSQRQTSWCQAIAPCHVAWRAINDYGGLSAKKEQNLP

SEQ ID NO: 7935 - protein, 203 aa, Escherichia coli 3030-1; identical to SEQ ID NO: 6414

SEQ ID NO: 7936 - protein, 361 aa, Escherichia coli 3030-1; identical to SEQ ID NO: 7868

SEQ ID NO: 7937 - protein, 224 aa, Escherichia coli 3030-1; identical to SEQ ID NO: 7869

SEQ ID NO: 7938 - protein, 591 aa, Escherichia coli 3030-1; identical to SEQ ID NO: 7870

SEQ ID NO: 7939 - protein, 505 aa, Escherichia coli 3030-1
MSAAVMLTLYTSSSWAFSIDDVAKQAQSLAGKGYEAPKSNLPSVFRDMKYADYQQIQFNHDKAYWNNLKTPFKLEFYHQGMYFDTPVKINEVTATAVKRIKYSPDYFTFGDVQHDKDTVKDLGFAGFKVLYPINSKDKNDEIVSMLGASYFRVIGAGQVYGLSARGLAIDTALPSGEEFPRFKEFWIERPKPTDKRLTIYALLDSPRATGAYKFVVMPGRDTVVDVQSKIYLRDKVGKLGVAPLTSMFLFGPNQPSPANNYRPELHDSNGLSIHAGNGEWIWRPLNNPKHLAVSSFSMENPQGFGLLQRGRDFSRFEDLDDRYDLRPSAWVTPKGEWGKGSVELVEIPTNDETNDNIVAYWTPDQLPEPGKEMNFKYTITFSRDEDKLHAPDNAWVQQTRRSTGDVKQSNLIRQPDGTIAFVVDFTGAEMKKLPEDTPVTAQTSIGDNGEIVESTVRYNPVTKGWRLVMRVKVKDAKKTTEMRAALVNADQTLSETWSYQLPANE

SEQ ID NO: 7940 - protein, 191 aa, Escherichia coli 3030-1
MKKSLLGLTFASLMFSAGSAVAADYKIDKEGQHAFVNFRIQHLGYSWLYGTFKDFDGTFTFDEKNPAADKVNVKINTTSVDTNHAERDKHLRSADFLNTEKYPQATFTSTSVKKDGDELDITGDLTLNGVTKPVTLEAKLIGQGDDPWGGKRAGFEAEGKIKLKDFNIKTDLGPASQEVDLIISVEGVQQK

SEQ ID NO: 7941 - protein, 232 aa, Escherichia coli 3030-1; identical to SEQ ID NO: 5747

SEQ ID NO: 7942 - protein, 729 aa, Escherichia coli 3030-1
MLSTQFNRDNQYQASTKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGTPRNFSITSTYQF

SEQ ID NO: 7943 - protein, 207 aa, Escherichia coli 3030-1; identical to SEQ ID NO: 5743

SEQ ID NO: 7944 - protein, 551 aa, Escherichia coli 3030-1; identical to SEQ ID NO: 5742

SEQ ID NO: 7945 - protein, 700 aa, Escherichia coli 3030-1
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 7946 - protein, 366 aa, Escherichia coli 3030-1
MKLKIVAVVVTGLLAANVAHAAEVYNKDGNKLDLYGKVTALRYFTDDKRDDGDKTYARLGFKGETQINDQMIGFGHWEYDFKGYNDEANGSRGNKTRLAYAGLKISEFGSLDYGRNYGVGYDIGSWTDMLPEFGGDTWSQKDVFMTYRTTGVATYRNYDFFGLIEGLNFAAQYQGKNERTDNSHLYGADYTRANGDGFGISSTYVYDGFGIGAVYTKSDRTNAQERAAANPLNASGKNAELWATGIKYDANNIYFAANYAETLNMTTYGDGYISNKAQSFEVVAQYQFDFGLRPSLAYLKSKGRDLGRYGDQDMIEYIDVGATYFFNKNMSTYVDYKINLIDESDFTRAVDIRTDNIVATGITYQF

SEQ ID NO: 7947 - protein, 236 aa, Escherichia coli 3030-1; identical to SEQ ID NO: 6472

SEQ ID NO: 7948 - protein, 438 aa, Escherichia coli 3030-1
MGSRGLIRKILAISGVGKYIKDDIGFSYQGYFRSGWGTGNHGSPQTYAAGSLGRFGNEMSGWFDLTLNQRVYNQDGKTANAVVTYDGNVGEQYNDAWFGDSANENIMQFSDIYLTTRGFLPFAPEADFWVGKHKLPQYEIQMLDWKTLTTDVAAGVGIENWALGVGLFDMSLSRDDVDVYSRDFSRTSQMNTNSVDVRYRNIPLWDDATLSLMAKYSAPNKTDQQQDNENDNSYFEMKDSWMLTSVLRQNLQRDTFNEFTLQVANNSYASSFASFSDASNTMAHGRYYYGDHTNGIAWRLISQGEMYLTDNIIMANALVYSHGEDVYSYESGAHSDFDSIRTVIRPAWIWNTWNQTGLELGWFKQQNKTQQGVTLNESAYKTTLWHALKVGESILGSRPEIRFYGTYINILDNELSNFKFNENSKDEFMAGIQAEVWW

SEQ ID NO: 7949 - protein, 111 aa, Escherichia coli 3030-1; identical to SEQ ID NO: 7885

SEQ ID NO: 7950 - protein, 387 aa, Escherichia coli 3030-1; identical to SEQ ID NO: 7356

SEQ ID NO: 7951 - protein, 118 aa, Escherichia coli 3030-1 [sequence omitted]

SEQ ID NO: 7952 - protein, 823 aa, Escherichia coli 3030-1
MTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 7953 - protein, 224 aa, Escherichia coli 3030-1; identical to SEQ ID NO: 6302

SEQ ID NO: 7954 - protein, 641 aa, Escherichia coli 3030-1
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNAVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 7955 - protein, 828 aa, Escherichia coli 3030-1; identical to SEQ ID NO: 6558

SEQ ID NO: 7956 - protein, 162 aa, Escherichia coli 3030-1; identical to SEQ ID NO: 6365

SEQ ID NO: 7957 - protein, 363 aa, Escherichia coli 3030-1
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGREALRQNGDGVGGSITYDYEGFGIGAAVSSSKRTDDQNSPLYIGNGDRAETYTGGLKYDANNIYLAAQYTQTYNATRVGSLGWANKAQNFEAVAQYQFDFGLRPSLAYLQSKGKNLGRGYDDEDILKYVDIGATYYFNKNMSTYVDYKINLLDDNQFTRDAGINTDNIVALGLVYQF

SEQ ID NO: 7958 - protein, 192 aa, Escherichia coli 3030-1; identical to SEQ ID NO: 7894

SEQ ID NO: 7959 - protein, 227 aa, Escherichia coli 3030-1
MSAQASVTPDRTRLIFNESDKSISVTLRNNDPKLPYLAQSWIEDEKGNKISSPLTVLPPVQRIDSMMNGQVKVQGMPDINKLPADRESLFYFNVREIPPKTNKANTLQIALQTRIKLFWRPKALENVSMKNPWQYKVTLTRNGQEFTVNNPTPYYVIFSNASTQKNGNPAAGFSPIVMSPKTSAPLNVKMGSVPVLTYVNDYGARMPLFFTCNGNSCQVDEEQSRKG

SEQ ID NO: 7960 - protein, 739 aa, Escherichia coli 3030-1
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGAGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEV

SEQ ID NO: 7961 - protein, 472 aa, Escherichia coli 3030-1; identical to SEQ ID NO: 7376

SEQ ID NO: 7962 - protein, 432 aa, Escherichia coli 3030-1; identical to SEQ ID NO: 5727

SEQ ID NO: 7963 - protein, 523 aa, Escherichia coli 3030-1
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKSASC

SEQ ID NO: 7964 - protein, 834 aa, Escherichia coli 3030-1
MYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEEAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGELSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 7965 - protein, 231 aa, Escherichia coli 3030-1
MSSIAWGAIIPDRTRIIMNESDKGEALKLTNQSKNLPYLAQTWIEDTKGNKSRDFIVTAPPMVRLNPSEQIQIRMISQEKIAQLPNDRETLFYFNVREIPPKTDKKNVMQVTMQHALKLFWRPKAIELEDDGVMSYEKVEIIRRNDGSIRFNNKMPYHVTLGYIGTNGITMLPQTQSLMVTPYSHADTQFKNVPSAFQVGYINDFGGLSFYEINCPTVNNSCNVSVAKRDK

SEQ ID NO: 7966 - protein, 199 aa, Escherichia coli 3030-1
MIYDASRKEAALPVANKGAETPYLLQSWVDNIDGTSRAPFIITPPLFRLEAGDDSSLRIIKTADNLPENKESLFYINVRAIPAKKKSDDVNANELTLVFKTRIKMFYRPAHLKGRVNDAWTSLEFKRSDHSLNIYNPTEYYVVFAGLAVDKTDLTSKIEYIAPGEHKQLPLPASGGKNVKWAAINDYGGSSGTETRPLQ

SEQ ID NO: 7967 - protein, 721 aa, Escherichia coli 3030-1
MDEIPALAEKDDDSVINSLEQIIPGTAAEFDFNHQRLNLSIPQIALYRDAKGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 7968 - protein, 678 aa, Escherichia coli 3030-1
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPAPVSTPAATTTAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGTPITPRATTDSGMTTNNPTLQTTPTDDQFTNNGGRVDAVYIVATPGEIAFIKPMIAMRNGSQSGAMLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 7969 - protein, 243 aa, Escherichia coli 3030-1; identical to SEQ ID NO: 6145

SEQ ID NO: 7970 - protein, 208 aa, Escherichia coli 3030-1; identical to SEQ ID NO: 5717

SEQ ID NO: 7971 - protein, 614 aa, Escherichia coli 3030-1
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHFGRYDSSATLDEMKQYTVQWANNVIVGHGSIGAGVDWQKQTTTPGTGYVENGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 7972 - protein, 446 aa, Escherichia coli 3030-1; identical to SEQ ID NO: 6459

SEQ ID NO: 7973 - protein, 237 aa, Escherichia coli 3030-1; identical to SEQ ID NO: 6458

SEQ ID NO: 7974 - protein, 368 aa, Escherichia coli 3030-1
MNKTITALAIMMASFAANASVLPETPVPFKSGTGAIDNDTVYIGLGSAGTAWYKLDTQAKDKKWTALAAFPGGPRDQATSAFIDGNLYVFGGIGKNSKGLTQVFNDVHKYNPKTNSWVKLMSHAPMGMAGHVTFVHNGKAYVTGGVNQNIFNGYFEDLNEAGKDSATIDKINAHYFDKKAEDYFFNKFLLSFDPSTQQWSYAGESPWYGTAGAALVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 7975 - protein, 774 aa, Escherichia coli 3030-1
MTPLRVFRKTTPLVNAIRLSLLPLAGLSFSAFAAQVNIAPGSLDKALNQYAAHSGITLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEACVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRSYDRFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 7976 - protein, 360 aa, Escherichia coli 3030-1; identical to SEQ ID NO: 6702

SEQ ID NO: 7977 - protein, 512 aa, Escherichia coli 3030-1; identical to SEQ ID NO: 6251

SEQ ID NO: 7978 - protein, 216 aa, Escherichia coli 3030-1
MAMMVAGRAEAGVALGATRVIYPAGQKQVQLAVTNNDENSTYLIQSWVENADGVKDGRFIVTPPLFAMKGKRENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 7979 - protein, 863 aa, Escherichia coli 3030-1
MHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGVQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 7980 - protein, 331 aa, Escherichia coli 3431; identical to SEQ ID NO: 6551

SEQ ID NO: 7981 - protein, 660 aa, Escherichia coli 3431
MGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPTGVAKGSPVTTVDTAKSGNLMNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 7982 - protein, 353 aa, Escherichia coli 3431
MTERELSIIRALGEEFATVLADLQHTFEEKMAAQAQAFEEKLASLSAVLQKHVTVDEVHPVLQAMVDDAVGTIPVPRDGRDYDPDVLQQAVNDAVANIPVPADGKSITPDDVRPMLEQMVKEAVSHIPAPRDGRDYDPDVLQQAVNDAVANIPVPADGKSITPDDVRPMLEQMVKEAVSHIPAPRDGRDYDPEVLKQAVLEAVNALPAPQDGRDATALEVLPAIDDQKSFPRGTYATHLGGLWRAYEKTHGMRGWECLVDGVADIDVSMTGERLFSVVIRQSSGQCTEKTFSLPVMLYRGVFRAGETYHPGDTVTWGGSLWHCNSMTADKPGDAHASGWTLAAKRGRDAGGGK

SEQ ID NO: 7983 - protein, 539 aa, Escherichia coli 3431
MAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGIIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 7984 - protein, 700 aa, Escherichia coli 3431
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNLGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 7985 - protein, 203 aa, Escherichia coli 3431; identical to SEQ ID NO: 6414

SEQ ID NO: 7986 - protein, 361 aa, Escherichia coli 3431; identical to SEQ ID NO: 7868

SEQ ID NO: 7987 - protein, 233 aa, Escherichia coli 3431; identical to SEQ ID NO: 6411

SEQ ID NO: 7988 - protein, 591 aa, Escherichia coli 3431
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNHLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGISWNYSKSRGQPDADQVFALNFSLPLNLLLPRSNDSYTRKKITPG

SEQ ID NO: 7989 - protein, 226 aa, Escherichia coli 3431; identical to SEQ ID NO: 6432

SEQ ID NO: 7990 - protein, 102 aa, Escherichia coli 3431; identical to SEQ ID NO: 6385

SEQ ID NO: 7991 - protein, 650 aa, Escherichia coli 3431; identical to SEQ ID NO: 6393

SEQ ID NO: 7992 - protein, 897 aa, Escherichia coli 3431; identical to SEQ ID NO: 6392

SEQ ID NO: 7993 - protein, 386 aa, Escherichia coli 3431
MVDDVPVAQVLQALAEQEKLNLVVSPDVSGTVSLHLTDVPWKQALQTVVKSAGLITRQEGNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 7994 - protein, 208 aa, Escherichia coli 3431; identical to SEQ ID NO: 5717

SEQ ID NO: 7995 - protein, 696 aa, Escherichia coli 3431
MRITTLASVVIPCLGFSASSITAAEDVMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPDLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 7996 - protein, 732 aa, Escherichia coli 3431
MMRKKYMPRALGPLLLVVLSPAVAQQNDDNEIIVSASRSNRTVAEMTQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLRQELVGQVYYRDESLRFYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLPLTKSVNVSDSKLEGVKVDSYELGWRFTGDNLRTQIAAYYSLSNKSVERNKDLTISVKDDRRRIYGVEGAVDYLIPDTDWSTGVNFNVLKTESKVNGQWQKYDVKESSPSKATAYISWAPEPWSLRVQSTTSFDVSDAEGNDINGYTTVDFISSWLLPVGTLSFSVENLFDRDYTTVWGQRAPLYYSPGYGPASLYDYKGRGRTFGLNYSVLF

SEQ ID NO: 7997 - protein, 191 aa, Escherichia coli 3431; identical to SEQ ID NO: 5748

SEQ ID NO: 7998 - protein, 232 aa, Escherichia coli 3431; identical to SEQ ID NO: 5747

SEQ ID NO: 7999 - protein, 729 aa, Escherichia coli 3431; identical to SEQ ID NO: 6402

SEQ ID NO: 8000 - protein, 213 aa, Escherichia coli 3431; identical to SEQ ID NO: 5744

SEQ ID NO: 8001 - protein, 213 aa, Escherichia coli 3431
MIFPVHAGMVIFGTRIIYPAEQKEVMVQLMNQGNRSSLMQAWIDDGDTSLPPEKIQVPFMLTPPVVKVAANSGQQIKIKIMPNKLPSNKESIFYLNVLDIPPNSPEQEGKNALKFAMQNRIKLFYRPAGIAPVNKATFKKLLINRSGNGLVIKNDSANWVTISDVKANNVKVNYETIMIAPLESQSVNVKSNNANNWYLTIIDDHGNYISDKI

SEQ ID NO: 8002 - protein, 823 aa, Escherichia coli 3431
MTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYSWDIGVFRLDFSVPQAWVEELESGYVPPENWERGINAFYTSYYVSQYYSDYKASGNNKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYLSRDYRTFNDHVWANNKDNYRRDKNDIYDIADYYQNDFGRKNSFSANMSQSLPEGWGSVSLSTLWRDYWGRSGSSKDYQLSYSNNWRRISYTLAASQAYDENHHEEKRFNIFISIPFDWGDDVTTLRRQIYMSNSTTFDDQGVASNNTGLSGTVGSRDQFNYGVNLSYQHQENETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 8003 - protein, 663 aa, Escherichia coli 3431
MGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRAFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 8004 - protein, 119 aa, Escherichia coli 3431; identical to SEQ ID NO: 6116

SEQ ID NO: 8005 - protein, 614 aa, Escherichia coli 3431; identical to SEQ ID NO: 6387

SEQ ID NO: 8006 - protein, 446 aa, Escherichia coli 3431 [sequence omitted]

SEQ ID NO: 8007 - protein, 512 aa, Escherichia coli 3431
MKKISFFIFTALFCCSAQAAPSSLEKRLGKNEYFIITKSSPVRAILNDFAANYSIPVFISSSVNDDFSGEIKNEKPVKVLEKLSRLYHLTWYYDENILYIYKTNEISRSIITPTYLDIDSLLKYLSDTISVNKNSCNVRKITTFNSIEVRGVPECIKYITSLSESLDKEAQSKAKNKDVVKVFKLNYASATDITYKYRDQNVVVPGVVSILKTMASNGSLPSTGKGAVERSGNLFDNSVKISADPRLNAVVVKDREITMDIYQQLISELDIEQRQIEISVSIIDVDANDLQQLGVNWSGTLNAGQGTIAFNSSAAQANISSSVISNANNFMIRVNALQQNSKAKILSQPSIITLNNMQAILDKNVTFYTKVSGEKVASLESITSGTLLRVTPRILDDTPNSLTGKRRERVRLLLDIQDGNQSTSQSNIQDTGSLLPEVQNSEMTTEATLSAGESLLLGGFIQDKESSSKDGIPLLSDIPVIGSLFSSTVKQKHSVVRLFLIKATPIKSASSE

SEQ ID NO: 8008 - protein, 774 aa, Escherichia coli 3431
MTPLRVFRKTTPLVNTIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLSPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEIGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 8009 - protein, 199 aa, Escherichia coli 3431
MIYDASRKEAALPVANKGAETPYLLQSWVDNIDGKSRAPFIITPPLFRLEAGDDSSLRIIKTADNLPENKESLFYINVRAIPAKKKSDDVNANELTLVFKTRIKMFYRPAHLKGRVNDAWKSLEFKRSDHSLNIYNPTEYYVVFAGLAVDKTDLTSKIEYIAPGEHKQLPLPASGGKNVKWAAINDYGGSSGTETRPLQ

SEQ ID NO: 8010 - protein, 790 aa, Escherichia coli 3431
MLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQQLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVSAGAFEINDLYPSSNSGDLEVTIEESGGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWDYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGSVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 8011 - protein, 670 aa, Escherichia coli 3431
MKAARCLPVVLAALIFAGCGTHTPDQSTAYMQGTAQADSAFYLQQMQQSSDDTRINWQLLAIRALVKEGKTGQAVELFNQLPQELNDAQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITLRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRNLSWLQYQQGQVVPVS

SEQ ID NO: 8012 - protein, 799 aa, Escherichia coli 3431
MPGATRMLKKTLLAYTIGFAFSPPANADGIEIAAVDFDRETLKSLGVDPNISHYFSRSARFLPGEYSLIVSVNGEKKGNIATRFDENGDICLDQAFLQQAGLKIPSEEKNGCYDYILSYPGTTITPLPNQEALDIIVSPQAIIPIGLDLTNAATGGTAALLNYSLMSSRAEFSNGSSDYSQAALEGGININDWMLRSHQFLTQTNGTFSNQNSSTYLQRTFTDLKTLMRAGEVNLNNSVLEGASIYGIEIAPDNALQTSGSGVQVTGIANTSQARVEIRQQGVLIHSILVPAGAFTIPDVPVRNGNSDLNVTVVETDGSSHNYIVPSTLFNQHVESFQGYRFAIGRVDDDYDESPWVISASSGWNLTRWSAMNGGVIVAENYQAASIRSSLVPLPDLTVSSQISTSQDTKDSLQGQKYRLDANYNLPFSLGLTTSLTRSDRHYRELSEAIDDDYTDPTKSTYALGLNWSNSILGGFNISGYKTYSYDGDNDSSNLNINWNKAFKHATVSVNWQHQLSASENNEDDGDLFYVNISIPFGRSNTATLYTRHDDHKTHYGTGVMGVVSDEMSYYVNAERDHDERETSLNGSISSNLHYTQVSLAAGASGSDSRTYNGTMSGGIAVHDQGVTFSPWTINDTFTIAKMDNNIAGVRITSQAGPVWTDFRGNAVIPSIQPWRTSGVEIDTASLPKNVDIGNGTKMIKQGRGAVGKVGFSAITQRRALLNITLSDGKKLPRGVAIEDSEGNYLTTSVDDGVVFLNNIKPDMVLDIKDEQQSCRIHLTFPEDAPKDVFYETATGECQ

SEQ ID NO: 8013 - protein, 351 aa, Escherichia coli 3431; identical to SEQ ID NO: 6367

SEQ ID NO: 8014 - protein, 221 aa, Escherichia coli 3431
MKNYLWLVALLPLLSGCESQAILVKKDDAYFAPPKTEAPPPADGRAGGVFETGYNWSLTADRRAYRVGDILTVILEESTQSSKQAKTNFGKSNTVDIGAPTIFGHTKDKLSGSIDANRDFDGSATSQQQNSLRGEITVSVHAVQPNGILEIRGEKWLTLNQGDEYIRLSGLVRADDIQNDNSVSSQRIADARISYAGRGALSDANAAGWLTRLFNHPLFPI

SEQ ID NO: 8015 - protein, 746 aa, Escherichia coli 3431; identical to SEQ ID NO: 6710

SEQ ID NO: 8016 - protein, 869 aa, Escherichia coli 3431
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTVLGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNKRIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 8017 - protein, 230 aa, Escherichia coli 3431; identical to SEQ ID NO: 6360

SEQ ID NO: 8018 - protein, 161 aa, Escherichia coli 3431; identical to SEQ ID NO: 5769

SEQ ID NO: 8019 - protein, 266 aa, Escherichia coli 3431; identical to SEQ ID NO: 5772

SEQ ID NO: 8020 - protein, 747 aa, Escherichia coli 3431; identical to SEQ ID NO: 6343

SEQ ID NO: 8021 - protein, 230 aa, Escherichia coli 3431
MAFSSSSIADIVISGTRVIYKSDQKSVNVRLENKGNNPLLVQSWLDTGDDNAEPGSITVPFTATPPVSRIDAKRGQTIKLMYTASTSLPKDRESVFWFNVLEVPPKPDAEKVANQSLLQLAFRTRIKLFYRPDGLKGNPSEAPLALKWFWSGSEGKASLRVTNPTPYYVSFSSGDLEASGKRYPIDVKMIAPFSDEVMKVNGLNGKANSAKVHFYAINDFGGAIEGNARL

SEQ ID NO: 8022 - protein, 426 aa, Escherichia coli 3431
MTIEYTKNYHHLTRIATFCALLYCNTAFSAELVEYDHTFLMGQNASNIDLSRYSEGNPAIPGVYDVSVYVNDQPIINQSITFVAIEGKKNAQACITLKNLLQFHINSPDINNEKAVLLARDETLGNCLNLTEIIPQASVRYDVNDQRLDIDVPQAWVMKNYQNYVDPSLWENGINAAMLSYNLNGYHSETPGRKNESIYAAFNGGMNLGAWRLRASGNYNWMTDSGSNYDFKNRYVQRDIASLRSQLILGESYTTGETFDSVSIRGIRLYSDSRMLPPTLASFAPIIHGVANTNAKVTITQGGYKIYETTVPPGAFVIDDLSPSGYGSDLIVTIEESDGSKRTFSQPFSSVVQMLRPGVGRWDISGGQVLKDDIQDEPNLFQASYYYGLNNYLTGYTGIQITDNNYTAGLLGKVRISRSFLPKLTR

SEQ ID NO: 8023 - protein, 170 aa, Escherichia coli 3431 [sequence omitted]

SEQ ID NO: 8024 - protein, 784 aa, Escherichia coli 3431; identical to SEQ ID NO: 6283

SEQ ID NO: 8025 - protein, 227 aa, Escherichia coli 3431
MRIIIALLMSFFILPVHAGMVIYGTRIIYPKKNREVLVQLMNQSKNASLIQAWIDDGNTTIAPEKIQVLFILTPPVSRVAGGSGQQLKIRKMPNNLPHNKESLFYLNVLDIPPNNPQNAGKNKIKLALQNRIKLLWRPSGIAPVDKKSLSQLNIKKKNNAISINNETANWITVTTIKAQNVKVNNESILLPPFSNNDITLKNNHASEYELTVVDDYGNNIHSKIAAR

SEQ ID NO: 8026 - protein, 803 aa, Escherichia coli 3431
MYSFPGYAEETFDTHFMIGGMRGEKVSEYRFDNKQPLPGNYELDFYVNHQWRGKKDITIPESPAKPCLPKVLLTTLGVKTDNLNTEDNCILLDEAVHGGQYQWDISEHRLNLTIPQAYINELERGYVPPESWDRGIDAFYTSYNLSQYRSYDSNNNSNTASYGRFNSGLNLFSWQLHSDASYSKPDDMKGKWQSNTLYLERGWSQILSTVQIGENYTSSLIFDSLRFSGIRLFRDMQMLPDSMQSFTPLVQGVAQSNALITVSQNGYIIYQKEVPPGPFTIADLQLSGSGADLDVSIKEADGSVRSFLVPYSSVPNMLQPGVSNFDFIAGRSKIYGVKNQEDFLEANYIYGLNNLLTLYGGTILSDNYNAITLGNGWNTPLGAISFDATRSSSKLNNDITHEGTSYQVAYNKYLVQTATRFSVAAWRYASQDYRTFSDHLYENDKHNHQSEYDDFYDIGRKNSLSANIMQPLSNNLGNVSLSALWRNYWGRSGNAKDYQFSYSNSWQRISYTFSASQSYDENDKEEERFNLFISIPFYWGDDITKTRHQINLSNSTSFSKDGYSSNNTGVTGIAGEHDQLNYGIYVNQQQQNNDTSLGTNLSWRTPIAIIDGSYSHSKNTWQSGGSISSGLVVWPGGINITNQLSDTFAILDAPGLEGAHINGQKYNRTNSKGQVVYDLMIPHRENHLVLDIANSESETELQGNRQIIAPYRGAVSYVQFTTDQRKPWYIQALRPDGSPLTFGYDVLDLQENNIGVVGQGSRLFIRVDEIPTGIKVALNDEQNLFCTITFQHVIDENKTYICQ

SEQ ID NO: 8027 - protein, 368 aa, Escherichia coli 3431; identical to SEQ ID NO: 7693

SEQ ID NO: 8028 - protein, 76 aa, Escherichia coli 3431
MIRQSSGQRTEKTFSLPVMLYRGVFRAGETYHPGDTVTWGGSLWHCNSMTGDKPGEAHSSGWTLAAKRGRDAGGGK

SEQ ID NO: 8029 - protein, 207 aa, Escherichia coli 3431; identical to SEQ ID NO: 5743

SEQ ID NO: 8030 - protein, 565 aa, Escherichia coli 3431
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVANMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 8031 - protein, 203 aa, Escherichia coli 3431; identical to SEQ ID NO: 6396

SEQ ID NO: 8032 - protein, 518 aa, Escherichia coli 3431; identical to SEQ ID NO: 6358

SEQ ID NO: 8033 - protein, 641 aa, Escherichia coli 3431; identical to SEQ ID NO: 7667

SEQ ID NO: 8034 - protein, 828 aa, Escherichia coli 3431; identical to SEQ ID NO: 6366

SEQ ID NO: 8035 - protein, 162 aa, Escherichia coli 3431; identical to SEQ ID NO: 6365

SEQ ID NO: 8036 - protein, 367 aa, Escherichia coli 3431; identical to SEQ ID NO: 5789

SEQ ID NO: 8037 - protein, 192 aa, Escherichia coli 3431
MKSKKYIIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRLLQCGNEIYSAIKDLQSKAPDKNIVIFTHNHCLTYIAKDKRDATFKPDYLDGLVMHVEKGKVYLDGEFVNH

SEQ ID NO: 8038 - protein, 274 aa, Escherichia coli 3431; identical to SEQ ID NO: 6362

SEQ ID NO: 8039 - protein, 241 aa, Escherichia coli 3431
MGAMTLALLLSATSLSALASVTPDRTRLIFNESDKSISVTLRNNDPKLPYLAQSWIEDEKGNKITSPLTVLPPVQRIDSMMNGQVKVQGMPDINKLPADRESMFYFNVREIPPKSNKPNTLQIALQTRIKLFWRPKALEKVSMKSPWQHKVTLTRSGQAFTVNNPTPYYVIISNASAQKNGNPAAGFSPLVIEPKTTVPLNVKMDSVPVLTYVNDFGARMPLFFQCNGNSCQVDEEQSRKG

SEQ ID NO: 8040 - protein, 862 aa, Escherichia coli 3431
MSGSYSSVWAEDDIQFDSRFLELKGDTKIDLKRFSSQGYVEPGKYNLQVQLNKQPLAEEYDIYWYAGEDDVSKSYACLTPELVAQFGLKEDVAKNLQWSHDGKCLKPGQLEGVEIKADLSQSALVISLPQAYLEYTWPDWDPPSRWDDGISGIIADYSITAQTRHEENGGDDSNEISGNGTVGVNLGPWRMRADWQTNYQHTRSNDDDDEFGGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGGFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSEMVRTGNDKEMYTATYNQNFRDAGVSVYLNYTRHTYWDREEQTNYNIMLSHYFNMGSIRNMSVSLTGYRYEYDNRADKGMYISLSMPWGDNSTVSYNGNYGSGTDSSQVGYFSRVDDATHYQLNIGTSDKHTSVDGYYSHDGSLAQVDLSANYHEGQYTSAGLSLQGGATLTTHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGSVYLAGVKPGEHMSVFWSGVAHCDINLPDPLPADLFNGLLLPCQQKGNVAPVVPDDIKPVIQEQTQQVTPTDPPVSVSANQ

SEQ ID NO: 8041 - protein, 432 aa, Escherichia coli 3431; identical to SEQ ID NO: 5727

SEQ ID NO: 8042 - protein, 265 aa, Escherichia coli 3431
MKMRAVAVFTGMLTGVLSVTGLLSAGAYAAGGEGNMSASATETNARVFSLHLGATRVVYNPASSGETLTVINDQDYPMLVQSEVLSEDQKSPAPFVVTPPLFRLDGQQSSRLRIVRTYGEFPSDRESLQWICVKGIPPKEDDRWAEGKDGEKKADKVSLNVQLSVSSCIKLFVRPPAVKGRPDDVAGKVEWQRAGNRLKGVNPTPFYINLSALTVGGKEVKEREYIAPFSSREYPLPAGASGKVQWKVITDYGGTSKQFEAELKG

SEQ ID NO: 8043 - protein, 860 aa, Escherichia coli 3431; identical to SEQ ID NO: 5691

SEQ ID NO: 8044 - protein, 360 aa, Escherichia coli 3431; identical to SEQ ID NO: 6702

SEQ ID NO: 8045 - protein, 242 aa, Escherichia coli 3431; identical to SEQ ID NO: 6420

SEQ ID NO: 8046 - protein, 742 aa, Escherichia coli 3431
MGEISVKTGNNARNGGKNSLNRLIRCVCGKKIGPDPRNFNQRVSLGRNDLLIRTFLSIPQAWLAWHSENWAPPSTWKEGVAGVLMDYNLFASSYRPQDGSSSTNLNAYGTAGINAGAWRLRSDYQLNKTDSEDNHDQSGGISRTYLFRPLPQLGSKLTLGETDFSSNIFDGFSYTGAALASDDRMLPWELRGYAPQISGIAQTNATVTISQSGRVIYQKKVPPGPFVIDDLNQSVQGTLDVKVTEEDGRVNNFQVSAASTPFLTRQGQVRYKLAAGQPRPSMSHQTENETFFSNEVSWGMLSNTSLYGGLLISDDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTIHRMSWNDTLDERNSWGMSAGLQSDRPDNGAQVSGNYQHLSSAGEWDISGTYAASDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQLFTVVWGEQSCIIHLPERLEDTTKRLILPCH

SEQ ID NO: 8047 - protein, 430 aa, Escherichia coli 3431; identical to SEQ ID NO: 5758

SEQ ID NO: 8048 - protein, 360 aa, Escherichia coli 3431
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRNEVTEANGDGFGFSTTYEYEGFGVGATYAKSDRTNNQVIYGNNGLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVGMVYQF

SEQ ID NO: 8049 - protein, 351 aa, Escherichia coli 4_1_47FAA; identical to SEQ ID NO: 5767

SEQ ID NO: 8050 - protein, 230 aa, Escherichia coli 4_1_47FAA; identical to SEQ ID NO: 6360

SEQ ID NO: 8051 - protein, 412 aa, Escherichia coli 4_1_47FAA
MKIPTTTDIPQRYTWCLAGICYSSLAILPSFLSYAESYFNPAFLLENGTSVADLSRFERGNHQPAGVYRVDLWRNDEFIGSQDIVFESTTVNTGDKSGGLMPCFNQALLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFRARHSAVYHRNLLPTAGRNYLQITPPFC

SEQ ID NO: 8052 - protein, 746 aa, Escherichia coli 4_1_47FAA
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 8053 - protein, 243 aa, Escherichia coli 4_1_47FAA
MTFMKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPSPEKNSGHAVLQVAIQSRIKVFWRPSALRKKAGEKVELQLQVSQQGNQLNLKNPTGYYLTIAYLGRNEQGILPGFKTVMVAPFSTVNTNTGSYSGRQFYLGYMDDYGALRMTTLNCSGQCRLQAVEAKK

SEQ ID NO: 8054 - protein, 758 aa, Escherichia coli 4_1_47FAA
MNNNQISNGQKINWQKKGDKTIPCINDSLVDKFGLKPDIRQSLPQIDRCIDFSSRPEMLFNFDQANQQLNISIPQAWLAWHSENWAPPSTWKEGVAGVLMDYNLFASSYRPQDGSSSTNLNAYGTAGINAGAWRLRSDYQLNKTDSEDNHDQSGGISRTYLFRPLPQLGSKLTLGETDFSSNIFDGFSYTGAALASDDRMLPWELRGYAPQISGIAQTNATVTVSHSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLISGDDYHSAAMGIGQNMLWLGALSFDVTWASSQFDTQQDERGLSYRFNYSKQVDATNSTISLAAYRFSDRHFHSYANYLDHKYNDNDAQDEKQTISLSVGQPITPLNFNLYANLLHQTWWNADASTTANITAGFNVDIGNWRDISISTSFNTTHYEDKDRDNQIYLSISLPFGNGGRVGYDMQNSNHSTTHRMSWNDTLDERNSWGMSTGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVADNVIKETWIEGAIGYKSLASRSGKDVNVIIRNASGQFPPLGADIRQEDSGISVGMVGEEGHAWLSGVAENQQFTVVWGDSQHCSLYLPEHMENTANRLILPCH

SEQ ID NO: 8055 - protein, 193 aa, Escherichia coli 4_1_47FAA; identical to SEQ ID NO: 6300

SEQ ID NO: 8056 - protein, 430 aa, Escherichia coli 4_1_47FAA; identical to SEQ ID NO: 5758

SEQ ID NO: 8057 - protein, 878 aa, Escherichia coli 4_1_47FAA
MSYLNLRLYQRNTQCLHIRKHRLAGFFVRLVVACAFAAQAPLSSAELYFNPRFLADDPQAVADLSRFENGQELPPGTYRVDIYLNNGYMATRDVTFNTGDSEQGIVACLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQMADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTNNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 8058 - protein, 121 aa, Escherichia coli 4_1_47FAA
MNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 8059 - protein, 368 aa, Escherichia coli 4_1_47FAA
MNKTITALTIIMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLDPVSSPDGVAGGFAGISNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 8060 - protein, 212 aa, Escherichia coli 4_1_47FAA
MYKRKLLPLILWLLLSGAAAAQEYTTYSVLDKPVTETVQDNETVVEFFSFYCPPCYAFSQGYGIDGAIRESLPAGGKMVKYHADLLGSLGNELTRAWSVAMLSGLEEKVEPLLFEATMVSRTLKRPEDIRAVFVKAGMPAEEYELMLASQEVADMTEKQRRLFKEYGVTGTPSIYVNGRYHIQNSAFQADSVEAFRKSYVTAVMSLLNRKDK

SEQ ID NO: 8061 - protein, 243 aa, Escherichia coli 4_1_47FAA
MLKMKPALKKTLMAVACLSAVPAAQAAISLDRTRVIFNGGEKSMTLNVANDNKQLPYLAQAWIENEKQEKITTGPIVVTPPVQRLEPGAKSMVRLASTPDISKLPQDRESLFYFNLREIPPKSDKANVLQIALQTKIKLFYRPKAIEAKPNAVWQDQLVLNKTSGGYRIENPTPYYVTVIGLGGSEKQAKEGEFEAVMLAPKSTQTVKSGTYSTPYLSYINDYGGRPVLQFSCSGDRCTAVKK

SEQ ID NO: 8062 - protein, 843 aa, Escherichia coli 4_1_47FAA
MKNNTSFAVNGITYALMLSLVGAPAYAVDFNTDVLDAADRQNIDFSRFSQAGYIMPGQYQMEIMVNDQGISPSAFPVTFLEPPASGQDGKKPLPQACLTPEMVNRMGLTAASQEKVTYWNNGQCADLSQLPGVEIRPNPAEGMLYINMPQAWLEYSDASWLPPSRWDNGIPGLLFDYNINGTVNKPHKGKQSQSLSYNGTAGANFGAWRLRADYQGNLNHTTGSGQGTDSQFTWSRFYMYRAIPRWRANLTLGENYINSEIFSSWRYTGASLESDDRMLPPKLRGYAPQVSGIADTNARVVISQQGRILYDSTVPAGPFTIQDLDSSVRGRLDVEVIEQDGRKKTFQVDTAYVPYLTRPGQIRYKLVSGRSRNYEHTTEGPVFAAGEASWGISNKWSLYGGGIVAGDYNALAVGLGRDLNEFGTVSADVTQSVARIPGEDTKQGKSWRLSYSKRFDDVNADITFAGYRFSERNYMTMDQYLNARYRNDFTGREKELYTVTLNKNFEDWKTSVNLQYNHQTWWDRPASNSYTLSVNRYFDAFGFKNVSAGLAATRSRYSRNGVRGSGDNYNDSVFLRLSVPWGTGTASYSGSMSNDRYTNTVGYSDTLDKGLSSYSLNAGVSSGGGQPSQSQMSAYYNHSSPLANLSANFSAVENGYTSFGMSASGGATITAKGAALHAGGMNGRTRLLVDTDGVGGVPVDGGRVSTNRWGIGVVTDVSSYYRNTTSVDLNKLPEDMEATRSVVESVLTEGAIGYREFEVLKGSRLFAVLRLADNSHPPFGASVTNAKGRELGMVADSGLAWLSGVNPGETLNVGWDGRTQCVVDIPKNLDPAQQLPLPCRKAN

SEQ ID NO: 8063 - protein, 478 aa, Escherichia coli 4_1_47FAA
MTRIKINARRIFSLLIPFFFFTSVHAEQTAAPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQKAIGLNMEQIKAEKQDFIKTVIPQWEEQARKNGLLSQ

SEQ ID NO: 8064 - protein, 446 aa, Escherichia coli 4_1_47FAA; identical to SEQ ID NO: 7485

SEQ ID NO: 8065 - protein, 432 aa, Escherichia coli 4_1_47FAA; identical to SEQ ID NO: 5727

SEQ ID NO: 8066 - protein, 567 aa, Escherichia coli 4_1_47FAA
MKIKLCITIILISALCIFNGLLTPGAYAATANGYVANKENLRSFFETVSSYAGKPTIVSKLAMKKQISGNFDLTEPYALIERLSAQMGLIWYDDGKAIYIYDSSEMRNALINLRKVSTNEFNNFLKKSGLYNSRYEIKGGGNGTFYVSGPPVYVDLVVNAAKLMEQNSDGIEIGRNKVGIIHLVNTFVNDRTYELRGEKIVIPGMAKVLSTLLNNNIKQSTGVNVLSEISSRQQLKNVSRMPPFPGAEEDDDLQVEKIISTAGAPETDDIQIIAYPDTNSLLVKGTVSQVDFIEKLVATLDIPKRHIELSLWIIDIDKTDLEQLGADWSGTIKIGSSLSASFNNSGSISTLDGTQFIATIQALAQKRRAAVVARPVVLTQENIPAIFDNNRTFYTKLVGERTAELDEVTYGTMISVLPRFASRNQIELLLNIEDGNEINSDKTNVDDLPQVGRTLISTIARVPQGKSLLIGGYTRDTNTYESRKIPILGSIPFIGKLFGYEGTNANNIVRVFLIEPREIDERMMNNANEAAVDARAITQQMAKNKEINDELLQKWIKTYLNREVVGG

SEQ ID NO: 8067 - protein, 360 aa, Escherichia coli 4_1_47FAA; identical to SEQ ID NO: 6702

SEQ ID NO: 8068 - protein, 213 aa, Escherichia coli 4_1_47FAA; identical to SEQ ID NO: 5744

SEQ ID NO: 8069 - protein, 729 aa, Escherichia coli 4_1_47FAA
MLSTQFNRDNQHQTTSKPSLLAACIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 8070 - protein, 232 aa, Escherichia coli 4_1_47FAA; identical to SEQ ID NO: 7454

SEQ ID NO: 8071 - protein, 191 aa, Escherichia coli 4_1_47FAA
MKKSLLGLTFASLMFSAGSAVAADYKIDKEGQHAFVNFRIQHLGYSWLYGTFKDFDGTFTFDEKNPAADKVNVTINTTSVDTNHAERDKHLRSADFLNTAKYPLATFTSTSVKKDGDDLDITGDLTLNGVTKPVTLEAKLIGQGDDPWGGKRAGFEAEGKIKLKDFNIKTDLGPASQEVDLIISVEGVQQK

SEQ ID NO: 8072 - protein, 362 aa, Escherichia coli 4_1_47FAA; identical to SEQ ID NO: 5813

SEQ ID NO: 8073 - protein, 203 aa, Escherichia coli 4_1_47FAA
MKKIAITCALLSSLVASSVWADAASDLKSRLDKVSSFHASFTQKVTDGSGAAVQEGQGDLWVKRPNLFNWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKSQQNGAVEAAKFTFTPPQGVTVDDQRK

SEQ ID NO: 8074 - protein, 760 aa, Escherichia coli 4_1_47FAA
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKIKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGMAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 8075 - protein, 659 aa, Escherichia coli 4_1_47FAA
MLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 8076 - protein, 713 aa, Escherichia coli 4_1_47FAA
MAKFTPSFSGIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYGDNQARVTAYDATTGTLTRRVDATQGSTQRMHATRADLQGNVDIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 8077 - protein, 840 aa, Escherichia coli 4_1_47FAA
MNNKNTFTGDKLSHAIKIALSGVVCSLLFVLPVHAVEFNVDMIDVEDRENIDISRFEKKGYITPGKYLVRVQINKNMLPQTLILEWVKADNESGSLLCLTKENLTSFGLNTEFIESLQTIAGSECLNLSQRQELTTRLDKATMILSLSVPQAWLKYQATNWTPPEFWDAGIAGFILDYNMYASQYSPHHGDSTQNVSSYGTLGFNLGAWRLRSDYQYNQNFADGRSVNHDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGQLDVTVEEEDGRTSTFQVGSASIPYLTRKGQVRYKTSLGKPTSVGHNDINNPFFWTAEASWGWLNNVSLYGGGMFTADDYQAITTGIGFNLNQFGSLSFDVTGADASLQQQNSDNLRGYSYRFNYAKHFESTGSQITFAGYRFSDKDYVSMSEYLSSRNGDESIDNEKESYVISLNQYFETLELNSYLNVTRNTYWDSASNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTATRHGVALHDYSYGDNARMMVDTDGISGVEINSNRTVTNGLGIAVIPSLSNYTTSMLRVNNNDLPEGVDVENSVIRTTLTQGAIGYAKLNATTGYQIVGVIRQENGRFPPLGVNVTDKATGKDVGLVAEDGFVYLSGIQENSILHLTWGDNTCEVTPPNQSNISESAIILPCKTVK

SEQ ID NO: 8078 - protein, 246 aa, Escherichia coli 4_1_47FAA
MKLPLITTGMICFLGICNFAQATVSPDRTRIIFNASNKSATVRLTNQSKIDPYLAQSWIEDASGKKTRDYISTLPPMERIEPDEQVQIRLMALASLNNLPQDRETLFYYNVREIPPRAKEQNVMQIAMQSRLKLFWRPKAIELKEGEMVPLQKVTITRTAVGLTLNNPTPYHITVGYIGTNGKTLMPGADSIMVAPFASATQHLNNLPSTFQLGFVADYGGLEMFKVVCNSVQSLCQSTPAKKGKI

SEQ ID NO: 8079 - protein, 678 aa, Escherichia coli 4_1_47FAA
MVPSTFSRLKAARCLPVVLAALIFAGCGTHTPDQSTAYMQGTAQADSAFYLQQMQQSSDDTRINWQLLAIRALVKEDKTGQAVELFNQLPQELNDSQRREKTLLAAEIKLAQKDFAGAQNLLAKITPADLEQNQQARYWQAKIDASQGRPSIDLLRALIAQEPLLGAKEKQQNIDATWQTLSSMTQEQANTLVINADENILQGWLDLQRIWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPAATTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 8080 - protein, 883 aa, Escherichia coli 4_1_47FAA
MTAFRAAFKAYRMHQVLLLPRFARLTIALGLATAVFPVDAEYYFNPRFLSNDLAESVDLSAFTKGREAPPGTYRVDIYLNDEFITSRDITFIADDNNADLIPCLSTDLLVSLGIKKSALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPNSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSIKSVYSKSFYQTGTNIQVAGYRYSTQGFYNLSDSAYSRMSGYTVKPPTGDSNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGKNKNGSIVAENGQVYLTGLPQSGKLQVSWGKDKNSNCIVEYKLPEVSPGTLLNQQTAICR

SEQ ID NO: 8081 - protein, 113 aa, Escherichia coli 4_1_47FAA
MEKDQKNENTLQLAIISRIKMFYRPTNLAMAPEEAPAMLRFRRSGSKLTLINPTPYFITVTNMKAGNSNLPNTMVPPKGEVSVDIPHAATGDISFQTINDYGALTPRIKATMQ

SEQ ID NO: 8082 - protein, 106 aa, Escherichia coli 4_1_47FAA
MKKVLALVVAAAMGLSSAAFAAETATTPAPTATTTKAAPAKTTHHKKQHKAAPAQKAQAAKKHHKNAKAEQKAPEQKSAGSEETRQETQPSATGKTCCTTRSVSYQ

SEQ ID NO: 8083 - protein, 816 aa, Escherichia coli 4_1_47FAA
MLRTTRWVAAIIFLYSFPGYAEETFDTHFMIGGMRGEKVSEYRFDNKQPLPGNYELDFYVNHQWRGKKDITIPESPAKPCLPKVLLTTLGVKTDNLNTEDNCILLDEAVHGGQYQWDISEHRLNLTVPQAYINELERGYVPPESWDRGIDAFYTSYNLSQYRSYDSNNNSNTASYGRFNSGLNLFSWQLHSDASYSKPDDMKGKWQSNTLYLERGWSQILSTVQIGENYTSSLIFDSLRFSGIRLFRDMQMLPDSMQSFTPLVQGVAQSNALITVSQNGYTIYQKEVPPGPFTIADLQLSGSGSDLDVSIKEADGSVRSFLVPYSSVPNMLQPGVSNFDFIAGRSQIYGVKNQEDFLEANYIYGLNNLLTLYGGTILSDNYNAITLGNGWNTPLGAISFDATRSSSKLNNDTRHEGTSYQVAYNKYLLQTATHFSVAAWRYASQDYRTFSDHLYENDKINHQSDDDDFYDIGRKNSLSANIMQPLSNNLGNVSLSALWRNYWGRSGNAKDYQFSYSNSWQRISYTFSASQSYDENDKEEERFNLFISIPFYWGDDIAKTRHQINLSNSTSFSKDGYSSNNTGITGIAGEHDQLNYGIYVNQQQQNNDTSLGTNLSWRTPIATIDGSYSHSKNAWQSGGSISSGLVVWPGGINITNQLSDTFAILDAPGLEGAHINGQKYNRTNSKGQVVYDLMIPHRENHLVLDIANSESETELQGNRQIIAPYRGAVSYVQFTTDQRKPWYIQALRPDGSPLTFGYDVLDLQENNIGVVGQGSRLFIRVDEIPTGIKVALNDEQNLFCTITFQHVIDENKTYICQ

SEQ ID NO: 8084 - protein, 227 aa, Escherichia coli 4_1_47FAA
MRIITALLMSFFILPVHAGVVIYGTRIIYPEKNREVLVQLMNQSKNASLIQAWIDDGNTTIAPEKIQVPFILTPPVSRVAGGSGQQLKIRKMPNNLPHNKESLFYLNVLDIPPNNPQNAGKNKIKLALQNRIKLLWRPSGIAPVDKKSLSQLNIKKKNNAISINNETANWITVTTIKAQNVKVNNESILLPPFSNNDITLKNNHASEYELTVVDDYGNNIHSKIAAR

SEQ ID NO: 8085 - protein, 789 aa, Escherichia coli 4_1_47FAA
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYEDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSNPQNNKLADSVNRVMPQFKVDGKMVFERDMNLLAPGFTQTLEPRAQYLYVPYRDQSDIYNYDSALLQSDYSGLFRDRTYGGLDRIASANQVTTGVTSRVYDDAAVERFNISVGQIYYFTESRTGDDNITWENDDKTGSLVWAGDTYWRISERWGLRGGIQYDTRLDNVATSSSSIEYRRDEDRLVQLNYRYASPEYIQATLPRDSRDKRWNAPQYKDGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 8086 - protein, 873 aa, Escherichia coli 4_1_47FAA
MQQEANVMKTKTSTKRHNLTRIAMYCSIMYSGATIGAESVEYDPTFLMGGNASSIDVSRYSDGNPTLPGVYDVSIYVNEQPVANLEIPFIAIPDKKNAQACITLKNLLQLHIKTPPADEENTILLPRDETLGNCLDLSLAIPKSSVNYDPSEQRLDINVPQAWVMKNYQNYVDPSLWENGINAATLSYNINAYRSENSNYTNDSVYTSFNGGVNLGAWRLRSSGNYSWRNDAGSNVEFMNRYVQRDITAIRSQLIMGESYTTGETFDSVSIRGIRLYSDSRMLPPVLANFAPTIRGVANTNAKVSITQSGYKIYETTVPPGPFVIDDLSPSGYGSDLIVTIEEADGSKRTFSQPFSSVIQMLRPGVSRWDISGGQINKDDLHHEPNLLQATYYRGLSNLFTGYTGFQVTDNHYAAGLLGIGMNTSVGAISFDVTHSSVDIPDDKRYQGQSYRISWNKFFDLTDTSLNIAAYRYSTQDYLGLNDALTLIDEVEHPTQDLDPKTMRNYGRMKNQFTVSINQPLRFGKDDYGSFYTSGSWSDYWGGSKSRSNYSVGYSNSASWGSYSISAQRSWDEYSQTENSIYLSFSIPIEKLMGTEHRDSGFQSIDTQLSTNMDGNNQFNMSSSGYSNDNRVSYSVNAGYGMNKTGKDLSNIGGYASYESPWGTLAGSVSATSDNNRQYSVNTDGGFVLHSGGLTFSNDSFSDNDTIALVKAPGAKGARINYGNNTVDRWGYGVTSALSPYQENKIALDTENLENDIEMKSTSTVAVPRQGSVIFAGFETNQGQSAIMNIKRSDGKGIPFAADIHDETNAIIGNVGQGGQAFVRGIQQQGTIKITWLEASMPKTCIAQYQQPNVTSEKIQQTIILNNILCQLQ

SEQ ID NO: 8087 - protein, 243 aa, Escherichia coli 4_1_47FAA
MLNKKNIVALCVASSMAFSMPVMADIVISGTRVIYKSDQKSVSVRLENKGNSHLLVQSWLDTGDDNAEPGSINVPFTATPPVSRIDAKRGQTIKLMYTGSTVLPSDKESVFWFNVLEVPPKPDASKVENQSLLQLAFRPRIKLFYRPAGLNGNPSEAPLALKWKWAEGKSGLSVYNPTPYYVSFNSAELIAGGKSNPLNVKMVAPKSEEIFTISGSGGKATSGKVHFSAINDFGGAIEGDVNL

SEQ ID NO: 8088 - protein, 747 aa, Escherichia coli 4_1_47FAA
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLDLYNPVNTDFDFNAKDPDNSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 8089 - protein, 266 aa, Escherichia coli 4_1_47FAA
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLLDQYAQLKAQYADKPKKRVFLQFGINPPFTSGKESIQNQVLEVCGGENIFKDSRVPWPQVSREQVLARAPQAIVITGGPDQIPKIKQYWGEQLKIPVIPLTSDWFERASPRIILAAQQLCNALSQVD

SEQ ID NO: 8090 - protein, 161 aa, Escherichia coli 4_1_47FAA; identical to SEQ ID NO: 5769

SEQ ID NO: 8091 - protein, 518 aa, Escherichia coli 4_1_47FAA
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLRETKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 8092 - protein, 660 aa, Escherichia coli 4_1_47FAA
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGTRLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 8093 - protein, 402 aa, Escherichia coli 4_1_47FAA
MLIPGVQAAKPQKVTLMVDDVPVAQVLQALAEQEKLNLVVSPDVSGTVSLHLTDVPWKQALQTVVKSAGLITRQEGNILSVHSVAWQNDNIARQEAEQARAQANLPLENRNITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 8094 - protein, 259 aa, Escherichia coli 4_1_47FAA
MHQFPLSSLMINVLICILICCTNAQAGVVVGGTRFVYPEKQSSISVELKNTASKDMLVKISVTPDDGRQLKGTLESQPLLPDKAFIATPPLLVLKQDKNTKIRINRVGGQLPIDRESLFILNIAALPAQEQNSQLKNENQLQVAVRNRMKIFYRPETLSGNPLDAYQQLRWSRNNEAVTVFNPTPWYVTLYNLSIDGKSINGGMVAPFSHRQQDWCQRQGYCEINWQTLDLYNNALPVWSVKLNVLQNNAIMGAVAIHG

SEQ ID NO: 8095 - protein, 248 aa, Escherichia coli 4_1_47FAA
MDFKNKCFSNRNINSLLKTQYIIRAGALFLLSAISINAIAAGGFGLGSTRLVYPSDSQQITLSVQNGGANTSYLIQSWIDDNQSSKKSQDFVVTPPLFMLPTRKEASLRIMFIGKSQLPTDRETLFWMNVKAIPPTDEKNTQKNTLQLALQNRIKLFYRPTNLPVQAGKARDMLRFKYEGKQLRVINPSPYYLTVTGIRVQGAKLPNAFVPPKSDVTVSSPVTLAGEITYQTINDYGATTARQKGTMQ

SEQ ID NO: 8096 - protein, 826 aa, Escherichia coli 4_1_47FAA
MLRMTPLASAIVALLLGIEAYAAEETFDTHFMIGGMKDQQVANIRLDDNQPLPGQYDIDIYVNKQWRGKYEIIVKDNPQETCLSREIIKRLGINTDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNSNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTSWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVTTPRRQIYMSNSTTFDDQGFASNNTGLSGTVGNRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRTDGQPLTFGYEVNDIHGHNIGVVGQGSQLFIRTNEVPPSVNVAIDKQQGLSCTITFGKEIDESRNYICQ

SEQ ID NO: 8097 - protein, 397 aa, Escherichia coli 4_1_47FAA
MKRKVLAMLVPALLVAGAANAAEVYNKDGNKLDLYGKVAGLHYFSDDAGSDGDMSYARIGFKGETQIADQFTGYGQWEFNIGANGPESDKGNTATRLAFAGLGFGQNGTFDYGRNYGVVYDIEAWTDMLPEFGGDTYAGADNFLNGRANGVATYRNNGFFGQVDGLNFALQYQGNNEGSGGLWDQEGSGNGNNRKLSKENGDGFGMSTSYDFDFGLSLGAAYSNSDRTDNQRATGLGEQRSNKYAGGETAEAWTVGAKYDANNVYLAAMYAETRNMTAYGSGKDNNDIDRGGIANKTQNFEVVAQYQFDFGLRPSIAYLQSKGKDLGGWAHDGNGDPRYTNKDLVKYVEVGATYYFNKNMSTYVDYKINLLDNDDDFYEANGIATDDIVAVGLVYQF

SEQ ID NO: 8098 - protein, 274 aa, Escherichia coli 4_1_47FAA
MNKTAIALLALLASSASLAATPWQKITQPVPGSAQSIGSFSNGCIVGADTLPIQSEHYQVMRTDQRRYFGHPDLVMFIQRLSSQVSNLSLGTVLIGDMGMPAGGRFNGGHASHQTGLDVDIFLQLPKTRWTSAQLLRPQALDLVSRDGKHVVPTLWKPEIFSLIKLAAQDKDVTRIFVNPAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 8099 - protein, 200 aa, Escherichia coli 4_1_47FAA; identical to SEQ ID NO: 7474

SEQ ID NO: 8100 - protein, 367 aa, Escherichia coli 4_1_47FAA; identical to SEQ ID NO: 5785

SEQ ID NO: 8101 - protein, 162 aa, Escherichia coli 4_1_47FAA
MKTILPAVLFAAFATTSAWAAESVQPLEKIAPYPQAEKGMKRQVIQLTPQEDESTLKVELLIGQTLEVDCNLHRLGGKLESKTLEGWGYDYYVFDKVSSPVSTMMACPDGKKEKKFVTAYLGDAGMLRYNSKLPIVVYTPDNVDVKYRIWKAEEKIDNAVVR

SEQ ID NO: 8102 - protein, 828 aa, Escherichia coli 4_1_47FAA; identical to SEQ ID NO: 6558

SEQ ID NO: 8103 - protein, 663 aa, Escherichia coli 4_1_47FAA
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWKVTKDVKLRAGVLNLGDKDLSRDDYSYNEDGRRYFMAVDYRF

SEQ ID NO: 8104 - protein, 539 aa, Escherichia coli 4_1_47FAA; identical to SEQ ID NO: 6525

SEQ ID NO: 8105 - protein, 207 aa, Escherichia coli 4_1_47FAA; identical to SEQ ID NO: 5743

SEQ ID NO: 8106 - protein, 377 aa, Escherichia coli 4_1_47FAA
MRGYGYDNRTNYDAYYSPGSPLLDTRKLYSQSWDAGLRYNGELIKSQLITSYSHSKDYNYDPHYGRYDSSATLDEMKQYTVQWANNVTVGHGNIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLNPEKSKQWEGAFEGLTAGVNWRISGYRNDVSDLIDYDDHTLKYYNEGKARIKGVEATANFDTGPLTHTVSYDYVDARNAITDAPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 8107 - protein, 208 aa, Escherichia coli 4_1_47FAA; identical to SEQ ID NO: 5717

SEQ ID NO: 8108 - protein, 263 aa, Escherichia coli 4_1_47FAA
MSKRNAVTTFFTNRVTKALGMTLALMMTCQSAMASLAADQTRYIFRGDKDALTITVTNNDKERTFGGQAWVDNIVEKDTRPTFVVTPSFFKVKPNGQQTLRIIMASDHLPKDKESVYWLNLQDIPPALEGSGIAVALRTKLKLFYRPKALLEGRKGAEEGLSLQSRPDGRTMLVNTTPYIFAIGSLLDGNGKKIATDNETAQKLLMFMPGDEVQVKGNVVKVDSLNDWGSLQTWTINQKKAAAPSGQKASDSPVNPSDKADKK

SEQ ID NO: 8109 - protein, 814 aa, Escherichia coli 4_1_47FAA
MCAGKKAVAEPVSSVFFRRAALALAVSAAFASATGIAGEKLDMSFIQGGAGVNPEVWAALNGSYAPGRYLVDLSLNGKEAGKQILDVTPQDSNELCLTEAWLTKAGIYVSADYFREGYDATRQCYVLTKAPSVKVDFDVSTQSLALSIPQKGLVKMPENVDWDYGTSAFRVNYNANANTGRNNTSAFGSADLKANIGHWVVSSSATASGGDSGDNSTTINMFTATRAIRALSADLAVGKTSTGDSLLGSTGTYGVSLSRNNSMKPGNLGYTPVFSGIANGPSRVTLTQNGRLLHSEMVPAGPFSITDVPLYTSGDVTMKITGEDGREQVQNFPLSVMAGQLSPGQHEFSVAAGLPDDDSDLKGGVFAASYGYGLDGLTLRTGGVFNQDWQGVSAGAVLGLSYLGAVSADGAYATAKYRDGSRSGNKVQLSWSKQLEMTNTGLRVSWSRQSEEYEDMSSFDPTELWSQSNHGRRTKDEWNAGVSQPVGGLFSLSVSGWQRSYYPASMTGSYRYSDDNGKDTGITGTLSTQIKGVSLNLGWSGSRNTRGENNWSASASVSVPFTLFDRRYSSSTSVSTSKDGGTGFSTGVSGSLNDRFSYGLGGGRDSGGGVSSYLNASYSGDRAYLNGALNHSQSGGTSGSVSVSGSVLAVPAAKDIMFSRTTGDTVAVVNVKDTPGVKVTSGDGQTDSDGNLVVPLNSYDWNTVTIDAGTLPLSTELTNTSQKVVPTDKAVVWMPFDALKVKRYLLQVKQRDGEFVPGGTWARDSKNTPLGFVANNGVLMINTVDAPGDITLGQCRIPAAKLQDTEKLQEITCE

SEQ ID NO: 8110 - protein, 121 aa, Escherichia coli 4_1_47FAA
MDAVLSVQGASAPVKKKSFFSKFTRLNMLRLARAVIPAAVLMMFFPQLVMAAGSSGQDLMASGNTTVKATFGKDSSVVKWVVLAEVLVGAVMYMMTKNVKFLAGFAIISVFIAVGMAVVGL

SEQ ID NO: 8111 - protein, 261 aa, Escherichia coli 4_1_47FAA
MRAVSVINAMLFYLVIINYANANGETFKESLDASDAKMGSRTFSIKIDKSRLIFNEDEFGEILTVYNTHEYPVLVQTYLLNEDKQTKNNKFISTPPIFKLDANQQSKIRIVPKAVTSDSGNKESLSWVCVKGIPPKTGDVWDEGYEKSPKKSNLMVNIAVSNCIKLIARPPSLPPIDSNSKLKVNWKISKGKLVAFNLTPYYINFNSLAVNEKVISNGEYVAPYSRKEITVNGGIRKGQNVSWEFITDLGGVSKVVDDVLE

SEQ ID NO: 8112 - protein, 805 aa, Escherichia coli 4_1_47FAA
MKFKRFPKISLLALSIWYSHFSLAEELNLDFIQGVSVIPSILKSDTNYPEGQYIVDVAVNKERTERLELNISKEDEKNNMLCLSSEWLKKAGVMLKMDAYQDVFDEGKGCYVLAKKPHTLVDFDYGAQALNFNIPQAYLLDKTDPARWDYGVNGGRLKYYGNFNKTVHNDFNAFGNVDATINLGRWVLSSNMNVSHSDDKTEFTSSDLTLSTAISQVQGDLLLGKSQTRTELFSDFNFYGAALRSNSNMRPWEFRGYAPDISGVAPTPSRVTVKQNGYVVYSRMVPAGPYRLDDLNPMGNGDLVVTVEDENGNKTEQIYPITTLPTLLRPGEFQYNLAVGKKNNSNELDKAFDSDTGLFWLGSLDYGFTTTTLNSAALLNENYLSGGLGVTQMLGGLGALSLSANVSKASYNNGEEKTGQNFSAKYAKSFTDKTDLQLLTYRYQSKEYVEFADFNPKDIWRNARYGGQRSRYEARLSHRFDGTYLSGSYWWQDYWMHKGQDAGGTVSMSTSVFDSVSLFLNGTYSKYVWSDKPDYSVSLNVSVPFDLKGTRHYSSNSVGYTHNGGTTFNSSISTTLTDRFNYSLSANAGSKGDRGASVSAGYAFDAIQTNVGVSRSYSKQGYSQSSLSGSVSGSVLGTSETGPLFTKESSDTVGIVSIPGVEGVSVNGSMPTDRNGNTVVWLSEYSENNININMDNVPDNMEFETTSYNVVPTEKAMVYRKFGFKNVLRYILRVKDAQGNYLAGGDAKTEQGLNAGFISNNGVLLMNMLAEPKSVSVATGDGKQCRFSMAGLKANTNKVQEVRCE

SEQ ID NO: 8113 - protein, 230 aa, Escherichia coli 4_1_47FAA
MNKFAKGALVALLSLSFCGQSMAAFVLNGTRFIYEEGKKNLSFEVTNNANKTYGGQVWIDNTNQGNGVYMVPQPPFFKVGAKQKQIIRVMNTDSNLPKDRESLFWLNVQEVPPKPEVKDGEGSVLAIAMNTRVKLIYRPVSLKDGRKDAEKHLKLEQRGNETWLKNPTPYYIAIVNVKRDGKDIPLSDSVMKGVAQLKPFSDVSLGKNVSGKISVDAVNDWGGVQSYEIH

SEQ ID NO: 8114 - protein, 118 aa, Escherichia coli 4_1_47FAA [sequence omitted]

SEQ ID NO: 8115 - protein, 203 aa, Escherichia coli 4_1_47FAA; identical to SEQ ID NO: 6347

SEQ ID NO: 8116 - protein, 270 aa, Escherichia coli 4_1_47FAA
MAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSNGSQKAAGFAVTHIRADYTLGHGFSVNASVNNLFDTQYAYSEGFIEEGRNFWAGIEYTF

SEQ ID NO: 8117 - protein, 366 aa, Escherichia coli 4_1_47FAA; identical to SEQ ID NO: 7432

SEQ ID NO: 8118 - protein, 249 aa, Escherichia coli 4_1_47FAA
MTKYLSAKTLTTVLSLLAATVSFSTQASVTPDRTRLIFNESDKSISVTLRNNDPKLPYLAQSWIEDEKGVKISSPLAVLPPVQRIEAMMNGQVKIQGLPDIHKLPADRESMFYFNVREIPPKSNKSNTLQIALQTRIKLFWRPKALEKNTTQNPWQHKVTLTRNGQEFTVNNPTPYYVIFSNASAQKNGNPAAGFSPIVMSPKTSAPLNVKMGSVPVLTYVNDYGARMPLFFTCNGNSCQVDEEQSRKG

SEQ ID NO: 8119 - protein, 484 aa, Escherichia coli 4_1_47FAA
MPEHSFLRLRGLSWWIALAISGSPFNALADDTIQFDGRFLDLKGNTKIDLGRFSQKGYVEPGKYNLRVHVNNQPLPDDYDIYWYATENDPNKSYACLSPELVAQFGLKEDIAKNLQWIRDGQCLNTALLAGTEISGDLGQSALLVSVPQAYLEYTDSEWDPPSRWDDGIPGLIADYSINAQTRHENGGDDTNDISGNGTVGVNVGPWRLRADWQSDYQHTRSNDDGDTDDSGTQKNWEWSRYYAWRALPSLKAKLSLGEDYLNSDIFDGFSYIGGSISTDDQMLPPNLRGYAPDISGVAHTTAKVTVTQMGRVIYETQVPAGPFRIQDIGDSVSGTLHVRIEEQNGQVQEYDVSTASMPFLTRPGQVRYKVTMGRPQNWDHQVAGSFFSGGEASWGIANGWSLYGGALADENYQSAALGLGRDLALLGALAFDVTHSRVQLDDNSVYGNKTLDGNSYRVSYAKDFDELNSRVTFAGYRFSEKTT

SEQ ID NO: 8120 - protein, 700 aa, Escherichia coli 4_1_47FAA
MKIFSVRQTVLPALLVLSPVVFAADEQTMIVSATPQVVSELDTPAAVSVVDGEEMRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVITQTGQQPPTIEASSYYGSFGSWRYGLKATGAMGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHRGELGVPLTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPAPGRNYGVGMNIAWRFE

SEQ ID NO: 8121 - protein, 432 aa, Escherichia coli 53638; identical to SEQ ID NO: 5727

SEQ ID NO: 8122 - protein, 111 aa, Escherichia coli 53638
MKKQIEGMTMKKVLALVVAAAMGLSSAAFAAETTTTPAPTATTTKAAPAKTTHHKKQHKAAPAQKAQAAKKHHKNTKAEQKAPEQKAQAAKKHAKKHSHQQPAKPAAQPAA

SEQ ID NO: 8123 - protein, 478 aa, Escherichia coli 53638; identical to SEQ ID NO: 5711

SEQ ID NO: 8124 - protein, 237 aa, Escherichia coli 53638
MRKITQAISAVCLLFALNSSAVALASSPSPLNPGTNVARLAEQAPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPATSMNPVIFAGDKPGQNTKSQWLQDKNIRIFYGDSDNDITAARDVGARGIRILRASNSTYKPLPQAGAFGEEVIVNSEY

SEQ ID NO: 8125 - protein, 446 aa, Escherichia coli 53638
MMITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNKKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYNGDSKVNPNYGKAVPADFNGGSFGRGDSDEWTFGAQMEIWW

SEQ ID NO: 8126 - protein, 518 aa, Escherichia coli 53638; identical to SEQ ID NO: 6358

SEQ ID NO: 8127 - protein, 614 aa, Escherichia coli 53638
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAYTHGYDVVAYGNTGTQAQPDKDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVENGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 8128 - protein, 213 aa, Escherichia coli 53638; identical to SEQ ID NO: 5744

SEQ ID NO: 8129 - protein, 729 aa, Escherichia coli 53638; identical to SEQ ID NO: 6531

SEQ ID NO: 8130 - protein, 232 aa, Escherichia coli 53638; identical to SEQ ID NO: 5747

SEQ ID NO: 8131 - protein, 191 aa, Escherichia coli 53638; identical to SEQ ID NO: 5748

SEQ ID NO: 8132 - protein, 511 aa, Escherichia coli 53638; identical to SEQ ID NO: 5749

SEQ ID NO: 8133 - protein, 208 aa, Escherichia coli 53638; identical to SEQ ID NO: 5717

SEQ ID NO: 8134 - protein, 881 aa, Escherichia coli 53638
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEEFSGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNMSVSLTGYRYEYDNRADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFTVISGQKAMAVLRLSDGSHPPFGAEVKNDNEQTVGLVDDDGNVYLAGVKPGEHMSVFWSGVAHCDINLPDPLPADLFNGLLLPCQHKGNVAPVTSLAVKLAIQEQTQRVTPTEPPTSISVNQ

SEQ ID NO: 8135 - protein, 250 aa, Escherichia coli 53638; identical to SEQ ID NO: 6548

SEQ ID NO: 8136 - protein, 274 aa, Escherichia coli 53638; identical to SEQ ID NO: 6549

SEQ ID NO: 8137 - protein, 200 aa, Escherichia coli 53638; identical to SEQ ID NO: 6363

SEQ ID NO: 8138 - protein, 245 aa, Escherichia coli 53638
MPARHLYFIMTNTWNRLALLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNVGVVPPKSQRQTSWCQAIAPCHVAWRAINDYGGLSAKKEQNLP

SEQ ID NO: 8139 - protein, 233 aa, Escherichia coli 53638; identical to SEQ ID NO: 6411

SEQ ID NO: 8140 - protein, 362 aa, Escherichia coli 53638; identical to SEQ ID NO: 6543

SEQ ID NO: 8141 - protein, 203 aa, Escherichia coli 53638; identical to SEQ ID NO: 6414

SEQ ID NO: 8142 - protein, 368 aa, Escherichia coli 53638
MKVKVLSLLVPALLVAGAANAAEVYNKDGNKLDLYGKVDGLHYFSDNKSEDGDQTYVRLGFKGETQVTDQLTGYGQWEYQIQGNTSEDNKENSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGAAVSSSKRTDAQNTAAYIGNGDRAETYTGGLKYDANNIYLAAQYTQTYNATRVGSLGWANKAQNFEAVAQYQFDFGLRPSVAYLQSKGKNLGVVAGRNYDDEDILKYVDVGATYYFNKNMSTYVDYKINLLDDNQFTRDAGINTDNIVALGLVYQF

SEQ ID NO: 8143 - protein, 162 aa, Escherichia coli 53638; identical to SEQ ID NO: 6365

SEQ ID NO: 8144 - protein, 828 aa, Escherichia coli 53638; identical to SEQ ID NO: 6558

SEQ ID NO: 8145 - protein, 224 aa, Escherichia coli 53638; identical to SEQ ID NO: 6372

SEQ ID NO: 8146 - protein, 663 aa, Escherichia coli 53638
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 8147 - protein, 660 aa, Escherichia coli 53638; identical to SEQ ID NO: 7981

SEQ ID NO: 8148 - protein, 331 aa, Escherichia coli 53638; identical to SEQ ID NO: 6551

SEQ ID NO: 8149 - protein, 430 aa, Escherichia coli 53638; identical to SEQ ID NO: 5758

SEQ ID NO: 8150 - protein, 243 aa, Escherichia coli 53638; identical to SEQ ID NO: 6555

SEQ ID NO: 8151 - protein, 193 aa, Escherichia coli 53638; identical to SEQ ID NO: 6560

SEQ ID NO: 8152 - protein, 746 aa, Escherichia coli 53638
MNKKIHSLALLVNLGIYGGAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 8153 - protein, 869 aa, Escherichia coli 53638
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERISLNSSAFPELAQQQNNKCINLLKAVPDATINFDFAAMRLNITISQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGIRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGTVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGNPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGRKPVPFGSLVRENSTGITSMVGDDGQVYLSGAPLSGELLVQWGDGANSRCIAHYVLPKQSLQQAVTVISAVCTHPGS

SEQ ID NO: 8154 - protein, 230 aa, Escherichia coli 53638; identical to SEQ ID NO: 7736

SEQ ID NO: 8155 - protein, 412 aa, Escherichia coli 53638
MKQWIAALLLMLIPGVQAAKPQKVTLMVDDVPVAQVLQALAEQEKLNLVVSPDVSGTVSLHLTDVPWKQALQTVVKSAGLITRQEGNILSVHSIAWQNNNIARQEAEQARAQANLPQENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 8156 - protein, 897 aa, Escherichia coli 53638
MKLNIFTKSMIGMGLVCSALPAFAIEAWNNQQGGNKYQVIFDGKIYENAWWVSSTNCPGKAKANDATNPWRLKRTATAAEISQFGNTLSCEKSGSSSSSNSNTPASNTPANSGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDARNPWRYVRAATATEISQYGNPGSCSVKPDNNGGAVTPVDPTPETPVTPTPDNSEPSTPADSVNDYSLQAWSGQEGSEIYHVIFNGNVYKNAWWVGSKDCPRGTSAENSNNPWRLERTATAAELSQYGNPTTCEIDNGGVIVADGFQASKAYSADSIVDYNDAHYKTSVDQDAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLIRFNGVNYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLKVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIASLHAQLKGLYGNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 8157 - protein, 673 aa, Escherichia coli 53638; identical to SEQ ID NO: 6170

SEQ ID NO: 8158 - protein, 654 aa, Escherichia coli 53638; identical to SEQ ID NO: 6507

SEQ ID NO: 8159 - protein, 351 aa, Escherichia coli 53638; identical to SEQ ID NO: 5767

SEQ ID NO: 8160 - protein, 678 aa, Escherichia coli 53638; identical to SEQ ID NO: 6398

SEQ ID NO: 8161 - protein, 231 aa, Escherichia coli 53638; identical to SEQ ID NO: 6515

SEQ ID NO: 8162 - protein, 221 aa, Escherichia coli 53638; identical to SEQ ID NO: 7446

SEQ ID NO: 8163 - protein, 170 aa, Escherichia coli 53638
MVRLNPNEQIQIRMITQEKIAQLPKDRETLFYFNVREIPPKTDKKNVMQVTMQHALKLFWRPKAIELEDDGVMTYEKVEIIRRNDGSIRFNNKMPYHVTLGYIGTNGVTMLPQTQSLMVLPFSHADTQFKNVPSNFQVGYINDFGGLSFYEINCPTVNNSCNVSVAKRDK

SEQ ID NO: 8164 - protein, 832 aa, Escherichia coli 53638
MYKKLKLTTISELIKNIYCSLSVIIIGCASAYAVEFNKDLIEAEDRENVNLSQFETDGQLPVGKYSLSTLINNKRTPIHLDLQWVLIDNLTAVCVTPEQLTLLGFTDEIIEEAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFSITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLATGVGFNLNSLGSLSFDVTRSDAQLHNQNKETGYSYRANYSKRFESTGSQLTFAGYRFSDKNFVSMNEYINDTNHYTNYQNEKESYIVTFNQYLESLRLNKYVSLARNTYWDASSNVNYSLSLSRDFDIGPLKNVSTSLTFSRINWEDDNQDQLYLNISIPWGTSRTLSYGMQRNQDNNISHTASWYDSSDRNNSWSVSASGDNDEFKDMEASLRASYQHNTENGRLYLSGTSQRDSYYSLNASWNGSFTATRHGAAFHDYSGSADSRFMIDADGAEDISLNNKRAVTNRYGIGVIPSVSSYITTSLSVDTRNLPENVDIENSVITTTLTEGAIGYAKLDTRKGYQIMGVIRLADGSHPPLGISVKDETSHKELGLVADGGFVYLNGIQDDSKLTLRWGDKSCFIQPPKSSNLTTGTVILPCIS

SEQ ID NO: 8165 - protein, 565 aa, Escherichia coli 53638; identical to SEQ ID NO: 6395

SEQ ID NO: 8166 - protein, 207 aa, Escherichia coli 53638; identical to SEQ ID NO: 5743

SEQ ID NO: 8167 - protein, 161 aa, Escherichia coli 53638; identical to SEQ ID NO: 5769

SEQ ID NO: 8168 - protein, 266 aa, Escherichia coli 53638
MAKSLFRALVALSFFAPLWLNAAPHVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLLDQYAQLKAQYADKPKKRVFLQFGINPPFTSGKESIQNQVLEVCGGENIFKDSRVPWPQVSREQVLARSPQAIVITGGPDQIPKIKQYWGEQLKIPVIPLTSDWFERASPRIILAAQQLCNALSQVD

SEQ ID NO: 8169 - protein, 747 aa, Escherichia coli 53638; identical to SEQ ID NO: 6511

SEQ ID NO: 8170 - protein, 246 aa, Escherichia coli 53638
MFFNTKHTTALCFVTCMAFSSSSIADIVISGTRVIYKSDQKSVNVRLENKGNNPLLVQSWLDTGDDNAEPGSITVPFTATPPVSRIDAKRGQTIKLMYTASTSLPKDRESVFWFNVLEVPPKPDAEKVANQSLLQLAFRTRIKLFYRPDGLKGNPSEAPLALKWSWSGSEGKASLRVANPTPYYVSFSSGDLEASGKRYPIDVKMIAPFSDEVMKVTGLNGKANSAKVHFYAINDFGGAIEGNARL

SEQ ID NO: 8171 - protein, 686 aa, Escherichia coli 53638; identical to SEQ ID NO: 6453

SEQ ID NO: 8172 - protein, 359 aa, Escherichia coli 53638; identical to SEQ ID NO: 6332

SEQ ID NO: 8173 - protein, 784 aa, Escherichia coli 53638; identical to SEQ ID NO: 6283

SEQ ID NO: 8174 - protein, 551 aa, Escherichia coli 53638; identical to SEQ ID NO: 5742

SEQ ID NO: 8175 - protein, 700 aa, Escherichia coli 53638
MKIFSVRQTVLPALLALSPVVFAADEQTMIVSAAPQVVSELDTPAAVSVVDGEEMRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTKAEWKANPQQAPRAEQYDTRKTIKQTQAGLRYERSLSSRDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYITPSNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLIGLFTGYKYNYHNLTVDLFGRVDNLFDKEYVGSVIVNESNGRYYEPAPGRNYGVGVNIAWRFE

SEQ ID NO: 8176 - protein, 121 aa, Escherichia coli 53638
MNAILSVQGASAPVKKKSFFSKFTRLNMLRLVRAVIPVAVLMMLFPELAMASAGKGTDLMAKGQETVKATFGKDSSIVTWVILAEVLVGAVMYMMTKNVKFLAGFAILSVFIAVGMAVVGL

SEQ ID NO: 8177 - protein, 260 aa, Escherichia coli 53638
MSKRNAVTTFFTNQVTKALGMTLALMMSCQSAVASLAADQTRYIFRGDKDALTITVTNNDKERTFGGQAWVDNIVEKDTRPTFVVTPSFFKVKPNGQQTLRIIMASDHLPKDKESVYWLNLQDIPPALEGSGIAVALRTKLKLFYRPKALLEGRKGAEEGISLQSRPDGRTMLVNTTPYIFAIGSLLDGNGKKIAADNETAQKLLMFMPGDEVQVKGNVVKVDSLNDYGELQTWTINQKKSAISSAQKSSDTEGNSSDKK

SEQ ID NO: 8178 - protein, 806 aa, Escherichia coli 53638
MVAELVSSLFSRRAALAVSAAFASTTGVAGEKLDMSFIRGGAGVNPEVWAALNGSYAPGRYLVDLSLNGKEAGKQILDVTPQDSDELCLTEAWLAKAGIYVSADYFREGYDATRQCYVLTKAPSVKVDFDVSTQSLALSIPQKGLVKMPENVDWDYGTGAFRVNYNANANIGRNNTSTFGSADLKANIGHWVVSSSASASGGDSGDNSATINAFTATRAIRALSADLTVGKTSTGSSLLGSTGTYGVSLSRNNSMKPGNLGYTPVFSGIANGASRVTLTQNGRLLHSEMVPAGPFSITDVPLYTSGDVTMKITGEDGREQTQLFPLSVMAGQLNPGQHEFSVAVGLSDDDSDLKGGVFAASYGYGLDGLTLRTGGVFNRDWQGISAGAVLGLSYLGAVSADGAYAMAEYRDGSRSGNKVQLSWSKQLEMTNTGLRVSWSRQSEEYEDMSSFDPTELWSQSNHGRQPKDEWNAGISQSVGGLFSLSVSGWQRSYYPAQMTGRYRYSDDNGLDTGITGTLSTQIKGVSLNLGWSGSRNSQGENNRSASASISVPFTLFERRYSSSTSVSTSKGGGTGFSTGVSGSLNDRFSYGLGGGRDSGGGVSSYLNASYSGDRAYLNGALNHSQSGGTSGSVSVSGSVLVVPMAKDIMFSRTTGDTVAVVNVKDTPGVKVTFGDGQTDSDGNLVVPLNSYDWNTVTIDAGTLPLSTELTNTSQKVVPTDKAVVWMPFDALKVKRYLLQVKQRDGEFVPGGTWARDSKNTPLGFVANNGVLMINTVDAPGDITLGQCRIPAARLQDTEKLQEITCE

SEQ ID NO: 8179 - protein, 753 aa, Escherichia coli 53638
MNVIKLAIGSGILLLSCGAYSQSISEKTNSDKKGAAEFSPLSVSVGKTTSEQEALEKTGATSSRTTDKNLQSLDATMRSMPGTYTQIDPGQGAISVNIRGMSGFGRVNTMVDGITQSFYGTSTSGTTAHGSTNNMAGVLIDPNLLVAVDVTRGDSSGSEGINALAGSANMRTIGVDDVIFNGNTYGLRSRFSVGSNGLGRSGMIALGGKSDAFTDTGSIGVMAAVSGSSVYSNFSNGSGINSKEFGYDKYMKQNPKSQLYKMDIRPDEFNSFELSARTYENKFTRRDITSDDYYIKYHYTPFSELIDFNVTASTSRGNQKYRDGSLYTFYKTSAQNRSDALDINNTSRFTVADNELEFMLGSKLMRTRYDRTIHSAAGDPKANQESIENNPFAPSGQQDISALYTGLKVTRGIWEADFNLNYTRNRITGYKPACDSRVICVPQGSYDIDDKEGGFNPSVQLSAQVTPWLQPFIGYSKSMRAPNIQEMFFSNSGGASMNPFLKPERAETWQAGFNIDTRDLLVEQDALRFKALAYRSRIQNYIYSESYLVCSGGRKCSMAEVIGNDWEGISDEYSDNMYIYVNSASDVIAKGFELEMDYDAGFAFGRLSFSQQQTDQPTSIASTYFGAGDMTELPRKYMTLDTGVRFFDNALTLGTIIKYTGKARRLSPDFEQDEHTGAIIKQDLPQIPTIIDLYGTYEYNRNLTLKLSVQNLMNRDYSEALNKLNMMPGLGDETHPANSARGRTWIFGGDIRF

SEQ ID NO: 8180 - protein, 121 aa, Escherichia coli 53638
MNAILSVQGASAPVKKKSFFSKFTRLNMLRLVRAVIPVAVLMMLFPELAMASAGKGTDLMAKGQETVKATFGKDSSIVTWVILAEVLVGAVMYMMTKNVKFLAGFAILSVFIAVGMSVAGF

SEQ ID NO: 8181 - protein, 654 aa, Escherichia coli 83972; identical to SEQ ID NO: 6816

SEQ ID NO: 8182 - protein, 900 aa, Escherichia coli 83972; identical to SEQ ID NO: 6827

SEQ ID NO: 8183 - protein, 412 aa, Escherichia coli 83972; identical to SEQ ID NO: 6828

SEQ ID NO: 8184 - protein, 258 aa, Escherichia coli 83972
MRQYRLLSPMIKVVIVLFSLLFSTAQAGLVIGGTRFAYPENQSSISVELKNTSDRDMLVKVAVSPDDARQLTGTVESLPSYSETVFIATPPLFILKPDKNTKIRINRVGGSLPADRESLFILNVAALPTLENSHSVKTDNQLQIAVRNRMKIFYRPSNLSEDPNMSYQKLRWARKNEIVTVYNPGPRYVTLYNLHVDGKVIDGGMVAPFSHRQQSWCKSQGVCEIAWQTLDIYNNVLPILKVKLNPSQLDVTGFAFSQ

SEQ ID NO: 8185 - protein, 250 aa, Escherichia coli 83972; identical to SEQ ID NO: 5862

SEQ ID NO: 8186 - protein, 660 aa, Escherichia coli 83972; identical to SEQ ID NO: 6837

SEQ ID NO: 8187 - protein, 362 aa, Escherichia coli 83972; identical to SEQ ID NO: 5874

SEQ ID NO: 8188 - protein, 204 aa, Escherichia coli 83972; identical to SEQ ID NO: 5755

SEQ ID NO: 8189 - protein, 760 aa, Escherichia coli 83972; identical to SEQ ID NO: 6793

SEQ ID NO: 8190 - protein, 331 aa, Escherichia coli 83972
MKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLVAPSDGTLLTRAVEPGTVLNEGGTVFTVSLTRPVWVRAYVDERNLDQAQPGRKVLLYTDGRPNKPYHGQIGFVSPTAEFTPKTVETPDLRTDLVYRLRIVVTDADDALRQGMPVTVQFGDEAGHE

SEQ ID NO: 8191 - protein, 431 aa, Escherichia coli 83972; identical to SEQ ID NO: 6791

SEQ ID NO: 8192 - protein, 746 aa, Escherichia coli 83972
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTHATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKAAQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 8193 - protein, 353 aa, Escherichia coli 83972; identical to SEQ ID NO: 6846

SEQ ID NO: 8194 - protein, 721 aa, Escherichia coli 83972; identical to SEQ ID NO: 6807

SEQ ID NO: 8195 - protein, 733 aa, Escherichia coli 83972; identical to SEQ ID NO: 6152

SEQ ID NO: 8196 - protein, 696 aa, Escherichia coli 83972; identical to SEQ ID NO: 6787

SEQ ID NO: 8197 - protein, 161 aa, Escherichia coli 83972; identical to SEQ ID NO: 5769

SEQ ID NO: 8198 - protein, 266 aa, Escherichia coli 83972; identical to SEQ ID NO: 6841

SEQ ID NO: 8199 - protein, 752 aa, Escherichia coli 83972
MAPSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVAVGTRGASNTYDYLIIRGFAADGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMIGYSFDHEFNDTFTVRQNLRFAQNKVSQKSVYGYGMCSDPLYTKDQEALKASPCLSIPQSQWGHTLTRQYVIDNEKLENFSVDTQLQSKFATGSVDHTLLTGVDFMRMRNDIDSWFGYAGSVAPSDIYNLDRSDFDFGAHPNPSGPYRVLLKQKQTGLYVQDQAQWDKVLVTLGGRYDWADQSSFNRDYGNKSERDDKEFTWRGGVNYLFDNGVTPYFSYSESFEPASQTDANGDLFAPSKGKQYEVGVKYVPEDRPIVVTGALYQLTKTNNLMADPNGSLFSVEGGEIRARGVELEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 8200 - protein, 230 aa, Escherichia coli 83972
MAFSSSAIADIVISGTRVVYKSEQKSVNVRLENKGNNPLLVQSWLDTGDDNAEPGSITVPFTATPPVSRIDAKRGQTIKLMYTASSALPKDRESVFWFNVLEVPPKPDAAKAANQSLLQLAFRTRIKLFYRPEGLSGISSDAPLALKWSWATSEGKAALRVDNPTPYYVSFSSGDLEANGKRYPLDMTMIAPFSNDVIKVNGMSGRTSSAKVHFFAINDFGGSIEGNANL

SEQ ID NO: 8201 - protein, 825 aa, Escherichia coli 83972
MGKDASNIDLSRYTEGNPTLPGIYDVSVYVNDQPIMSQSIAFAVIEGKKNAQACITQKNLLQFHISSPDKNSEKAILLKRDDDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAIMNIVRSDGKNIPFAADIYDEQNNIIGNVGQGGQAFVRGIEQEGNIRITWIEEGKPVSCFAHYQQNTTSEKIAQSIILNGLRCQIQ

SEQ ID NO: 8202 - protein, 784 aa, Escherichia coli 83972; identical to SEQ ID NO: 6829

SEQ ID NO: 8203 - protein, 840 aa, Escherichia coli 83972; identical to SEQ ID NO: 5645

SEQ ID NO: 8204 - protein, 368 aa, Escherichia coli 83972
MNKTITALAILMASFAANASVLPETPVPFKSGTGVIDNDTVYIGLGSAGTAWYKLDTQAKDKRWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAYYFDKKAEDYFFNKFLLSFDPSTQQWSYAGESPWYGTAGAAVVNKGDKTWLINGEAKPGLRTDAVFELDFTGNNLKWNKLAPVASPDGVAGGFAGMSNDSLIFAGGAGFKGSRENYQNGKNYAHEGLKKSYSADIHLWHNGKWDKSGELSQGRAYGVSLLWNNSLLIIGGEAAGGKAVTDSVLISVKDNKVTVQN

SEQ ID NO: 8205 - protein, 774 aa, Escherichia coli 83972
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTSRIPGFMLWGARVAYDFGPQMADLNLAFGVKNIFDQDYFIRSYNDNNKGIYAGQPRTLYMQGSLKF

SEQ ID NO: 8206 - protein, 138 aa, Escherichia coli 83972
MPTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGSAENIGDN

SEQ ID NO: 8207 - protein, 865 aa, Escherichia coli 83972
MKIDELIKKQKSGSNVSSSELAKASIELINQLVDTAASINNNVNSFSQQLNKLGSVLSNTKHLNGVGNKLQNLPNLDNIGAGLDTVSGILSAISASFILSNADADTGTKAAAGVELTTKVLGNVGKGISQYIIAQRAAQGLSTSAAAAGLIASVVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGSVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGKNLTETDNLYSVEELIGTTRADKFFGSKFTDIFHGADGDDHIEGNDGNDRLYGDKGNDTLSGGNGDDQLYGGDGNDKLIGGAGNNYLNGGDGDDELQVQGNSLAKNVLSGGKGNDKLYGSEGADLLDGGEGNDLLKGGYGNDIYRYLSGYGHHIIDDDGGKDDKLSLADIDFRDVAFRREGNDLIMYKAEGNVLSIGHKNGITFRNWFEKESGDISNHQIEQIFDKDGRVITPDSLKKALEYQQSNNKASYVYGNDALAYGSQDNLNPLINEISKIISAAGNFDVKEERAAASLLQLSGNASDFSYGRNSITLTASA

SEQ ID NO: 8208 - protein, 614 aa, Escherichia coli 83972; identical to SEQ ID NO: 5872

SEQ ID NO: 8209 - protein, 208 aa, Escherichia coli 83972; identical to SEQ ID NO: 5869

SEQ ID NO: 8210 - protein, 719 aa, Escherichia coli 83972
MRDEMLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWRFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 8211 - protein, 643 aa, Escherichia coli 83972
MKMTRLYPLALGGLLLPAIANAQTSQQDESTLVVTASKQSSRSASANNVSSTVVSAPELSDAGVTASDKFPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDITVPMAT

SEQ ID NO: 8212 - protein, 360 aa, Escherichia coli 83972; identical to SEQ ID NO: 5891

SEQ ID NO: 8213 - protein, 122 aa, Escherichia coli 83972; identical to SEQ ID NO: 5737

SEQ ID NO: 8214 - protein, 111 aa, Escherichia coli 83972; identical to SEQ ID NO: 5889

SEQ ID NO: 8215 - protein, 224 aa, Escherichia coli 83972
MATVLLLLLFACHSTIANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTHLAMAPEEAPAMLRFRRSGSKLTLINPTPYFITVTNMKAGNSNLPNTMVPPKGEVSVDIPHAVTGDISFQTINDYGALTPRIKATMQ

SEQ ID NO: 8216 - protein, 883 aa, Escherichia coli 83972; identical to SEQ ID NO: 6849

SEQ ID NO: 8217 - protein, 700 aa, Escherichia coli 83972
MKIFSVRQTVLPALLVLSPVVFAADEQTMIVSAAPQVVSELDTPAAVSVVNGEEMRLATPRINLSESLTGVPSLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPLTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYIPEDGWYAGTEARYMGDIMADDENTAKAPSYTLVGLFTGYKYNYHNFTVDLFGRVDNLFDKEYVGSVIVNESNGRYYEPAPGRNYGVGINIAWRFE

SEQ ID NO: 8218 - protein, 541 aa, Escherichia coli 83972
MAMAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKNQVIMDVENHLYARKDIKQLGIAPMISMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 8219 - protein, 191 aa, Escherichia coli 83972; identical to SEQ ID NO: 6818

SEQ ID NO: 8220 - protein, 517 aa, Escherichia coli 83972; identical to SEQ ID NO: 6817

SEQ ID NO: 8221 - protein, 229 aa, Escherichia coli 83972; identical to SEQ ID NO: 6845

SEQ ID NO: 8222 - protein, 554 aa, Escherichia coli 83972
MALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPKPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSATGTGGGGGEYPLQDGFGWTNGVTLKMLDLICPKEQPCDNVPATRPLSESTTQPVKQKEAEPTP

SEQ ID NO: 8223 - protein, 656 aa, Escherichia coli 83972
MRLKKRYLCTVLSLAFTQQSVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYHDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 8224 - protein, 203 aa, Escherichia coli 83972; identical to SEQ ID NO: 7450

SEQ ID NO: 8225 - protein, 360 aa, Escherichia coli 83972; identical to SEQ ID NO: 5879

SEQ ID NO: 8226 - protein, 213 aa, Escherichia coli 83972; identical to SEQ ID NO: 5744

SEQ ID NO: 8227 - protein, 729 aa, Escherichia coli 83972; identical to SEQ ID NO: 6821

SEQ ID NO: 8228 - protein, 235 aa, Escherichia coli 83972
MIAMQKNAAHTYAISSLLVLSLTGCAWIPSTPLVQGATSAQPVPGPTPVANGSIFQSAQPINYGYQPLFEDRRPRNIGDTLTIVLQENVSASKSSSANASRDGKTNFGFDTVPRYLQGVFGNARADVEASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 8229 - protein, 241 aa, Escherichia coli 83972
MLRFVLFFFTLSVSAVVQGSVVIMGTRVVYPATQKSISIRLNNDNESPALVQSWLDDGDAAAPPESVHVPFIITPPIFRMDSKSGQTVRIVYTGESLPKDRESLFYLNVLDIPAKPGAKKDSDNSEQRNNNYLQLAIRSRIKFFFRPAHLKLTPNDAYLKVTWHQEEGRIKAVNPTPYYITYNKIAVDQNKHLTPVEHGGMIPPFSSTVFALKGRTAPASKVSWVIVNDYGGYQQGESVLE

SEQ ID NO: 8230 - protein, 861 aa, Escherichia coli 83972
MITEDISKENLFWSKVIMNANNLSCLIYCRCSLLLFAALGLTVTNHSFAAEEAEFDSEFLHLDKGINVIDIRRFSHGNPVPEGRYYSDIYVNNVWKGKADLQYLRTANTGAPTLCLTPELLSLIDLVKDTMSGNTSCFPASTGLSSASINFDLSTLRLNIEIPQALLNTRPRGYISPAQWQSGVPAAFINYDANYYQYNSSGTSNEQTYLGLKAGFNLWGWALRHRGSESWNNSYPAGYQNIETSIMHDLAPLRAQFTLGDFYTNGELMDSLSLRGVRLASDERMLPGSLRGYAPAVRGIANSNAKVTIYQNAHILYETTVPAGPFVINDLYPSGYAGDLIVKITESNGQTRMFTVPFAAVAQLIRPGFSRWQMSVGKYRYANKTYNDLIAQGTYQYGLTNDITLNSGLTTASGYTAGLAGLAFNTPLGAIASDITLSRTAFRYSGVTRKGYSLHSSYSINIPASNTNITLAAYRYSSKDFYHLKDALSANHNAFIDDVSVKSTAFYRPRNQFQISINQELGEKWGGMYLTGTTYNYWGHKGSRNEYQMGYSNFWKQLGYQIGLSQSRDNEQQRRDDRFYINFTLPLGGSVQSPVFSTVLNYSKEEKNSIQTSISGTGGEDNQFSYGISGNSQENGPSGYAMNGGYRSPYVNITTTVGHDTQNNNQRSFSASGAVVAHPYGVTLSNDLSDTFAIIHAEGAQGAVINNASGSRLDFWGNGIVPYVTPYEKNQISIDPSNLDLNVELSATEQEIIPRANSATLVKFDTKTGRSLLFDIRMSTGNPPPMASEVLDEHGQLAGYVAQAGKVFTRGLPEKGHLSVVWGPDNKDRCSFVYHVAHNKDDMQSQLVPVLCIQHPNQEKT

SEQ ID NO: 8231 - protein, 836 aa, Escherichia coli 83972; identical to SEQ ID NO: 6074

SEQ ID NO: 8232 - protein, 244 aa, Escherichia coli 83972; identical to SEQ ID NO: 6111

SEQ ID NO: 8233 - protein, 478 aa, Escherichia coli 83972; identical to SEQ ID NO: 6796

SEQ ID NO: 8234 - protein, 260 aa, Escherichia coli 83972; identical to SEQ ID NO: 6790

SEQ ID NO: 8235 - protein, 446 aa, Escherichia coli 83972; identical to SEQ ID NO: 5873

SEQ ID NO: 8236 - protein, 831 aa, Escherichia coli 83972
MQELPMLRMTPLASAIVALLIGIEAYAAEETFDTHFMIGGMKDQQVSNIRLEDNQPLPGPYDIDIYVNKQWRGKYEIIVKDNPQETCLSREMIKRLGINTDSFASGKQCLTFKQLIQGGSYTWDIGVFRLDFSVPQAWVEDLESGYVPPENWERGINAFYTSYYVSQYYSDYKASGNSKSTYVRFNSGLNLQGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSIQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSNKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESRNYICQ

SEQ ID NO: 8237 - protein, 224 aa, Escherichia coli 83972; identical to SEQ ID NO: 5893

SEQ ID NO: 8238 - protein, 728 aa, Escherichia coli 83972
MIIVIVCIIVTPQSKKADKSEAVPAFWDDHLHTNKSTAMLPYARGRKEDVSDTHFIFVVTSWRYGMFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 8239 - protein, 828 aa, Escherichia coli 83972; identical to SEQ ID NO: 6558

SEQ ID NO: 8240 - protein, 169 aa, Escherichia coli 83972
MKKESKKMKTILPAVLFAAFATTSAWAAESVQPLEKIAPYPQAEKGMKRQVIQLTPQEDESTLKVELLIGQTLEVDCNLHRLGGKLESKTLEGWGYDYYVFDKVSSPVSTMMACPDGKKEKKFVTAYLGDAGMLRYNSKLPIVVYTPDNVDVKYRVWKAEEKIDNAVVR

SEQ ID NO: 8241 - protein, 375 aa, Escherichia coli 83972; identical to SEQ ID NO: 5922

SEQ ID NO: 8242 - protein, 200 aa, Escherichia coli 83972; identical to SEQ ID NO: 5898

SEQ ID NO: 8243 - protein, 274 aa, Escherichia coli 83972; identical to SEQ ID NO: 5899

SEQ ID NO: 8244 - protein, 250 aa, Escherichia coli 83972; identical to SEQ ID NO: 6150

SEQ ID NO: 8245 - protein, 882 aa, Escherichia coli 83972
MPNHSNFRLRGIACYIALAISGGSVNAWADDSIQFDPRFLELKGDTKIDLGKFSKKGYVDAGKYNLRVFINKQPLSDEYDINWYVSENDPTKNYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKNWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSADGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNADEHMMVFWEGSAQCEIVLPKPLPADLFSGLLLPCEQKGTAAPDSSAPEIKPVIQDQTRQVTPTEAPTSISATQ

SEQ ID NO: 8246 - protein, 518 aa, Escherichia coli 83972
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKDTKFPELSWKVDDKKGSVELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTTKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 8247 - protein, 686 aa, Escherichia coli 83972; identical to SEQ ID NO: 6795

SEQ ID NO: 8248 - protein, 713 aa, Escherichia coli 83972; identical to SEQ ID NO: 6056

SEQ ID NO: 8249 - protein, 222 aa, Escherichia coli 83972; identical to SEQ ID NO: 5850

SEQ ID NO: 8250 - protein, 840 aa, Escherichia coli 83972; identical to SEQ ID NO: 5851

SEQ ID NO: 8251 - protein, 249 aa, Escherichia coli 83972; identical to SEQ ID NO: 5852

SEQ ID NO: 8252 - protein, 628 aa, Escherichia coli 83972
MVKDTITIVATGNQNTVFETPSMVSVVTNDTPWSQNAVTSAGMLKGVAGLSQTGAGRTNGQTFNLRGYDKSGVLVLVDGVRQLSDMAKSSGTYLDPALVKRIEVVRGPNSSLYGSGGLGGVVDFRTADAADFLPPGETNGLSLWGNIASGDHSTGSGLTWFGKTGKTDALLSVIMRKRGNIYQSDGEHAPNKEKPAALFAKGSVGITDSNKAGASLRLYRNNTTEPGNSTQTHGDSGLRDRKTVQNDVQFWYQYAPVDNSLINVKSTLYLSDITIKTNGHNKTAEWRNNRTSGVNVVNRSHTLIFPGAHQLSYGAEYYRQQQKPEGSATLYPEGNIDFTSLYFQDEMTMKSYPVNIIVGSRYDRYKSFNPRAGELKAERLSPRAAISVSPTDWLMMYGSISSAFRAPTMAEMYRDDVHFYRKGKPNYWVPNLNLKPENNITREIGAGIQLDGLLTDNDRLQLKGGYFGTDARNYIATRVDMKRMRSYSYNVSRARIWGWDMQGNYQSDYVDWMLSYNRTESMDASSREWLGSGNPDTLISDISIPVGHRGVYAGWRAELSASATHVKKGDPHQAGYTIHSFSLSYKPVSVKGFEASVTLDNAFNKLAMNGKGVPLSGRTVSLYTRYQW

SEQ ID NO: 8253 - protein, 725 aa, Escherichia coli 83972
MRINKIFWSLTVLLVGLNSQVSVAKYSDDDNDETLVVEATAEQVLKQQPGVSVITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPTNDWHGSLSLYTNQPESSEEGATRRANFSLSGPLAGDALTTRLYGNLNKTDADSWDINSPVGTKNAAGHEGVRNKDINGVVSWKLNPQQILDFEVGYSRQGNIYAGDTQNSSSSAVTESLAKSGKETNRLYRQNYGITHNGIWDWGQSRFGVYYEKTNNTRMNEGLSGGGEGRILAGEKFTTNRLSSWRTSGELNIPLNVMVDQTLTVGAEWNRDKLDDPSSTSLTVNDRDISGISGSAADRSSKNHSQISALYIEDNIEPVPGTNIIPGLRFDYLSDSGGNFSPSLNLSQELGDYFKVKAGVARTFKAPNLYQSSEGYLLYSKGNGCPKDITSGGCYLIGNKDLDPEISVNKEIGLEFTWEDYHASVTYFRNDYQNKIVAGDNVIGQTASGAYILKWQNGGKALVDGIEASMSFPLVKERLNWNTNATWMITSEQKDTGNPLSVIPKYTINNSLNWTITQAFSASFNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 8254 - protein, 211 aa, Escherichia coli 83972
RAVNDAVGKLPVPADGKSITPDDVRPMLEQMVTDAVSHIPVPRDGRDYDPEVLQKAVLDAVSALPAPQDGRDATALEIFPAIDEQKSFPRGTYATHQGGLWRAYEKTHGMRGWECLVDGVADIDVSMTGERSFTVVVRQSSGQCTEKTFSLPVMLYRGVFRTGETYHPGDTVTWGGSLWHCNSMTGDKPGEAHSSGWTLAAKRGRDAGGGK

SEQ ID NO: 8255 - protein, 478 aa, Escherichia coli 83972
MAADFIFSLSVGADMFFGDGGQLLSDKSLTGSAGGGNNRMKFNILPLAFFIGIIVSPARAELYFNPRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQLYMSNQARGYIAPEYWDNGITAALLNYDFSGNRVRDSYGGTSDYAYLNLKTGLNIGSWRLRDNTSWSYSAGKGYSQNNWQHINTWLERDIVSLRSRLTMGDSYTRGDIFDGVNFRGIQLASDDNMVPDSQRGYAPTIHGISRGTSRISIRQNGYEIYQSTLPPGPFEINDIYPAGSGGDLQVTLQEADGSVQRFNVPWSSVPVLQREGHLKYALSAGEFRSGGHQQDNPRFAEGTLKYGLPAGWTVYGGAWIAERYRAFNLGVGKNMGWLGAVSLDATRANARLPDESRHDGLVHGYRYHG

SEQ ID NO: 8256 - protein, 231 aa, Escherichia coli 83972; identical to SEQ ID NO: 6154

SEQ ID NO: 8257 - protein, 432 aa, Escherichia coli 83972; identical to SEQ ID NO: 5727

SEQ ID NO: 8258 - protein, 360 aa, Escherichia coli 83972
MMKKYLALALIAPLLISCSTTKKGDTYNEAWVKDTNGFDILMGQFAHNIENIWGFKEVVIAGPKDYVKYTDQYQTRSYINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHHSAESRRYLYKVNTAQKSYRRR

SEQ ID NO: 8259 - protein, 711 aa, Escherichia coli AA86
MFTPSFSGLKGRALFSLLFAAPMIHATDSVTTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESVGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 8260 - protein, 678 aa, Escherichia coli AA86
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRETTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTASPDCVINRKLSWLQYQQGQVVPAS

SEQ ID NO: 8261 - protein, 386 aa, Escherichia coli AA86
MVDDVPVAQVLQALAEQEKLNLVVSPDVSGTVSLHLTDVPWKQALQTVVKSAGLITRQEGNILSVHSVAWQNDNIARQEAEQTRAQANLPLENRNITLQYADAGELAKAGEKLLSAKGSMTVDKRTNRLLLRDNKTALSTLEQWVSQMDLPVGQVELSAHIVTINEKSLRELGVKWTLADAQQAGGVGQVTTLGSDLSVATATTHIGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 8262 - protein, 840 aa, Escherichia coli AA86
MNNKNTFTGDTLSHAIKNALSGVVCSLLFVLPAHAVEFNVDMIDVEDRENIDISRFEKKGYIPPGRYLARVQINKNMLPQALILEWVKADNESGSLLCLTKENLTNFGLNTEFIESLQNIAGSECLDLSQRQELTTRLDKATMILSLSVPQAWLKYQATNWTPPEFWDAGIAGFILDYNVYASQYAPHHGYSTQNVSSYGTLGFNLGAWRLRSDYQYNQNFTDGRSVNYDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGQLDVTVEEEDGRTSTFQVGSASIPYLTRKGQVRYKTSLGKPTSVGHNDINNPFFWTAEASWGWLNNVSLYGGGMFTADDYQAITTGIGFNLNQFGSLSFDVTGADASLQKQNSDNLRGYSYRFNYAKHFESTGSQITFAGYRFSDKDYVSMSEYLSSRNGDESIDNEKESYVISLNQYFETLELNSYLNVTRNTYWDSASNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTATRHGVALHDYSYADNARMMVDTDGISGVEINSNRTVTNGLGIAVVPSLSNYTTSMLRVNNNDLPEGVDVENSVIRTTLTQGAIGYAKLNATTGYQIVGVIRQENGRFPPLGVNVTDKATGKDVGLVAEDGFVYLSGIQENSILHLTWGDNTCEVTPPNQSNISESAIILPCKTVK

SEQ ID NO: 8263 - protein, 246 aa, Escherichia coli AA86
MKSPLITTGMICLLGICNFAQATVSPDRTRIIFNASNKSATVRLTNQSKIDPYLAQSWIEDASGKKTRDYISTLPPMERIEPDEQVQIRLMALASLNNLPQDRETLFYYNVREIPPRTKEQNVMQIAMQSRLKLFWRPKAIELKEGQMVPLQKVTITRTAAGLTLNNPTPYHITVGYIGTNGKTLMPGADSIMVTPFASATQYLNNLPSTFQLGFVADYGGLEMFKVECNSVQSLCQSSPAKKGKI

SEQ ID NO: 8264 - protein, 250 aa, Escherichia coli AA86
MKCIIENKKLVCGFRDELKASQNIIRSGILFLLSILFINNASAGGFGLGVTRLIYPAESKQITLSVQNSGDNTSYLIQSWVDDSKTEKKSQDFVITPPLFMLPTRKEASLRIMFLGKTNLPTDRETLYWMNVKAIPPTDEKNTQKNTLQLALQNKIKLFYRPENLPVQPGKARNMLRFKYEGKQLKVINPSPYYLTLTGIKVQGSKLPNTFVPPKSDITVSSPVTLAGEITYQTINDFGATTERQKGIMQ

SEQ ID NO: 8265 - protein, 654 aa, Escherichia coli AA86
MDSAMKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNSRKPSSTSAMDNVAITADEQTNSLVITADQSVQEKLATVIARLDIRRAQVLVEAIIVEVQDGNGLNLGVQWANKNVGAQQFTNTGLPVFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQLRIDGKSKALVGSEDLPVLNENTFNSHAPAPSSR

SEQ ID NO: 8266 - protein, 900 aa, Escherichia coli AA86
MKLNIFTKSMIGMGLVCSSLPALAMEAWNNQQGGNKYQVIFDGKIYENAWWVSSTNCPGKAKANDATNPWRLKRTATAAEISQFGNTLSCEKSGSSSSSTSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEITQYGNPGSCSVKPDNNGGAVTPVDPTPETPETPVTPTPDNNEPSTPADSSNDYSLQAWSGQEGSEIYHVIFNGNVYQNAWWVGSEDCPRGTSVENSNNPWRLVRTATAAEMSQYGNPTTCEIDNGGVIIADGFQASKAYSANSIVDYNDAHYKTSVDQDAWGFVPSGDNPWKKYEPAKAWSASTVYVKGDRVVVDGQAYEALFWTQSDNPALVANQNATGSNSRPWKPLGKTQSYSNEELNNAPQFNPETLYASDTLIRFNGENYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDPMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHAQLKGLYGNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 8267 - protein, 660 aa, Escherichia coli AA86; identical to SEQ ID NO: 6837

SEQ ID NO: 8268 - protein, 505 aa, Escherichia coli AA86
MYKKTTLAVLIALLTGATTVHAQTDISSIESRLAALEQRLKNAESRAQAAEARAKTAELQVQKLAETQQQNQLTTQEVAQRTVQLEQKSAENSGFEFHGYARSGLLMNDAASSSKSGPYLTPAGETGGAVGRLGNEADTYVELNVEHKQTLDNGATTRFKAMLADGQRDYNDWTGGSSNLNIRQAFAELGALPSFTGAFKDSTVWAGKRFDRDNFDIHWLDSDVVFLAGTGGGIYDVKWNETFRSNFSLYGRNFGDLDDIDNNVQNYILTMNHYAGPFQLMVSGLRAKDNDDRKDANGDLIQTDAANTGVHALVGLHNDTFYGLREGTAKTALLYGHGLGAEVKGIGSDGALLSEANTWRFASYGTTPLGSGWYVAPAILAQSSKDRYVKGDSYEWVTFNTRLIKEVTQNFALAFEGSYQYMDLKPKGYQNHNAVNGSFYKLTFAPTLKANDINNFFSRPELRLFATWMDWSSKLDDFASNDAFGSSGFNTGGEWNFGVQMETWF

SEQ ID NO: 8269 - protein, 432 aa, Escherichia coli AA86; identical to SEQ ID NO: 5727

SEQ ID NO: 8270 - protein, 359 aa, Escherichia coli AA86; identical to SEQ ID NO: 5847

SEQ ID NO: 8271 - protein, 119 aa, Escherichia coli AA86; identical to SEQ ID NO: 6116

SEQ ID NO: 8272 - protein, 784 aa, Escherichia coli AA86
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYKDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTRLAESANRVMPQFKVDGRMVFERDMEMLAPGYTQTLEPRAQYLYVPYRDQSKIYNYDSSLLQSDYSGLFRDRTYGGLDRIASANQVTTGVTSRIYDDAAVERFNISVGQIYYFTESRTGDDNITWENDDKTGSLVWAGDTYWRISDRWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 8273 - protein, 673 aa, Escherichia coli AA86; identical to SEQ ID NO: 6170

SEQ ID NO: 8274 - protein, 715 aa, Escherichia coli AA86; identical to SEQ ID NO: 6806

SEQ ID NO: 8275 - protein, 368 aa, Escherichia coli AA86
MNKTITALTIIMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTTIDKINAHYFDKKAEDYFFNKFLLSFDPSTQQWSYAGESPWYGTAGAAVVNKGDKTWLINGEAKPGLRTDAVFELDFTGNNLKWNKLAPVASPDGVAGGFAGMSNDSLIFAGGAGFKGSRENYQNGKNYAHEGLKKSYSADIHLWHNGKWDKSGELSQGRAYGVSLPWNNSLLIIGGETAGGKAVTDSVLISVKDNKVAVQN

SEQ ID NO: 8276 - protein, 241 aa, Escherichia coli AA86; identical to SEQ ID NO: 6139

SEQ ID NO: 8277 - protein, 856 aa, Escherichia coli AA86
MAGFFVRLFVACAFTAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAQLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLADNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 8278 - protein, 690 aa, Escherichia coli AA86
MIVTGNTAADTTDSAAGAGFKTNDIDVGPLGTKSWIETPYSSTTVTKEMIENQQAQSVSEMLKYSPSTQMQARGGMDVGRPQSRGMQGSVVANSRLDGLNIVSTTAFPVEMLERMDVLNSLTGALYGPASPAGQFNFVAKRPTEETLRKVTLGYQSRSAFTGHADLGGHFDENKRFGYRVNLLDQEGEGNVDDSTLRRKLVSVALDWNIQPGTQLQLDASHYEFIQKGYVGSFNYGPNVKLPSAPNPKDKNLALSTAGNDLTTDTISTRLIHYFNDDWSMNAGVGWQQADRAMRSVSSKILNNQGDISRSMKDSTAAGRFRVLSNTAGLNGHIDTGSIGHDLSLSTTGYVWSLYSAKGTGSSYSWGTTNMYHPDAIDEQGDGKIRTGGPRYRSSVNTQQSVTLGDTVTFTPQWSAMFYLSQSWLQTKNYDKHGNQTNQVDENGLSPNAALMYKITPNTMAYVSYADSLEQGGTAPTDESVKNAGQTLNPYRSKQYEVGLKSDIGEMNLGAALFRLERPFAYLDTDNVYKEQGNQVNNGLELTAAGNVWQGLNIYSGVTFLDPKLKDTANASTSNKQVVGVPKVQANLLAEYSLPSIPEWVYSANVHYTGKRAANDTNTSYASSYTTWDLGTRYTTKVSNVPTTFRVVVNNVFDKHYWASIFPSGTDGDNGSPSAFIGGGREVRASVTFDF

SEQ ID NO: 8279 - protein, 828 aa, Escherichia coli AA86; identical to SEQ ID NO: 6558

SEQ ID NO: 8280 - protein, 162 aa, Escherichia coli AA86; identical to SEQ ID NO: 5896

SEQ ID NO: 8281 - protein, 373 aa, Escherichia coli AA86; identical to SEQ ID NO: 5781

SEQ ID NO: 8282 - protein, 700 aa, Escherichia coli AA86
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVATTRFTTHGYRDHSGAQKNLANAKLGVRIDDASKLSLIFNSVDIKADDPGGLTEAEWKANPQQAPRAEQYDMRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNRGVPEYGQKGELRRDERNLMWNVDPYLQTQWQLTDKLSLDAGVRYSSVWFDSNDHYVTPGNGDDSGDASYHKWLPAGSLKYAMTDAWNVYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEKDCNGNRMPGIARNMGFASIGYIPEDGWYAGTEARYMGDIMADDENTAKAPSYTLVGLFTGYKYNYHNLTVDLFGRVDNLFDKEYVGSVIVNESNGRYYEPAPGRNYGVGINIAWRFE

SEQ ID NO: 8283 - protein, 631 aa, Escherichia coli AA86
MIHLVIIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGSMTNLSGVYGTLLLDNNLNYSVQVGNTQGGNTSSGTSGYSSLNYRGAYGNTNVGYSRSGDSSQIYYGMSGGIIAHADGITFGQPLGDTMVLVKAPGADNVKIENQIGIHTDWRGYAILPFATEYRENRVALNANSLADNVELDETVVTVIPTHGAIARATFNAQIGGKVLMTLKYGNKSIPFGAIVTHGENKNGSIVAENGQVYLTGLQQSGKLQVSWGNDKNSNCIVDYKLPAVSPGTLLNQQTAICR

SEQ ID NO: 8284 - protein, 200 aa, Escherichia coli AA86
MLAFCRSSLKSKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRFLQCGNEIYSAIKDLQHKAPDKNIVIFTHNHCLTYIAKDKRDATFKPDYLDGLVMHVEKGKVYLDGEFVNH

SEQ ID NO: 8285 - protein, 331 aa, Escherichia coli AA86; identical to SEQ ID NO: 6551

SEQ ID NO: 8286 - protein, 760 aa, Escherichia coli AA86
MENNRNFPARQFHSLTFFAGLCIGITPVAQALAAEGQANADDTLVVEASTPSLYAPQKSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPASDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 8287 - protein, 746 aa, Escherichia coli AA86
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKAAQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGKNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 8288 - protein, 203 aa, Escherichia coli AA86
MKKIAITCALLSSLVASSVWADAASDLKSRLDKVSSFQASFTQKVTDGSGAAVQEGQGDLWVKRPNLFNWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKSQQNGAVDAAKFTFTPPQGVTVDDQRK

SEQ ID NO: 8289 - protein, 118 aa, Escherichia coli AA86
MKKRGAFLGLLLVSACASVFAANNETSKSVTFPKCEGLDAAGIAASVKRDYQQNRVARWADDQKIVGQADPVAWVSLQDIQGKDDKWSVPLNVRGKSADIHYQVSVDCKSGMAEYQRR

SEQ ID NO: 8290 - protein, 518 aa, Escherichia coli AA86
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKDTKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDTVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 8291 - protein, 866 aa, Escherichia coli AA86
MTIKPTKNYHNHLTRIATFCALLYCNGAFCAELVEYDHTFLMGQNASNIDLSRYSEGNPAIPGVYDVSVYVNDQPVINQSITFVAIEGKKNARACITLKNLLQFHINSPDINSEKAVLLARDEALGNCLNLTEIIPQASVRYDVNDQRLDIDVPQAWVMKNYQNYVDPSLWENGINAAMLSYNLNGYHSETPGRKNDSIYAAFNGGMNLGAWRLRASGNYNWMTDSGGNYDFKNRYIQRDIASLRSQFIIGESYTTGETFDSVSIRGIRLYSDSRMLPPTLASFAPIIHGVANTNAKVTITQGGYKIYETTVPPGAFVIDDLSPSGYGSDLIVTIEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSISAQRSWNEDGDADDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIERWGYGVTSALSPYHENRIALDINDLENDVELKSTSAVAVPRQGSVVFADFETVQGQSAIMNITRSDGKNIPFAADIYDDQGNVIGNVGQGGQAFVRGIEQQGNINIKWLEESKPVSCLAHYQQSSEAEKIAQSIILNGIRCQIQ

SEQ ID NO: 8292 - protein, 246 aa, Escherichia coli AA86
MFFNTKYTAALCFATCVAFSSSAIADIVISGTRVIYKSDQKSVNIRLENKGNNPLLVQSWLDTGDDNAEPGSITVPFTATPPVSRIDAKRGQTIKLMYTASSVLPKDRESVFWFNVLEVPPKPDAATVANQSLLQLAFRTRIKLFYRPEALKGNPSEAPLALKWSWSGSEGKAALRVANPTPYYVSFSSGDLEASGKRFPIDVKMITPFSDEVMKVTGLNGKANSAKVHFYAINDFGGAIEGNASL

SEQ ID NO: 8293 - protein, 238 aa, Escherichia coli AA86
MSVFSRVCLGFTFLLTASQVQASIVLGGTRIIYPSNQNEVQITLKNKDAYARYLVQSWVSNIDGSKAPFLITPPVYKLEENRQTLLHIVFTGDKNKLPQDRESLFLANIKSVSAMPEELKDKNTLQFAMKARLKLFWRPASLDNSDALTAWEKLKFHKEAGKLIVKNPTPFYISFSDLTVSGKNIVPTESKSEPGALLMMVGPFSEQRFSLPVGAGSIVEWSVITDYGSSSGKRQQKL

SEQ ID NO: 8294 - protein, 749 aa, Escherichia coli AA86
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVAVGTRGASNTYDYLIIRGFAADGQSQNNYLNGLKMQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMIGYSFDHEFNDTFTVRQNLRFAQNKVSQKSVYGYGMCSDPLYSSNPSSSPCANVPQSQWGHTLTRQYVIDNEKLENFSVDTQLQSKFATGSVDHTLLTGVDFMRMRNDIDSWFGYAGSVAPSDIYNLDRSDFDFGAHPNPSGPYRVLLKQKQTGLYVQDQAQWDKVLVTLGGRYDWADQSSFNRDYGNKSERDDKEFTWRGGVNYLFDNGVTPYFSYSESFEPASQTDANGDLFAPSKGKQYEVGVKYVPEDRPIVVTGALYQLTKTNNLMADPNGSLFSVEGGEIRARGVELEAKAALSASVNLVGSYTYTDAEYTTDTNYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 8295 - protein, 266 aa, Escherichia coli AA86
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLLDQYAQLKAQYADKSKKRVFLQFGINPPFTSGKESIQNQVLEVCGGENIFKDSRVPWPQVSREQVLARSPQAIVITGGPDQIPKIKQYWGEQLKIPVIPLTSDWFERASPRIILAAQQLCNALSQVD

SEQ ID NO: 8296 - protein, 236 aa, Escherichia coli AA86
MQTTRTPYSVSFMATVLLLFLFACHSTIANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTHLAMAPEEAPAMLRFRRSGSILTLINPTPYFITVTNMKAGNSNLPNTMVPPKGEVSVDIPHAVTGDISFQTINDYGALTPRIKATMQ

SEQ ID NO: 8297 - protein, 826 aa, Escherichia coli AA86
MLRMTPLASAIVALLIGIEAYAAEETFDTHFMIGGMKDQQVANIRLDDNQPLPGQYDIDIYVNKQWRGKYEIIVKDNPQETCLSREMIKRLGINTDNFASGKQCLTFKQLIQGGSYTWDIGVFRLDFSVPQAWVEELESGYVPPENWERGINAFYTSYYMSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRFGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKNYQLSYSNNLRRISYTLAASHAYDENHHEEKRFNIFISIPFDWGDDVTTPRRQIYMSNSTTFDDQGFASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESKNYICQ

SEQ ID NO: 8298 - protein, 224 aa, Escherichia coli AA86; identical to SEQ ID NO: 5893

SEQ ID NO: 8299 - protein, 250 aa, Escherichia coli AA86
MFYKLSCSMVVSTTLAVLLTTTNLAAHASVTPDRTRLVFNESDKSISVTLRNNNEKLPYLAQSWLEDEKGNKITSPLAVLPPVQRIDAMMNGQVKIQALPDIHTLPSDRESLFYYNVREIPPKSGKANTLQIALQTRIKLFWRPKALEKIDMRKPWQFKVTLTRSGQDYIVNNPTPYHVIISDASTQKKGLTAAGFKPLVMPPKTSQPLKAKMNSAPVLTYINDYGARLPLVFRCEGDTCKVDEAQSLKG

SEQ ID NO: 8300 - protein, 161 aa, Escherichia coli AA86; identical to SEQ ID NO: 5769

SEQ ID NO: 8301 - protein, 362 aa, Escherichia coli AA86
MMKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEESPLGKGKKAEQWATGLKYDANNIYLAANYGETRNATPITNKFTNTSGFANKTQDVLLVAQYQFDFGLRPSIAYTKSKAKDVDGIGDVDLVNYFEVGATYYFNKNMSTYVDYIINQIDSDNKLGVGSDDTVAVGIVYQF

SEQ ID NO: 8302 - protein, 191 aa, Escherichia coli AA86
MKKSLLGLTFASLMFSAGSAVAADYKIDKEGQHAFVNFRIQHLGYSWLYGNFKDFDGTFTFDEKNPAADKVNVTINTTSVDTNHAERDKHLRSADFLNTAKYPQATFTSTSVKKDGDELDITGDLTLNGVTKPVTLEAKLIGQGDDPWGGKRAGFEAEGKIKLKDFNIKTDLGPASQEVDLIISVEGVQPK

SEQ ID NO: 8303 - protein, 111 aa, Escherichia coli AA86; identical to SEQ ID NO: 5889

SEQ ID NO: 8304 - protein, 351 aa, Escherichia coli AA86
MKKSTLALVVMGIVASVSVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPISGGFANKTQNFEAVAQYQFDFGLRPSLGYVLSKGKDIEGIGDEDLVNYVDVGATYYFNKNMSAFVDYKINQLDSDNKLNINNDDIVAVGMTYQF

SEQ ID NO: 8305 - protein, 232 aa, Escherichia coli AA86
MQKNAAHTYAISSLLALSLTGCAWIPSTPLVQGATSAQPVPGPTPVANGSIFQSAQPINYGYQPLFEDRRPRNIGDTLTIVLQENVSASKSSSANASRDGKTNFGFDTVPRYLQGLFGNARADVEASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 8306 - protein, 729 aa, Escherichia coli AA86
MLSTQFNRDNQHQAIIKPSLLAGCIALALLPSAAFAAPATEETVIVEGSATAPDDGENDYNVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDRSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNLSITGTYQF

SEQ ID NO: 8307 - protein, 213 aa, Escherichia coli AA86; identical to SEQ ID NO: 5744

SEQ ID NO: 8308 - protein, 641 aa, Escherichia coli AA86
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKNVKLRAGVLNLGDKDLSRDDYSYNEDGRRYFMAVDYRF

SEQ ID NO: 8309 - protein, 430 aa, Escherichia coli AA86; identical to SEQ ID NO: 5758

SEQ ID NO: 8310 - protein, 203 aa, Escherichia coli AA86; identical to SEQ ID NO: 7450

SEQ ID NO: 8311 - protein, 656 aa, Escherichia coli AA86
MRLKKRYLCTALSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 8312 - protein, 565 aa, Escherichia coli AA86
MKSPAPSRPQKMALIPVCIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPKPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILSRASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPLKQKEAEPTP

SEQ ID NO: 8313 - protein, 539 aa, Escherichia coli AA86; identical to SEQ ID NO: 7564

SEQ ID NO: 8314 - protein, 351 aa, Escherichia coli B088; identical to SEQ ID NO: 5767

SEQ ID NO: 8315 - protein, 230 aa, Escherichia coli B088
MMTKIKLLMLIIFYLIISASAHAAGGIALGATRIIYPADAQQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 8316 - protein, 869 aa, Escherichia coli B088
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQITLLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQATYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 8317 - protein, 360 aa, Escherichia coli B088
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNNQVIYGNNSLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVGMVYQF

SEQ ID NO: 8318 - protein, 746 aa, Escherichia coli B088; identical to SEQ ID NO: 6296

SEQ ID NO: 8319 - protein, 193 aa, Escherichia coli B088; identical to SEQ ID NO: 6300

SEQ ID NO: 8320 - protein, 132 aa, Escherichia coli B088
MNAILSVQGASAPVEKKSFFSKFTRLKKYFSFRPSRLNMLRLVRAVIPAAVLMMFFPQLAMAAQGGGQDLMAGGNATVKATFGKDSSAVKWVILAEVLVGAIMYMMTKNVKFLAGFAIISVFITVGMAVVGL

SEQ ID NO: 8321 - protein, 628 aa, Escherichia coli B088
MEDDMSLSRLPKISLLAMSIYTHLGYATDLNLDFIQGTSIIPSILKSDYVYPQGQYSVDVFVNNEKTGTAELNITPADEKNNMLCFSPEWINSAGVMLDASKYDDVYNREKKCYELAKKNHTQVVFDYSAQKLLLDVPQAYLLSKSAPSRWDYGVTGGRLKYYANFNKTTNDKLNAFGNVDLGFNVGRWVLSSNINVSRSGGETEFTSSDMTLSTAISQIQGDLLLGKSQTQTELFSDFNFYGVSVRSNSNMRPWEARGYAPDISGIASGPSRVTVTQNGYTIYSRMVPAGPYRLDDLRPTGNGDLVVTLEDDNGHKTVQVYPVTTLPTLLRPGDFQYDFAMGKKNQSNELNKAFSSDTGLFWLGSVDYGFSSATLNSAILLNNRYQSAGIGVTKPFGELGALSLSAQTAKARYNNGDEKKGQNVSIKYAKNFTDRTDLQFLTYRYQDKGYVDYAEFDPHRTVIHGNQKSRYEARLSHRFDTTYLSGAWWHQNYWDRDGSDTGATLSLSTSAFDSVSVFLNGSYNRYANTDKADYSASVSVSIPFDLRGVQHYASNSVGYNRSNGSTFNTSISASVNDRVNYNLNADISSRGQRGASASASYAFDAVQTNIGVSQTHSRQGDGQTSFS

SEQ ID NO: 8322 - protein, 230 aa, Escherichia coli B088
MNKVAKTAIAGVLSFAFCSQTMAAFVLNGTRFIYDENKKNITFEVTNNAGQMYGGQVWVDNTSEGNSIYMVPQPPFFKVGAKQKQIIRIMKTDSSLPTDRESLFWLNVQEVPPKPDVKESRGSVLAIAMNSRVKLIYRPSGLKNGRENAEKKLTMEQRGDKTWIKNPTPYYMAIVGVQTNGRELKLSDKVTKELTLLAPFSSVSLGVSARGSLKIAAINDWGGVQNYEIH

SEQ ID NO: 8323 - protein, 251 aa, Escherichia coli B088
MAYLILTLWGGYMLRKKALKITTKILIPYLFLASYVFANNDGGIGLDVTRVIFPSSAESVSLRSGNTSNNSVWLLRAWASDYTTNGTNTPFFITPPLVRINPKESIQFRINKLSDSSSLPSDRESVFSINVMAIPPQMDSQDGSKSHIQFSINNKIKLFYRPDSLNDSKIIEKIPESIQVKNNKSDIEIRNPTPYFVTLDKIKINNTELKNGDYMIAPFSSINIDWKGARDFTFQTINDYGGLTRPVHIYF

SEQ ID NO: 8324 - protein, 243 aa, Escherichia coli B088
MTFMKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPAPEKNSDHAVLQVAIQSRIKVFWRPTALRKKAGEKVELQLQVSQQGNQLTLKNPTAYYLTIAYLGRNEKGVLPGFKTVMVAPFSTVNTNTGNYSGSQFYLGYMDDYGALRMTTLNCSGQCHLQAVEAKK

SEQ ID NO: 8325 - protein, 816 aa, Escherichia coli B088
MNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGVLMDYNLFASSYRPQDGSSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAIGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPVISSYQPSTVAVNMNDLPDGVTVAENVIKETWIEGAIGYKSLASRSGKDVNVIIRNASGQFPPLGADIRQDDSGISVGMVGEKGHAWLSGVAENQKFTVVWGDSQHCSLHLPEHMEDTANRLILPCH

SEQ ID NO: 8326 - protein, 430 aa, Escherichia coli B088; identical to SEQ ID NO: 5758

SEQ ID NO: 8327 - protein, 332 aa, Escherichia coli B088; identical to SEQ ID NO: 6321

SEQ ID NO: 8328 - protein, 760 aa, Escherichia coli B088; identical to SEQ ID NO: 6322

SEQ ID NO: 8329 - protein, 203 aa, Escherichia coli B088
MKKIAITCALLSSLVASSVWADAASDLKSRLDKVSSFHASFTQKVTDGSGAAVQEGQGDLWVKRPNLFNWHMTQPDESILVSDGKTLWFYNPFVEQATATWLKDATGNTPFMLIARNQSSDWQQYNIKQNGDDFVLTPKASNGNLKQFTINVGRDGTIHQFTAVEQDDQRSSYQLKSQQNGAVDAAKFTFTPPQGVTVDDQRK

SEQ ID NO: 8330 - protein, 362 aa, Escherichia coli B088; identical to SEQ ID NO: 5809

SEQ ID NO: 8331 - protein, 224 aa, Escherichia coli B088
MTVSLTTILLSCSSAWAAGKGGIGLAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLGEAPAKLRCTSSADMVTVSNPTPYFITLTDLKIGGKVVKNQMISPFDKYQFSLPKGAKNSSVTYRTINDYGAETPQLNCKS

SEQ ID NO: 8332 - protein, 866 aa, Escherichia coli B088
MYRTHRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGLPAQGAITVRWGEAPDQICHISYQLTEQQINSAITRMDAICR

SEQ ID NO: 8333 - protein, 236 aa, Escherichia coli B088; identical to SEQ ID NO: 6329

SEQ ID NO: 8334 - protein, 517 aa, Escherichia coli B088; identical to SEQ ID NO: 6817

SEQ ID NO: 8335 - protein, 191 aa, Escherichia coli B088; identical to SEQ ID NO: 5748

SEQ ID NO: 8336 - protein, 232 aa, Escherichia coli B088; identical to SEQ ID NO: 5747

SEQ ID NO: 8337 - protein, 729 aa, Escherichia coli B088
MLSTQFNRDNQYQASTKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGIYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGTPRNFSITGTYQF

SEQ ID NO: 8338 - protein, 213 aa, Escherichia coli B088; identical to SEQ ID NO: 5744

SEQ ID NO: 8339 - protein, 203 aa, Escherichia coli B088; identical to SEQ ID NO: 6396

SEQ ID NO: 8340 - protein, 565 aa, Escherichia coli B088; identical to SEQ ID NO: 6492

SEQ ID NO: 8341 - protein, 207 aa, Escherichia coli B088; identical to SEQ ID NO: 5743

SEQ ID NO: 8342 - protein, 261 aa, Escherichia coli B088
MNRIVFWFVTLVFISSTSYANDFYRADSRSPDEVRRSGGLIPRGQDEAYERGTPININLYDHARGTVTGNTRYNDGYVSTTTTLRQAHLIGQNMLGSFNEYYIYVIAPAPNLFDVNGILGTYSPYPSENEYAALGGVPLSQIIGWYRVTFGAIEGGMHRNRNYRRDLFRGLSVAPNEDGYHLAGFPDEFPAWREYPWIEFAPDQCHQNNKTNSFLTCDFITNELSQADLLKFKKLIKRKSTFLTLQSIDDFLVKNGDKDEL

SEQ ID NO: 8343 - protein, 551 aa, Escherichia coli B088; identical to SEQ ID NO: 5742

SEQ ID NO: 8344 - protein, 704 aa, Escherichia coli B088
MAFFMKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 8345 - protein, 518 aa, Escherichia coli B088; identical to SEQ ID NO: 7565

SEQ ID NO: 8346 - protein, 883 aa, Escherichia coli B088
MTAFRAAFKAYRMHQVLIMPRFARLTIALGLATAVFPVDAEYYFNPRFLSNDLAESVDLSAFTKGREAPPGTYRVDIYLNDEFMTSRDITFIADDNNAELIPCLSTDLLVSLGIKKIALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYYSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELNETVVTVIPTHGAIARATFNAQIGGKVLMTLKYGNKSVPFGAIVTHGENKNGSIVAENGQVYLTGLPQSGQLQVSWGKDKNSNCIVEYKLPEVSPGTLLNQQTAICR

SEQ ID NO: 8347 - protein, 239 aa, Escherichia coli B088; identical to SEQ ID NO: 6291

SEQ ID NO: 8348 - protein, 111 aa, Escherichia coli B088
MKKQIEGMTMKKVLALVVAAAMGLSSTAFAAETATTPAPTATTTKAAPAKTTHHKKQHKAAPAQKAQAAKKHHKNTKAEQKAPEQKAQAAKKHAGKHSHQQPAKPAAQPAA

SEQ ID NO: 8349 - protein, 122 aa, Escherichia coli B088; identical to SEQ ID NO: 5737

SEQ ID NO: 8350 - protein, 826 aa, Escherichia coli B088; identical to SEQ ID NO: 7342

SEQ ID NO: 8351 - protein, 224 aa, Escherichia coli B088; identical to SEQ ID NO: 6302

SEQ ID NO: 8352 - protein, 641 aa, Escherichia coli B088; identical to SEQ ID NO: 7667

SEQ ID NO: 8353 - protein, 828 aa, Escherichia coli B088; identical to SEQ ID NO: 6558

SEQ ID NO: 8354 - protein, 162 aa, Escherichia coli B088; identical to SEQ ID NO: 5896

SEQ ID NO: 8355 - protein, 375 aa, Escherichia coli B088
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRDALRQNGDGVGGSITYDYEGFGIGAAVSSSKRTDDQNGSYISNGVARNYIGTGDRAETYTGGLKYDANNIYLAAQYTQTYNATRVGSLGWANKAQNFEAVAQYQFDFGLRPSVAYLQSKGKNLGVINGRNYDDEDILKYVDVGATYYFNKNMSTYVDYKINLLDDNQFTRDAGINTDNIVALGLVYQF

SEQ ID NO: 8356 - protein, 200 aa, Escherichia coli B088; identical to SEQ ID NO: 6311

SEQ ID NO: 8357 - protein, 274 aa, Escherichia coli B088
MNKTAIALLALLASSASLAATPWQKITQPVPGSAQSIGSFSNGCIVGADTLPIQSEHYQVMRTDQRRYFGHPDLVMFIQRLSSQVSNLGMGTVLIGDMGMPAGGRFNGGHASHQTGLDVDIFLQLPKTRWTSAQLLRPQALDLVSRDGKHVVPTLWKPEIFSLIKLAAQDKDVTRIFVNPAIKQQLCLDAGTDRDWLRKVRPWFQHRAHMHVRLRCPADSLECEDQPLPPPGDGCGAELQSWFAPPKPGTTKPEKKTPPPLPPSCQALLDEHVI

SEQ ID NO: 8358 - protein, 250 aa, Escherichia coli B088
MSDLLCSAKLGATTLALLLSAASLSAQASVTPDRTRLIFNESDKSISVTLRNNDPKLPYLAQSWIEDEKGNKISSPLTVLPPVQRIDSMMNGQVKVQGMPDINKLPADRESLFYFNVREIPPKSNKANTLQIALQTRIKLFWRPKALENVSMKNPWQYKVTLTRNGQEFTVNNPTPYYVIFSNASTQKNGNPAAGFSPIVMSPKTSAPLNVKMGSVLVLTYVNDYGARMPLFFTCNGNSCQVDEEQSRKG

SEQ ID NO: 8359 - protein, 881 aa, Escherichia coli B088
MPDHSLFRLRILPWCIALAMSGSYSSVWAEDDIQFDSRFLELKGDTKIDLKRFSSQGYVEPGKYNLQVQLNKQPLAEEYDIYWYAGEDEASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 8360 - protein, 425 aa, Escherichia coli B088
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGRKSTVQRS

SEQ ID NO: 8361 - protein, 360 aa, Escherichia coli B088; identical to SEQ ID NO: 6645

SEQ ID NO: 8362 - protein, 679 aa, Escherichia coli B088
MSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 8363 - protein, 837 aa, Escherichia coli B088
MEQMYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEVAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSGRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 8364 - protein, 249 aa, Escherichia coli B088; identical to SEQ ID NO: 6450

SEQ ID NO: 8365 - protein, 231 aa, Escherichia coli B088; identical to SEQ ID NO: 6351

SEQ ID NO: 8366 - protein, 838 aa, Escherichia coli B088
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 8367 - protein, 678 aa, Escherichia coli B088; identical to SEQ ID NO: 6353

SEQ ID NO: 8368 - protein, 843 aa, Escherichia coli B088
MHWMHLPLYHYRAHFSFSLLALTIASSLPAYGGKFNPKFLENVQGIDQHIDLSVYDSPVGQQIPGKYRVSVFVNEEKMASRTLDFSTASEAKRKASGESLMPCLSRVQLEEMGVRVDSFPALKMSPPEACVAFDEIIPQATSRFDFNTQTLHLSFPQAAMMMTARGTVDPSRWDEGIPALLLDYSFSGSNGRNEGTGSSSDSTSDSYYLNLRSGLNVGPWRLRNNSIWNRTDGKNQWDNVGTSLNRAIIPLKSQITLGDTATPGEIFDSVQMRGALLASDDEMLPDSQRGFAPVVRGIAKSNAEVSIEQNGYVIYRTFVQPGAFEINDLYATSGSGDLTVIIKEADGSEQRFIQPFSAVAIFQREGYLKYSLAAGEYRAGNYDSDKPHFGQFTAMYGLPWGMTAYGGALLSADYSALALGLGKNFGTIGAVSVDVTQAKSQLRNNEKEEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSVAYTWTRSPEWEEDDRLWSFSVSIPLGGAWSSYRMTTDQNGKTSQQASVSGTLLEDCNLSYNVQQGYTSNGVGYSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNVELQEAFQKVVPTRGAVVRSRFDTRVGYRVLMSLKQANGNAVPFGATAALIDESKPASSIVGEEGQLYISGMPEEGELQVSWGNEQAQRCRVPFRLPENKDNAAIVMVNAVCEK

SEQ ID NO: 8369 - protein, 228 aa, Escherichia coli B088; identical to SEQ ID NO: 6185

SEQ ID NO: 8370 - protein, 412 aa, Escherichia coli B088; identical to SEQ ID NO: 6390

SEQ ID NO: 8371 - protein, 243 aa, Escherichia coli B088; identical to SEQ ID NO: 6145

SEQ ID NO: 8372 - protein, 208 aa, Escherichia coli B088; identical to SEQ ID NO: 5717

SEQ ID NO: 8373 - protein, 614 aa, Escherichia coli B088
MIKKASLLTAFSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHFGRYDSSATLDEMKQYTVQWANNVIVGHGSIGAGVDWQKQTTTPGTGYVENGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 8374 - protein, 446 aa, Escherichia coli B088; identical to SEQ ID NO: 6459

SEQ ID NO: 8375 - protein, 237 aa, Escherichia coli B088; identical to SEQ ID NO: 6313

SEQ ID NO: 8376 - protein, 478 aa, Escherichia coli B088; identical to SEQ ID NO: 5711

SEQ ID NO: 8377 - protein, 233 aa, Escherichia coli B088
MTKKNTLQKLFTFASLCLFTASSHAAFVLNSTRYVFDEKRENISVQVDNQSTQEYGGQIWIENQDQNDKNVYFVPSPTFFKVAEQHKQILRILKINDALPKDKESLFWINIQEIPKAPKDGTNTLSIALHTQVKMFYRPDALKEKRENAEQNIKAISSEGNTVLWNDTPYYFAIISVKQNGTAIKVSEDIKDKLSVFAPGEKVSLGKSVTSNSLSIVAFDDYGVDKEYKLNKS

SEQ ID NO: 8378 - protein, 785 aa, Escherichia coli B088
MKIKVLCVAIIFHLWSNEILADDFNYSFIRGGSKEVPEVLKNSGQNIPGKYVVDLLFNGSKTATSVDLAISNDDAEHICLSDEWLQKKGITINKEFYKAYLNPARNCYIIDKEKNSRVFFDPSLQELSIDMPQAGFIDTKKEGGTWDYGSTGFKLAYDLNTSKSSNQDRTTYGNIEGQINIGEWVLLGRGYAYQGEKFQSNNLLLTHAIKSIKSDILIGKTQSYNTLNNGFTFYGAQLKSNQDMYPWNSQSYAPVINGIARTHARVTVEQGGYTLKSFVVPPGPFVINDLTGVYSGDIILKIYEEDGTVKEQRFPVAVLPNLLKPGNYNYNIAIGSKVDQYSDKRDEDSLFAQMTYDYGFVPFTLNTSALVDKNYTNVGLGFIRSFGWFGAVAMSGNLSQAKYHNGKAMNGFSASVKYARALGENANLQLIGYRFNSENYIDYSDFNYRYYSLLNNRPKQRYESIITYQLPEMNVFLNMSAWKEDYWDRSSEVGANLNLSKSFNNISVSLNAGYSKLQGMENDYNAGVSLSVPFSVFDKSHYSFSGINYDRRNGTNFNTGVAGNINSRLSYNASINQSRNTTGSAVSASYLFDVVQTSASYSQMGSTSSSSFQVGGSIIGVPDAGILFTPVKNDEIAVVQMEDVPGVRFNGSMPGDKKGRAVIPLTAYNNNTITVNADNLPQSIELTENAINVTPTENAIIYKKVKYRKINTYIVKVISGNGFVIPMGSIAKNAENQEIGYVNNGGILLMNLEEKDEGIISVGDCKFDSRSLKKDMGKVQEIKCD

SEQ ID NO: 8379 - protein, 368 aa, Escherichia coli B088; identical to SEQ ID NO: 7974

SEQ ID NO: 8380 - protein, 241 aa, Escherichia coli B088; identical to SEQ ID NO: 6138

SEQ ID NO: 8381 - protein, 875 aa, Escherichia coli B088
MNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNRSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 8382 - protein, 784 aa, Escherichia coli B088; identical to SEQ ID NO: 6283

SEQ ID NO: 8383 - protein, 866 aa, Escherichia coli B088
MTIKPTKNYHNHLTRIATFCALLYCNSAFCAELVEYDHTFLMGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQSRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 8384 - protein, 246 aa, Escherichia coli B088; identical to SEQ ID NO: 6342

SEQ ID NO: 8385 - protein, 747 aa, Escherichia coli B088; identical to SEQ ID NO: 6343

SEQ ID NO: 8386 - protein, 266 aa, Escherichia coli B088; identical to SEQ ID NO: 5772

SEQ ID NO: 8387 - protein, 161 aa, Escherichia coli B088; identical to SEQ ID NO: 5769

SEQ ID NO: 8388 - protein, 678 aa, Escherichia coli B093
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRIWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPAATTAAVSAPANPSAELKIYDTSSQPLSQILNQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRATTDSDMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 8389 - protein, 222 aa, Escherichia coli B093
MSKLGISSLFKSILLTAALAVSFTASAFTEGTDYMVLEKPIPNADKTLIKVFSYACPFCYKYDKAVTGPVSEKVKDIVAFTPFHLETKGEYGKQASEVFAVLINKDKAAGISLFDANSQFKKAKFAYYAAYHDKKERWSDGKDPAAFIKTGLDAAGMSQADFEAALKEPAVQETLEKWKASYDVAKIQGVPAYVVNGKYLIYTKSIKSIDAMADLIRELASK

SEQ ID NO: 8390 - protein, 713 aa, Escherichia coli B093
MAKFTPSFSGIKGRALFSLLFAAPMIHATDTATTKDGETITVTANANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 8391 - protein, 686 aa, Escherichia coli B093
MFWRDMTLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 8392 - protein, 359 aa, Escherichia coli B093; identical to SEQ ID NO: 5847

SEQ ID NO: 8393 - protein, 230 aa, Escherichia coli B093; identical to SEQ ID NO: 7465

SEQ ID NO: 8394 - protein, 869 aa, Escherichia coli B093
MKIPTTTDIPQRYTWCLAGICYSSLAILPSFLSYAESYFNPAFLLENGTSVADLSRFERGNHQPAGVYRVDLWRNDEFIGSQDIVFESTTVNTGDKSGGLMPCFNQALLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRDYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGNGANSRCIAHYVLPKQSLQQAVTVISAVCTHPGS

SEQ ID NO: 8395 - protein, 193 aa, Escherichia coli B093; identical to SEQ ID NO: 6560

SEQ ID NO: 8396 - protein, 746 aa, Escherichia coli B093
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNVVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 8397 - protein, 430 aa, Escherichia coli B093; identical to SEQ ID NO: 5758

SEQ ID NO: 8398 - protein, 331 aa, Escherichia coli B093
MKKPVVIGLAVVVLAAVVAGGYWWYQSRQDNGLTLYGNVDIRTVNLSFRVGGRVESLAVDEGDAVKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGDEAGHE

SEQ ID NO: 8399 - protein, 660 aa, Escherichia coli B093
MGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 8400 - protein, 432 aa, Escherichia coli B093; identical to SEQ ID NO: 5727

SEQ ID NO: 8401 - protein, 785 aa, Escherichia coli B093; identical to SEQ ID NO: 7435

SEQ ID NO: 8402 - protein, 878 aa, Escherichia coli B093
MSYLNLRLYQRNTQCLHIRKHRLAGFFVRLFVACAFTAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAQLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLADNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 8403 - protein, 241 aa, Escherichia coli B093
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLMLINPTPYYLTVTELNAGTRVLENALVPPMGESTVKLPSDAGSNITYRTINDYGALTPKMTGVME

SEQ ID NO: 8404 - protein, 368 aa, Escherichia coli B093
MNKTIMALAIMMASFAANASVLPETPVPFKSGTGAIDNDTVYIGLGSAGTAWYKLDTQAKDKKWTALAAFPGGPRDQATSAFIDGNLYVFGGIDKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLDPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 8405 - protein, 213 aa, Escherichia coli B093; identical to SEQ ID NO: 5744

SEQ ID NO: 8406 - protein, 729 aa, Escherichia coli B093
MLSTQFNRDNQHQAIIKPSLLAGCIALALLPSAAFAAPVTEETVIVEGSATAPDDGENDYNVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLTPITGNNYELGLKSDWMNSRLTTTLAIFRIEQDHVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 8407 - protein, 232 aa, Escherichia coli B093; identical to SEQ ID NO: 5747

SEQ ID NO: 8408 - protein, 191 aa, Escherichia coli B093; identical to SEQ ID NO: 5748

SEQ ID NO: 8409 - protein, 229 aa, Escherichia coli B093
MALLIFAVLSLLVASELQAGVVVGGTRFIFPADRDSISISLTNTSQESWLINSKINRPTRWAGGEASTVPAPLLPAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNAGVVPPKSQRQTSWCQAITPCHVSWRTINDYGGLSAKKEQNLP

SEQ ID NO: 8410 - protein, 866 aa, Escherichia coli B093
MYRTQRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACAPLAEIIPDASVTFNVNKLRLEISVPQIAIKSNARGYVPPERWDEGINALLLGYSFSGANSIHSSAGSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQVTIKQNGYTIYQTYVSPGAFEISDLYSTSSSGDLLVEIKEADGSVNSYSVPFSSVPLLQRQGRIKYAVTLAKYRTNSNDQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPKSNDSYTRKKNYAWMTSNTSIDNEGHTTQNLGLTETLLDDGNLSYSVQQGYNSEGKTANGSTSMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGMPLRFGAMATLDGAQTISGIIDDDGSLYMSGLPAKGTITVRWGDAPDQICHISYELTEQQINAAITRMDSVCE

SEQ ID NO: 8411 - protein, 233 aa, Escherichia coli B093
MKTCITKGIVTVSLTAILLSCSFTWAAGKGGVGLAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLAEAPAKLRCTSSADMVTVSNPTPYFITLTDLKIGGKVVKNQMISPFDKYQFSLPMGAKNSSVTYRTINDYGAETPQLNCKS

SEQ ID NO: 8412 - protein, 357 aa, Escherichia coli B093; identical to SEQ ID NO: 5807

SEQ ID NO: 8413 - protein, 118 aa, Escherichia coli B093 [sequence omitted]

SEQ ID NO: 8414 - protein, 446 aa, Escherichia coli B093; identical to SEQ ID NO: 7485

SEQ ID NO: 8415 - protein, 478 aa, Escherichia coli B093
MTRIKINARRIFSLFIPFFFFTSVHAEQTAAPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGIIHEIQIPDISTKEKAQQSIGLNMEQIKAEKQDFIKTVIPQWEEQARKNGLLSQ

SEQ ID NO: 8416 - protein, 673 aa, Escherichia coli B093
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRAFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 8417 - protein, 715 aa, Escherichia coli B093
MLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEIVKGPYSVLYGSQAIGGIVNFITKKGGNKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVNQRSGGMTSSKSLTGFINKETRTRSYYESEQSTVSLFAQNDWQFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 8418 - protein, 660 aa, Escherichia coli B093
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQRSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 8419 - protein, 412 aa, Escherichia coli B093
MPNHSNFRLRGIACYIALAISGGSVNAWADDSIQFDPRFLELKGDTKIDLGKFSKKGYVDAGKYNLRVFINKQPLSDEYDINWYVSENDPTKTYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKNWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMSGASGRLEPQDRRRLFLWRRSVMGGGRWLVALRWRAGR

SEQ ID NO: 8420 - protein, 250 aa, Escherichia coli B093
MSYKLSSSMVVSTALAALLSTVSLAAHASVTPDRTRLVFNESDKSISVTLRNNNEKLPYLAQSWLEDEKGNKITSPLAVLPPVQRIDAMMNGQVKIQALPDIHTLPSDRESLFYYNVREIPPKTGKANTLQIALQTRIKLFWRPKALEKIDMRKPWQFKVTLTRSGQEYTVNNPTPYHVIISDASTQKKGPTAAGFKPLVMSPKTSQPLKVKMDSAPVLTYINDYGARLPLIFRCEGDTCKVDEDQSSKG

SEQ ID NO: 8421 - protein, 274 aa, Escherichia coli B093; identical to SEQ ID NO: 5899

SEQ ID NO: 8422 - protein, 200 aa, Escherichia coli B093; identical to SEQ ID NO: 7474

SEQ ID NO: 8423 - protein, 785 aa, Escherichia coli B093
MKKEIFIAAIIFHLLSKGALAEEFNYSFIRGGSKDIPDVLNSNKENVPGKYVVDVVFNGSKIASSTEMSIAKEDAEGICLSDEWLTENGIIINKDFYKNVYNSARQCYLLGNEANSKVAFDQSLQEVSIDLPQAGFQDAAKDGGVWDYGSNGFKIAYDVNTAKNSNQERTTYSSIDGQVNLGEWVLLGKGYAYQGENFDTNNLLLTRAIKSLKSDLQLGKTQLYNSLNNGFTFYGAQLKSNQDMYPWNSRAYSPVINGIARTHARVTIEQSGYTLKSIVVPPGPFVINDLNGVYSGDLIMKIYEEDGSVREQRFPVAVLPNLLRPGTYNYALAMGSKVNQDNGERDKESLFAQMSYDYGFEPFTLNSSLLLDKNYNNIGLGLIRSFGWFGAMSFSGNLSQAKYHNGKNLKGYSTSLKYAKALGDNANLQLIGYRFNSEDYIDYADFTYNSYSFIRNRPKQRYESIVTYQLPEKGMFLNFSAWKEDYWDNYNEVGANLSLTKSFDQITMTLNGGYSRLQNMDADYNVGLSLSVPLSLFDKTHYSFSNVNYDRRTGTSMNTGISGMINQRLSYNASVNQTRDTTGGTLSASYLFDWMQTSATYSQTGKNSSTSLQLGGSVIGVPEGGIIFTPVKNDQLAIVQMKDVPGVMFNGSLPGDKYGRAVIPLTAYNNNTISVNAEKLPKNIELTDNAINVTPTGNAIIYKNVKFKKINTYVVKLYGKNGYVVPMGSIAKNTQGKEVGYVNNGGILLMNLETHDEGVISLDQCQFNTQSLKKNHDQTQEIHCE

SEQ ID NO: 8424 - protein, 231 aa, Escherichia coli B093
MSNNVMKKINLMPVLALLLICFNSHAAFVLNSTRYIFAGDKDNISVQVNNESSQEYGGQIWIDNANARDQNVYFAPSPTFFKVSGGHKQILRVLKINDSLPKDKESLFWVNVQEIPKAPKEGTNSLAIALHTQVKMIYRPESLKEGREDAEKNIKIIHEGGNTILYNNSPYYFAVINVKQNGHDVKLSEETKNKIAAFAPFEKVSLGSKLSGKDISIVSFDDYGVDREYKL

SEQ ID NO: 8425 - protein, 826 aa, Escherichia coli B093
MLRMTPLASAIVALLLGIEAYAAEETFDTHFMIGGMKDQQVANIRLDDNQPLPGQYDIDIYVNKQWRGKYEIIVKDNPQETCLSREIIKRLGINTDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNSNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESKNYICQ

SEQ ID NO: 8426 - protein, 224 aa, Escherichia coli B093
MKGLFALLISSMVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLRVNRSGNGLVIKNDSANWVTISDVKANNVKVNYETIMIAPLESQSINVKSNNANNWHLTIIDDHGNYISDKI

SEQ ID NO: 8427 - protein, 518 aa, Escherichia coli B093; identical to SEQ ID NO: 7565

SEQ ID NO: 8428 - protein, 364 aa, Escherichia coli B093; identical to SEQ ID NO: 5776

SEQ ID NO: 8429 - protein, 162 aa, Escherichia coli B093; identical to SEQ ID NO: 8101

SEQ ID NO: 8430 - protein, 828 aa, Escherichia coli B093; identical to SEQ ID NO: 6558

SEQ ID NO: 8431 - protein, 663 aa, Escherichia coli B093
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 8432 - protein, 866 aa, Escherichia coli B093
MSRKIIKTHNNKLTYIASFCALLLSPCAISAEHVEYDNTFLMGQDASNIDLSRYTEGNPTLPGVYDVSVYINDQPVINQSISFITLEGKKNAQACITLKNLLQFHINKPDINAENSILLQREGELGDCLDLANIIPQASVHYDVNDQRLDINVPQAWVMKNYQNYVDSSLWENGINAAMLAYNVNAYHSEIPDRKNDSVYAAFNGGINLGAWRLRATGNYNWMTNVGSDYDFQNRYLQRDLASLRSQLIVGESYTTGETFDAVSIRGIRLYSDSRMLPPALASFAPIIHGVANTNAKVTITQGGYKIYETTVPPGAFVIDDLSPSGYGSDLIITIEESDGIKRTFSQPFSSVIQMQRPGVGRWDISAGQVLKDDIQNEPNLFQASYYYGLNNYLTGYTGIQITDNNYTAGLLGLGLNTAYGAFSVDVTHSDVQIPDDKTYRGQSYRISWNKLFEDTRTSLNIAAYRYSTQNYLGLNDALTLIDEVKHPEQDLEPKNMRNYSRMKNQVTVSINQPLKFEKKDYGSFYLAGSWSDYWADGQNNTNYSIGYSNSASWGSYSISAQRSWSQDGGNEDSIYLSFSIPIEKLLGSEHRDSGFQSIDTQLNSDFNGSNQLSISSSGYSTENHISYSVNTGYSMMKSSDDLGYIGGYASYESPWGTLSSSVSASSDNSRQISFNTDGGFVLHSGGLTFSNDSFSDSDTLAVVQAPGAKGARINYGNSTIDRWGYGVTNALSPYHENRIALDINGLENDVELKSTSAITVPRQGSVVFAGFETVQGQSAIMNIKRTDGKNIPFAADIYDENGNIIGNVGQGGQAFVRGIEQQGNIRINWLDDGKPVTCLAHYQQSAAPEKIAQTIILNGISCQIQ

SEQ ID NO: 8433 - protein, 246 aa, Escherichia coli B093
MFLNAKHTAAVCFATCMSLSASAIADIVISGTRVIYKSNEKSVNVRLENKGNNPLLVQSWLDTGDDSAEPGSITVPFTATPPVSRIDAKRGQTIKLMYTASSPLPKDRESVFWFNVLEVPPKPDADKVANQSLLQLAFRTRIKLFYRPEGLNGLPSDAPAALKWSWATSAGKTALRVANPTPYHVSFSSGDLVANGKTYPLDVKMVAPLSEETFYIKGMSGKASSAKVHFFAINDFGGAIEGNASL

SEQ ID NO: 8434 - protein, 747 aa, Escherichia coli B093
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVAVGTRGASNTYDYLIIRGFAADGQSQNNYLNGLKMQGNFYNDAVIDPYMLERAEIMRGPVSVLYGKSSPGGLLNMVSKRPTTEPLKEIQFKAGTDSLFQTGFDFSDALDDDGVYSYRLTGIARSANAQQKGAEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLDLYNPVNTDFDFNAKDPDNSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 8435 - protein, 266 aa, Escherichia coli B093; identical to SEQ ID NO: 8089

SEQ ID NO: 8436 - protein, 161 aa, Escherichia coli B093
MKKWLLAAGLGLALATSAQAADKIAIVNMGSLFQQVAQKTGVSNTLENEFKGRASELQRMETDLQAKMKKLQSMKAGSDRTKLEKDVMAQRQTFAQKAQAFEQDRARRSNEERGKLVTRIQTAVKSVASSQSIDLVVDANAVAYNSSDVKDITADVLKQVK

SEQ ID NO: 8437 - protein, 402 aa, Escherichia coli B093
MLIPGVQAAKPQKVTLMVDDVPVAQVLQALAEQEKLNLVVSPDVSGTVSLHLTDVPWKQALQTVVKSAGLITRQEGNILSVHSVAWQNDNIARQEAEQTRAQANLPLENRNITLQYADAGELAKAGEKLLSAKGSMTVDKRTNRLLLRDNKTALSALEQWVAQMDLPVGQVELSAHIVTINEKSLRELGVKWTLADAQQAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 8438 - protein, 351 aa, Escherichia coli B093; identical to SEQ ID NO: 7789

SEQ ID NO: 8439 - protein, 243 aa, Escherichia coli B093
MSRKSCLIRLFKTTVSCKLFTAIILSVFLVQPALTYAGVVIGGTRVVYLSNNPDKSISVFSKEEKIPYLIQAWVDPFNKEDKSKAPFTVIPPVSRLEPAQEKVLRIIHTKGVSLPDDRESVFWLNIKNIPPSASNKAANSLEIAVKTRIKLFWRPASIRLIPEDAAPKVKWHREGRNLIAENPNPIHISVMDVIVDGHDVPLNMIRPFETLTLPLPANSAGGQMIWRFINDYGAVSDPIKMTL

SEQ ID NO: 8440 - protein, 102 aa, Escherichia coli B093
MKKVLALVVAAAMGLSSAAFAAETATTPAPTVTTTKAAPAKTTHHKKQHKAAPAQKAQAAKKHHKNTKAEQKAPEQKAQAAKKHAKKHSHQQPAKPAAQPAA

SEQ ID NO: 8441 - protein, 362 aa, Escherichia coli B093
MKKFTVAISAVAVSVLMAMSAQAAEIYNKDGNKLDLYGKVNAEHYFSESAKHAGDMTYTRLGFRGETQINDQLTGFGQWEYEFEGNRPEGTGATDDDHTRLAFAGLRFGDYGAIDYGRNYGVAYDIGSWTDVLPEFGGDALTQTDVFMLGRATGVATYRNNDFFGMVDGLNFALQYQGKNDDRDATEANGDGYGMSASYDYEGVAVGAAYTKSDRTNAQETYANVSPLNASGKTAEVWATGFKYDANNIYIATTYSKTQNMTVFGKNHIANNARNFEAVAQYQFDFGLRPSIAYLHSRGDNLKGFASQDLLEYVDLGATYYFNKNMSTFVDYKINLIDKSEFTQKAGIATDDIVAVGMTYQF

SEQ ID NO: 8442 - protein, 883 aa, Escherichia coli B093
MTAFRAAFKAYRMHQVLLLPRFARLTIALGLATAVFPVDAEYYFNPRFLSNDLAESVDLSAFTKGREAPPGTYRVDIYLNDEFMTSRDITFIADDNNADLIPCLSTDLLVSLGIKKSALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSIKSVYSKSFYQTGTNIQVAGYRYSTQGFYNLSDSAYSRMSGYTVKPPTGDSNEQTQFIDYFNLFYSKRGQEQISISQQLGHYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNIGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPAVSPGTLLNQQTAICR

SEQ ID NO: 8443 - protein, 236 aa, Escherichia coli B093
MQTTRIPYSISFMATVLLLLLFACHSTIANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDIPHAAPGDISFQTINDYGALTPRIKATMQ

SEQ ID NO: 8444 - protein, 203 aa, Escherichia coli B093; identical to SEQ ID NO: 6347

SEQ ID NO: 8445 - protein, 656 aa, Escherichia coli B093
MRLKKRYLCTALSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRGIVKLGFTPRENDEYTVTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIAYTF

SEQ ID NO: 8446 - protein, 565 aa, Escherichia coli B093
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFAMMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSRQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPVKQNEAEPTP

SEQ ID NO: 8447 - protein, 207 aa, Escherichia coli B093
MPLPDFRLIRLLPLAALVLTACSVTTPKGPGKSPDSPQWRQHQQDVRNLNQYQTRGSFAYISDQQKVYARFFWQQTGQDRYRLLLTNPLGSTELELNAQPGNVQLVDNKGQRYTADDAEEMIGKLTGMPIPLNSLRQWILGLPGDATDYKLDDQYRLSEITYSQNGKNWKVVYGDYDTKTQPAMPANMELTDGGQRIKLKMDNWIVK

SEQ ID NO: 8448 - protein, 369 aa, Escherichia coli B093
MKKLTVTISAVATAVLMAVSAQAAEIYNKDGNKLDLYGKVDGLHYFSSNKDENGDESYMRMGIKGETQINDDLTGYGHWEYQIQANTPENENHAWTRLAFAGLKLSDYGSLDYGRNYGVVYDVTSWTDVLPEFGGDTYSADNFMQGRGNGFATYRNTDFFGLVDGLNFAVQYQGENGGVSGENTTNNGRGALRQNGNGVGGSITYEYDGFSIGGAVSSSQRTWDQNHTGLMGTGNRAETYTGGLKYDANNVYLAAQYTQTYNATLAGNLGWANKAQNLELVAQYQFDFGLRPSLAFLQSKGKKLGSINGRNYDNQDILKYVDVGATYYFNKNMSTYVDYKINLLKDNQFTRDAGINTDDIVAVGLVYQF

SEQ ID NO: 8449 - protein, 614 aa, Escherichia coli B093
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRIEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPSLNPEKSKQWEGAFEGLTAGVNWRISGYRNDVSDLIDYDDHTLKYYNEGKARIKGVEATANFDTGPLTHTVSYDYVDARNAITDVPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 8450 - protein, 366 aa, Escherichia coli B093; identical to SEQ ID NO: 7432

SEQ ID NO: 8451 - protein, 203 aa, Escherichia coli B093
MKKIAITCVLLSSLVASSVWADAASDLKSRLDKVSSFHASFTQKVTDGSGAAVQEGQGDLWVKRPNLFNWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKSQQNGAVDAAKFTFTPPQGVTVDDQRK

SEQ ID NO: 8452 - protein, 700 aa, Escherichia coli B093
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVITQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSSRDEMSVMMYAGERETTQYQSIPMAPQLNPSHAGGVITLQRHYQGIDSRWTHRGELGVPLTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYIPEDGWYAGTEARYMGDIMADDENTAKAPSYTLVGLFTGYKYNYHNLTVDLFGRVDNLFDKEYVGSVIVNESNGRYYEPAPGRNYGIGVNVAWRFE

SEQ ID NO: 8453 - protein, 208 aa, Escherichia coli B093; identical to SEQ ID NO: 5717

SEQ ID NO: 8454 - protein, 539 aa, Escherichia coli B093; identical to SEQ ID NO: 6525

SEQ ID NO: 8455 - protein, 565 aa, Escherichia coli B171; identical to SEQ ID NO: 6492

SEQ ID NO: 8456 - protein, 207 aa, Escherichia coli B171; identical to SEQ ID NO: 5743

SEQ ID NO: 8457 - protein, 672 aa, Escherichia coli B171
MIVSAAPQVVSELDTPAAVSVVDGEEMRLATSRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 8458 - protein, 800 aa, Escherichia coli B171
MTSRDITFIADDNNADLIPCLSTDLLVSLGIKKSALLDNKEHSAEKHVPDNSACTPLQDRLADASTEFDVGQQHLSLSVPQIYVGRMARGYVSPELWEEGINAGLLNYSFNGNSINNRSNHNAGKSNYAYLNLQSGINIGSWRLRDNSTWSYNSGSSNSSNSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTLGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 8459 - protein, 181 aa, Escherichia coli B171
MQTTRTPYSISFMATVLLLLLFACHSTVANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEASGVNTTTLCTAYHCPWLSNCGFSR

SEQ ID NO: 8460 - protein, 111 aa, Escherichia coli B171
MKKQIEGMTMKKVLALVVAAAMGLSSAAFAAETANTPAPTATTTKAAPAKTTHHKKQHKAAPAQKAQAAKKHHKNTKAEQKAPEQKAQAAKKHAGKHSHQQPAKPAAQPAA

SEQ ID NO: 8461 - protein, 203 aa, Escherichia coli B171; identical to SEQ ID NO: 6347

SEQ ID NO: 8462 - protein, 249 aa, Escherichia coli B171; identical to SEQ ID NO: 6450

SEQ ID NO: 8463 - protein, 837 aa, Escherichia coli B171
MEQMYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEVAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASDSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 8464 - protein, 512 aa, Escherichia coli B171; identical to SEQ ID NO: 6251

SEQ ID NO: 8465 - protein, 359 aa, Escherichia coli B171; identical to SEQ ID NO: 6332

SEQ ID NO: 8466 - protein, 863 aa, Escherichia coli B171
MHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTLTLYLSGSHQTYWGTSNVDEQFQAGLNTAFEDINWTLSYSLTKNAWQKGRDQMLALNVNIPFSHWLRSDSKSQWRHASASYSMSHDLNGRMTNLVGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 8467 - protein, 241 aa, Escherichia coli B171; identical to SEQ ID NO: 6143

SEQ ID NO: 8468 - protein, 368 aa, Escherichia coli B171
MNKTITALAILMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLISHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 8469 - protein, 774 aa, Escherichia coli B171
MTPLRVFRKTTPLVNTIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVCGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 8470 - protein, 446 aa, Escherichia coli B171
MMITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAVTRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAYVDEKFSYDINNNGHMLRILDHGAISMGDNWDMMYVGMYQDINWDNDNGTKWWTVGIRPMYKWTPIMSTLMEIGYDNVKSQRTGDTNNQYKITLAQQWQAGDSIWSRPAIRVFATYAKWDEKWGYDYTDKAKGTPNYGKAVPANFEGGSFGRGDSDEWTFGAQMEIWW

SEQ ID NO: 8471 - protein, 478 aa, Escherichia coli B171
MTRIKINARRIFSLLIPFFFFTSVHAEQTAAPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIEIPDISTKEKAQQAIGLNMEQIKAEKQDFIKTVIPQWEEQARKNGLLSQ

SEQ ID NO: 8472 - protein, 412 aa, Escherichia coli B171; identical to SEQ ID NO: 6495

SEQ ID NO: 8473 - protein, 663 aa, Escherichia coli B171
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGLETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 8474 - protein, 828 aa, Escherichia coli B171
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNDKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 8475 - protein, 162 aa, Escherichia coli B171; identical to SEQ ID NO: 6365

SEQ ID NO: 8476 - protein, 367 aa, Escherichia coli B171; identical to SEQ ID NO: 5784

SEQ ID NO: 8477 - protein, 200 aa, Escherichia coli B171; identical to SEQ ID NO: 6311

SEQ ID NO: 8478 - protein, 518 aa, Escherichia coli B171; identical to SEQ ID NO: 6358

SEQ ID NO: 8479 - protein, 245 aa, Escherichia coli B171
MGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 8480 - protein, 231 aa, Escherichia coli B171; identical to SEQ ID NO: 6351

SEQ ID NO: 8481 - protein, 662 aa, Escherichia coli B171
MVPSTFSRLKAARCLPVVLAALIFAGCGTHTPDQSTAYMQGTTQADSAFYLQQMQQSSDDTRINWQLLAIRALVKEGKTGQAVELFNQLPQELNDSQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPAPVSTPAATTTAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGTPITPRATTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 8482 - protein, 746 aa, Escherichia coli B171
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYVTTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLARANYIAGAGAYTYNEPGRTWYMSVNTHF

SEQ ID NO: 8483 - protein, 365 aa, Escherichia coli B171; identical to SEQ ID NO: 7931

SEQ ID NO: 8484 - protein, 760 aa, Escherichia coli B171; identical to SEQ ID NO: 6455

SEQ ID NO: 8485 - protein, 331 aa, Escherichia coli B171; identical to SEQ ID NO: 6456

SEQ ID NO: 8486 - protein, 866 aa, Escherichia coli B171
MTIKPTKNYHNHLTRIATFCALLYCNSAFCAEPVEYDHTFLMGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGSLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 8487 - protein, 246 aa, Escherichia coli B171; identical to SEQ ID NO: 6342

SEQ ID NO: 8488 - protein, 747 aa, Escherichia coli B171; identical to SEQ ID NO: 6343

SEQ ID NO: 8489 - protein, 266 aa, Escherichia coli B171; identical to SEQ ID NO: 5772

SEQ ID NO: 8490 - protein, 161 aa, Escherichia coli B171; identical to SEQ ID NO: 5769

SEQ ID NO: 8491 - protein, 226 aa, Escherichia coli B171; identical to SEQ ID NO: 7934

SEQ ID NO: 8492 - protein, 866 aa, Escherichia coli B171; identical to SEQ ID NO: 8332

SEQ ID NO: 8493 - protein, 362 aa, Escherichia coli B171; identical to SEQ ID NO: 5809

SEQ ID NO: 8494 - protein, 203 aa, Escherichia coli B171; identical to SEQ ID NO: 6414

SEQ ID NO: 8495 - protein, 517 aa, Escherichia coli B171; identical to SEQ ID NO: 6817

SEQ ID NO: 8496 - protein, 191 aa, Escherichia coli B171; identical to SEQ ID NO: 5748

SEQ ID NO: 8497 - protein, 250 aa, Escherichia coli B171; identical to SEQ ID NO: 6317

SEQ ID NO: 8498 - protein, 880 aa, Escherichia coli B171; identical to SEQ ID NO: 6482

SEQ ID NO: 8499 - protein, 826 aa, Escherichia coli B171
MLRMTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGRSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRFGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 8500 - protein, 243 aa, Escherichia coli B171; identical to SEQ ID NO: 6463

SEQ ID NO: 8501 - protein, 274 aa, Escherichia coli B171; identical to SEQ ID NO: 8357

SEQ ID NO: 8502 - protein, 614 aa, Escherichia coli B171; identical to SEQ ID NO: 7971

SEQ ID NO: 8503 - protein, 230 aa, Escherichia coli B171; identical to SEQ ID NO: 6294

SEQ ID NO: 8504 - protein, 122 aa, Escherichia coli B171; identical to SEQ ID NO: 5737

SEQ ID NO: 8505 - protein, 193 aa, Escherichia coli B171; identical to SEQ ID NO: 6300

SEQ ID NO: 8506 - protein, 213 aa, Escherichia coli B171; identical to SEQ ID NO: 5744

SEQ ID NO: 8507 - protein, 729 aa, Escherichia coli B171; identical to SEQ ID NO: 5745

SEQ ID NO: 8508 - protein, 119 aa, Escherichia coli B171; identical to SEQ ID NO: 6076

SEQ ID NO: 8509 - protein, 208 aa, Escherichia coli B171; identical to SEQ ID NO: 5717

SEQ ID NO: 8510 - protein, 230 aa, Escherichia coli B185; identical to SEQ ID NO: 6360

SEQ ID NO: 8511 - protein, 869 aa, Escherichia coli B185
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQVALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 8512 - protein, 365 aa, Escherichia coli B185; identical to SEQ ID NO: 7931

SEQ ID NO: 8513 - protein, 746 aa, Escherichia coli B185
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGITWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 8514 - protein, 229 aa, Escherichia coli B185
MKSVLLLLTVLFVQSVEAGIMPASSRIIYRDGDREKTLMLVNTNDYPVLVQSWVDNGEGSPEAASPPFVVLPPVFRLAARRTQGLRIIYNHDPLPQDRESAFWLNLYEMPPETPHQDPTHLTLAMNTQLKIFYRPKSVTMTPQEAMRKISWHLGNDGSSSYIELNNPTPLNISFTSISIGATKVQQESDMMIKPFSQRRYWLASNNVSGVVAATYLDDNGAQIKQQLAQ

SEQ ID NO: 8515 - protein, 840 aa, Escherichia coli B185
MNKSVVSISAAILVLLCQPVMGKEISPATPSDEDNYTFDPQLFRGSRFSQSSLAKLTTRESVAPGNYKMDIYTNNKLSGSWNVTFKEAADGRVLPCLTPEVADAIGLKTGEDKGEKDPVCTFAQELAPGITSQTQLSQLRLDLSVPQSQMISRPRGYVPPSELDTGASLAFMNYIANYYNVAYSGQNAHSQRSLWASFNGGINLGAWQYRQLSNMTWDNDKGNQWNNIRSYLQRPLPAINSQLMMGQLITSGRFFSGLSYHGVSLATDERMLPDSMRGYAPTIRGVAATNARVSVMQNGHEIYQTTVAPGPFEINDLYPTSYSGDLDVTVTEANGAVSRFSVPFSAVPESMRPGTSRYNVEVGKTQDSGDDSMFGDLTWQHGMTNTLTFNSGSRIADGYQALMLGGVYGSSLGAFGANLTWSHARVPESEAQSGWMSQLTWSKTFQPTSTTVSLAGYRYSTSGYRDLADVLGERHAASNKQSWDSSQWRQQSRFDLTLSQSLANYGNLFVSGSTQNYRGGKSRDTQLQLGYSNSFSHGISMNLSVGRQRMGGYKDNSDDMQTVTSLSFSFPLGGNGPRVPSLSNSWTHSTDGSSQLQSSLTGMLDEAQTTNYSLNVMRDQQYKQTTLSGNMQKRFSQTTVGLNASKGQDYWQASGNVQGAMAVHGGGITFGPYLGETFALVEAKGAEGAKVYNSSQLEINDSGYALVPAVTPYRYNRISLDPQGMDGDAELVDSERQVAPVAGAAVKVIFRTRPGKALLIKSRMADGSELPMGADVLDENNTVVGIAGQGGQIYLRTEQTKGHLSVRWGEGANDSCQLPFDISGKDSNSPIIRLNETCQS

SEQ ID NO: 8516 - protein, 233 aa, Escherichia coli B185
MNIFAYLLVLVFSMSMSSSAFASVVMTGTRIIFPGDAKEKTIQLRNTSDQPYIINIHVEDERGSDKNVPFMPTPQTFRMEAAAGQALRLLYTGDNLPQDRESVFWFSFSQLPYLNKNDKSQNQLILALTNRVKIFYRPSSIVGKSSDAPKNLTYQVKQNRIEVTNPTGYYVVIRAAELLNNGKKVPLANSVMIAPQSTIEWTLRTGISVAPGAQIHLVTVNDYGVNVTSEHAL

SEQ ID NO: 8517 - protein, 517 aa, Escherichia coli B185; identical to SEQ ID NO: 6817

SEQ ID NO: 8518 - protein, 191 aa, Escherichia coli B185; identical to SEQ ID NO: 5748

SEQ ID NO: 8519 - protein, 232 aa, Escherichia coli B185; identical to SEQ ID NO: 5747

SEQ ID NO: 8520 - protein, 729 aa, Escherichia coli B185; identical to SEQ ID NO: 5745

SEQ ID NO: 8521 - protein, 213 aa, Escherichia coli B185; identical to SEQ ID NO: 5744

SEQ ID NO: 8522 - protein, 351 aa, Escherichia coli B185
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETHKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 8523 - protein, 193 aa, Escherichia coli B185; identical to SEQ ID NO: 6300

SEQ ID NO: 8524 - protein, 243 aa, Escherichia coli B185
MTFVKGFPLILLVASMCSHGAVQPDRTRIIFNSKDKATSLRVENRSDKLPYLAYSWIENEKGEKSDEFLVALPPIQRLEPKATSQVRIMKQAATAKLPTDRESLFYYNLREIPPVPEGSEGHAILQVAVQSRIKLFWRPAALRKKMGDHVEQQLQVSQQNNQLTLKNPTGYYLTIAYLGRDEKGVLPGFKSTMVAPFSSVTTSTGSYSGKQFYLGYMDDYGALRMNTLSCQRQCRLQPVENKK

SEQ ID NO: 8525 - protein, 816 aa, Escherichia coli B185
MNIYRLSVLSCLAMVTPPALTAEFNLNVLDKSIRDSVDISLLNQKGVVAPGDYFVSVTVNNNKISNGQQIRWQKSGDKIIPCINESLIELFGLKSDFRKKLPAIKECVDFSVFPEIIFTFDQANQQLNITIPQAWLAWHSENWTPPSTWNNGIPGFLMDYNLFASTYRPQSGSSSNNLNAYGTTGLNAGAWRLRSDYQLSQSDSGDNREQSGAISRTYLFRPLPQIGSRLTLGETDFSSNIFDGFSYTGAALASDDRMLPWELRGYAPQISGIAQTNATVTISHSGRVIYQKKVPPGPFIIDDLNQSVQGTLDVKVSEEDGRVNNFQVSAASTPFLTRQGQVRYKLAAGRPRSSMSHHTEDETFISHEVSWGMLSNTSLYGGMLLAGDDYRSGALGIGQNMLWLGALSFDVTWADSHFDTQQDEQGYSYRFNYSKQVDATNSTISLAAYRFSDRHFHSYANYIDHKYNDADAQDEKQTISLSFGQPITPLNLNLYANILHQSWWNADTSTTANITVGFNVDIGDWKDISVSTSFNTTHYEDKDRDNQIYFSISLPIGESGRLGYDMQNNSNTTTHRMSWNDTLDERNSWGMSAGIQSDRPDNGAQVSGNYQHLSSAGEWDLTGTYAANDYTSASASWSGSFTATQHGVAFHRRSSTNEPRLMVSTDGVGDIPIQGNIDYTNRFGIAVVPFVSSYQPTTVAVNMNDLPDGVTVSENVVKETWTEGAIGFKSLASRAGKDLNVIISDANGHFPPLGADVRQAEGGVSVGMVGENGHAWLSGVDENQQFTVHWGDQKTCAIHLPEHLEDVTNRLILPCH

SEQ ID NO: 8526 - protein, 430 aa, Escherichia coli B185; identical to SEQ ID NO: 5758

SEQ ID NO: 8527 - protein, 203 aa, Escherichia coli B185; identical to SEQ ID NO: 6347

SEQ ID NO: 8528 - protein, 656 aa, Escherichia coli B185
MRLKKHYLCTALSLAFTQQAVAAQESDSLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGNHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTRSLASEYQWAAADNVDVVAGISYDWRDSVEAKKHEKDGSITHYDDNNQSAFNWQVMGKYHFVNEDTLALSYYDRTRFPTLKERYTTSKPAYNQIAIVNPQLKPERARGVDLTWNGAFTRDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTQYAYSEGFIEEGRNFWAGVEYTF

SEQ ID NO: 8529 - protein, 565 aa, Escherichia coli B185
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPTEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTIRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPVKQKEAEPTP

SEQ ID NO: 8530 - protein, 207 aa, Escherichia coli B185; identical to SEQ ID NO: 5743

SEQ ID NO: 8531 - protein, 332 aa, Escherichia coli B185
MMKKTVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGDEAGHE

SEQ ID NO: 8532 - protein, 760 aa, Escherichia coli B185
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGIAPSVAFGLGTANRLYLNYLHVTQHNTPDGGIPTIGLPGYSAPSAGTATLNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTSNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 8533 - protein, 203 aa, Escherichia coli B185; identical to SEQ ID NO: 6414

SEQ ID NO: 8534 - protein, 362 aa, Escherichia coli B185; identical to SEQ ID NO: 5754

SEQ ID NO: 8535 - protein, 224 aa, Escherichia coli B185; identical to SEQ ID NO: 7869

SEQ ID NO: 8536 - protein, 866 aa, Escherichia coli B185
MYRTHRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACALLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPINLLLPRSNDSYTSKKNYAWMTSNTSIDNEGHTTQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTTKQGIPLRFGAIATLDGVQANSGIIDDDGSLYMAGLPAKGTITVRWGEAPDQICHISYELTEQQINSAITRMDAICR

SEQ ID NO: 8537 - protein, 236 aa, Escherichia coli B185; identical to SEQ ID NO: 6409

SEQ ID NO: 8538 - protein, 551 aa, Escherichia coli B185; identical to SEQ ID NO: 5742

SEQ ID NO: 8539 - protein, 700 aa, Escherichia coli B185
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQSGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSSRDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYITPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVSSVIVNESNGRYYEPAPGRNYGVGVNIAWRFE

SEQ ID NO: 8540 - protein, 405 aa, Escherichia coli B185
MKIIITREYIMKRKVLAMLVPALLVAGAANAAEVYNKDGNKLDLYGKVAGLHYFSDDAGSDGDMSYARIGFKGETQIADQFTGYGQWEYNLQANGTEGDGDNSATRLAFAGLGFGQNGTFDYGRNYGVVYDIEAWTDMLPEFGGDTYAGADNFMNGRTNGVATYRNNGFFGQVDGLNFALQYQGNNEGSGDGFLFGQEGSGSGDGRKLSKENGDGYGMSTSYNFDFGLSFGAAYSNSDRTDEQTKPDFHNTRAGDRNDITAGGETAEAWTVGAKYDANNVYLAAMYAETRNMTGYGDANAIANKTQNFEVVAQYQFDFGLRPSIAYLQSKGKDLGGWAHDGNGDPRYTNKDLVKYVDIGATYYFNKNMSTYVDYKINLLDNDDDFYEANGIATDDIVAVGLVYQF

SEQ ID NO: 8541 - protein, 826 aa, Escherichia coli B185
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGAWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFLSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAASYRGAVVLVNFDTDQRKPWFIKALRADGQPLTFGYEVNDIHGHNIGVVGQGSQLFIRTNEVPPSVNVAIDKQQGLSCTITFGKEIDESRNYICQ

SEQ ID NO: 8542 - protein, 200 aa, Escherichia coli B185; identical to SEQ ID NO: 7474

SEQ ID NO: 8543 - protein, 274 aa, Escherichia coli B185
MNKTAIALLALLASSVSLAATPWQKITQPVPGSAQSIGSFSNGCIVGADTLPIQSEHYQVMRTDQRRYFGHPDLVMFIQRLSSQVSNLGMGTVLIGDMGMPAGGRFNGGHASHQTGLDVDIFLQLPKTRWTSAQLLRPQALDLVSRDGKHVVSTLWKPEIFSLIKLAAQDKDVTRIFVNPAIKQQLCLDAGTDRDWLRKVRPWFQHRAHMHVRLRCPADSLECEDQPLPPSGDGCGAELQSWFEPPKPGTTKPEKKTPPPLPPSCQALLDEHVI

SEQ ID NO: 8544 - protein, 250 aa, Escherichia coli B185
MTNLFCSARTAATTLALLITAASLSVQASVTPDRTRLIFNESDKSISVTLRNNDPKMPYLAQSWMEDEQGNKISSPLTVLPPVQRIDAMMNGQVKVQGMPDINKLPADRESVFYFNVREIPPKSNKPNTLQIALQTRIKLFWRPKALENVSMKKPWQHKVTLTRSGQEFTVNNPTPYFVVISNASAQKNGNPAAGFSPMVISPKTSVPLKVKMDSVPVLSYVNDYGARMPLYFKCGGDTCQVDVEQSRKG

SEQ ID NO: 8545 - protein, 883 aa, Escherichia coli B185
MDTCMPDHSLFRLRVLPCCVALAMSGSYVNAWAEDEIQFDSRFLELKGDTKIDLKRFSSQGYVEPGKYNLQVQLNKQPLTEEYDIYWYASENDASKTYACLTPELVAQFGLKEDVAKNLQWIHDGKCLKPSQLEGIDIKADLSQSALVISLPQAYLEYTDINWDPPSRWDDGISGLIADYSITAQTRHEENGGDDSNEISGNGTVGVNLGAWRLRADWQTDYLHSKSNDDDVINGDDTQKNWEWSRYYAWRALPSLKAKLGLGEDYLNSDIFDGFNYVGGSISTDDQMLPPNLRGYAPDISGVAHTTAKVTVSQLGRVIYETQVPAGPFRIQDLGDSVSGTLHIRIEEQNGQVQEYDINTASMPFLTRPGQVRYKLMMGRPQEWGHHVEGGFFSGGEASWGIANGWSLYGGALADEHYQSAALGVGRDLSVFGAVAFDVTHSHTRLDKETAYGKGSLDGNSFRVSYSKDFDELNSRVTFAGYRFSEENFMTMSEYLDASDSEMVRTGNDKEMYTATYNQNFRDAGVSVYLNYTRHTYWDRDEQTNYNIMLSHYFNLGSIRNMSISMTGYRYEYDNQSDKGVYISLSMPWGDSSTISYNGNYGSGSDSSQVGYFSRVDDATHYQLNVGTSDNHSSVDGYYSHDGSMAQVDVSANYHEGQYTSAGISLQGGATLTAQGGALHRTQNMGGTRLLIDADGVAGVPVEGNGAAVYTNMFGKAVVADVNNYYRNQAYIDLNNLPENAEATQSVVQATLTEGAIGYRKFSVISGQKAMAVLRLQDGSYPPFGAEVKNDNAQNVGLVDDDGNVYLAGVKPGEHMIVSWGGVAHCDIHLPDPLPADLFNGLLLPCQQTGAISPSMPHQIKPVIQEQTQQVMPTEAPVSVSAN

SEQ ID NO: 8546 - protein, 518 aa, Escherichia coli B185; identical to SEQ ID NO: 6358

SEQ ID NO: 8547 - protein, 366 aa, Escherichia coli B185
MKLKIVAVVVTGLLAANVAHAAEVYNKDGNKLDLYGKVTALRYFTDDKRDDGDKTYARLGFKGETQINDQMIGFGHWEYDFKGYNDEANGSRGNKTRLAYAGLKISEFGSLDYGRNYGVGYDIGSWTDMLPEFGGDTWSQKDVFMTYRTTGVATYRNYDFFGLIEGLNFAAQYQGKNERTDNSHLYGADYTRANGDGFGISSTYVYDGFGIGAVYTKSDRTNAQERAAANPLNASGKNAELWATGVKYDANNIYFAANYAETLNMTTYGDGYISNKAQSFEVVAQYQFDFGLRPSLAYLKSKGRDLGRYGDQDMIEYIDVGATYFFNKNMSTYVDYKINLIDESDFTRAVDIRTDNIVATGITYQF

SEQ ID NO: 8548 - protein, 883 aa, Escherichia coli B185
MTAFRAAFKAYRMHQVLLLPRFARLTIALSLATAVFPVDAEYYFNPRFLSNDLAESVDLSAFTKGREAPPGTYRVDIYLNDEFMTSRDITFITDDNNADLIPCLSTDLLVSLGIKKSALLDNKEHSAEKHVPDNSACTPLQDRLVDASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGFKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPRFIQGSLMHGLEENWTPYGGMQIAEDYQAFNLGIGKDLGLFGAFSFDITQANTTLADGTRHSGQSGKSVYSKSFYQTGTNIQVAGYRYSTQGFYNLSDSAYSRMSGYTVKPPTGDSNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGSMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 8549 - protein, 239 aa, Escherichia coli B185
MHQMQTTRTPYSISFMATVLLLLLFACHSTVANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGSSNLPNTMVPPKGEVSVDIPHAATGDISFQTINDYGALTPRIKATMQ

SEQ ID NO: 8550 - protein, 122 aa, Escherichia coli B185; identical to SEQ ID NO: 5737

SEQ ID NO: 8551 - protein, 224 aa, Escherichia coli B185
MKGLSSLLIFSMVLPAHAGIVIYGTRIIYPAENKEVMVQLMNQGNRSSLLQAWIDDGDTSLPPEKIQVPFMLTPPVAKIGANSGQQVKINIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKSNNANNWYLTIIDDHGNYISDKI

SEQ ID NO: 8552 - protein, 659 aa, Escherichia coli B185; identical to SEQ ID NO: 5736

SEQ ID NO: 8553 - protein, 828 aa, Escherichia coli B185; identical to SEQ ID NO: 5735

SEQ ID NO: 8554 - protein, 367 aa, Escherichia coli B185
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGTNGSVSGEDQTNNGRGALRQNGDGVGGSITYDYEGFGIGGAISSSKRTWDQNNTGLIGTGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLVYQF

SEQ ID NO: 8555 - protein, 432 aa, Escherichia coli B185; identical to SEQ ID NO: 5727

SEQ ID NO: 8556 - protein, 567 aa, Escherichia coli B185
MKIKLRITIILISVLCIFNGLLTPGAYAAAANGYVANKENLRSFFETVSSYAGKPTIVSKLAMKKQISGNFDLTEPYALIERLSAQMGLIWYDDGKAIYIYDSSEMRNALINLRKVSTNEFNNFLKKSGLYNSRYEIKGGGNGTFYVSGPPVYVDLVVNAAKLMEQNSDGIEIGRNKVGIIHLVNTFVNDRTYELRGEKIIIPGMAKVLSTLLNNNIKQSTGVNVLSEISSRQQLKNVSRMPPFPGAEEDDDLQVEKIISTAGAPETDDIQIIAYPDTNSLLVKGTVSQVDFIEKLVATLDIPKRHIELSLWIIDIDKTDLEQLGADWSGTIKIGSSLSASFNNSGSISTLDGTQFIATIQALAQKRRAAVVARPVVLTQENIPAIFDNNRTFYTKLVGERTAELDEVTYGTMISVLPRFAARNQIELLLNIEDGNEINSDKTNVDDLPQVGRTLISTIARVPQGKSLLIGGYTRDTNTYESRKIPILGSIPFIGKLFGYEGTNANNIVRVFLIEPREIDERMMNNANEAAVDARAITQQMAKNKEINDELLQKWIKTYLNREVVGG

SEQ ID NO: 8557 - protein, 360 aa, Escherichia coli B185; identical to SEQ ID NO: 6702

SEQ ID NO: 8558 - protein, 123 aa, Escherichia coli B185
MAEMTVLNNVMATSAKKRKPGLLSRCLSAVNKSTAKALVKYVAAPLALYLVAQGVAQADDLAAAGKQDVQDTFGQDSTMMYYFMIAEVFLVFMLYLRNHNPATFVLIPVFIVVTKVIFSMIGG

SEQ ID NO: 8559 - protein, 306 aa, Escherichia coli B185
MNSIPLSEFSGVRGSGHARLYIKASDSGPQTVVSEKLGSRILTRLGKLPLLRNTESVQKRRNAAAREDYYTRRTFKESLKQVYGDSFSQQAMQDIAGKPLTRRMVRQIIHNAEKVKAGGDKKEQKLSLSDKASEFTKISYDTSLNQLGLFAQKVKMITGSELKNIETLATGNGCLRSLMTAAHGVAQFSGNADITKAVETLLDIRVGNIPFSQFGTYTTTEGSSVQWIQNASQDDLEKAAEVIRRVAGDLELLFQNIKNGQNNKVSSTLSETIKPNNTGERGQTNVTTETARHWGRVVNEFRAIRR

SEQ ID NO: 8560 - protein, 569 aa, Escherichia coli B185
MSDPVIHGRLAYAGERLASLVSAASEHVQKDNRFLHAADKALKALLDTPLTVKKNDGTADNDPMFVPLRAPAVEIQETLNAEGRLTLLLGRLATLMGDNSVSQLASRLENRLAVIASQQQQREQLSGAFQTASEEAQSAMDVYKTALDSLTAAQAAYHDCAGKLERAEAKLDGLAPGAPDYVSLKQEIDTLRNELSSLRRNQEKALNAAEVAHNSARQKTEKLDGIASQIQGVFLTGGRAERHQTDNLNSIARFTMLLSIFIELVGKNNEESLKNDMALFRTLQESRQEEMLRKSEEYQEETRKAEVLNRTMGCVGKVVGALLTVASVVAAAFTGGAALGLAAASLALILTDGIVKAATGISFIQEALNPVIQHVLKPLMDIIGKAVAEILKGFGVDKASAEMVGNILGAILAAVTSVVVIVGVAILGKGAVSKLGHVLKKMMDEAVKKLLPDVLKHVMRNGNQILSHGIQRLAGVSGSRAVLLNKTVLGVSGAGATAAEGVFLKKASDAFADFTLSRFSSEQLRQWLKQAVDIFKDNNKMALELQKTLSSVIRQHSDTSRFVLRQIRA

SEQ ID NO: 8561 - protein, 566 aa, Escherichia coli B185
MKPSNIIVIFIILLFGISPFSIATGSETLFDNGYVARNDSLNSFFEAMSTKLNKTVVVSKSASRKKINGNFNFRDPEALLDRLASQLGVIWYSDGQTIYIYDAEEIRNSVISLQNISLSAFKSFLKEAGLYDSRYPLKGDEQNGIVYISGPPIFVSIVTKTAALIDKQNNDIEMGRLKIGVFRLHNTFVNDRTYQLRDQNIVIPGIATVIEKLLAGEQQNLTEVQGRMFRASGSNIASEALSGNSSTDNEMYIDEARDSTTSSSTPISDIKVISYPDTNSLLVKGTAEQVDFIGALVRLLDVAKRHVELSLWIIDLNKNDLEQLGVAWGGSTSFSNKLDIALNQTLVSTLDGVHFLASVYALEKKNQARIVSKPVLMTQENVPAIFDNNRTFYTKLIGERNSSLAHVTYGTMISVLPRFSADGEIEMSLNIEDGNEEKQSVSGNEDSVLPEVGRTHISTVARVPQGKSLLIGGYTRDSRTKDVQKIPLLGDIPLIGGLFRYENQNQNNVVRVFLIQPKEILDPLMPDADVFAAELMQDSGIENNRDPLDKWVLSYLNRGQALNHGK

SEQ ID NO: 8562 - protein, 263 aa, Escherichia coli B185
MSKRNAVTTFFTNRVTKALGMTLALMMTCQSAMASLAADQTRYIFRGDKDALTITVTNNDKERTFGGQAWVDNIVEKDTRPTFVVTPSFFKVKPNGQQTLRIIMASDHLPKDKESVYWLNLQDIPPALEGSGIAVALRTKLKLFYRPKALLEGRKGAEEGISLQSRPDGRTMLVNTTPYIFAIGSLLDGNGKKIATDNETAQKLLMFMPGDEVQVKGNVVKVDSLNDWGSLQTWTINQKKAAAPSGQKASDSPVNPSDKADKK

SEQ ID NO: 8563 - protein, 814 aa, Escherichia coli B185
MCAGKKAVAEPVSSVFFRRAALALAVSAAFASATGIAGEKLDMSFIQGGAGVNPEVWAALNGSYAPGRYLVDLSLNGKEAGKQILDVTPEDSKELCLSEAWLTKAGVYVSADYFREGYDATRQCYVLTKAPSVKVDFDVSTQSLALSIPQKGLVKMPENVDWDYGTSAFRVNYNANANTGRNNTSAFGSADLKANIGRWVVSSSATASGGDSGDNSTTINMFTATRAIRALSADLAVGKTSTGDSLLGSTGTYGVSLSRNNSMKPGNLGYTPVFSGIANGPSRVTLTQNGRLLHSEMVPAGPFSITDVPLYTSGDVTMRITGEDGREQVQNFPLSVMAGQLSPGQHEFSVAAGLPDDDSDLKGGVFAASYGYGLDGLTLRTGGVFNQDWQGVSAGAVLGLSYLGAVSADGAYATAKYRDGSRSGNKVQLSWSKQLEMTNTGLRVSWSRQSEEYEDMSSFDPTELWSQSNHGRRTKDEWNAGVSQPVGGLFSLSVSGWQRSYYPASTTGSYRYSDDNGKDTGITGTLSTQIKGVSLNLGWSGSRNTRGENNWSASASVSVPFTLFDRRYSSSTSVSTSKDGGTGFSTGVSGSLNDRFSYGLGGGRDSSGGVSSYLNASYSGDRAYLNGALNHSQSGGTSGSVSVSGSVLAVPAAKDIMFSRTTGDTVAVVNVKDTPGVKVTSGDGQTNSDGNLVVPLNSYDWNTVTIDAGTLPLSTELTNTSQKVVPTDKAVVWMPFDALKVKRYLLQVKQRDGEFVPGGTWARDSKNTPLGFVANNGVLMINTVDAPGDITLGQCRIPAVKLQDTEKLQEITCE

SEQ ID NO: 8564 - protein, 686 aa, Escherichia coli B185
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGANNSNPFNTVERKKVGIMLKVTPQINEGNAVQMVIEQEVSKVEGQTSLDVVFGERKLKTTVLANDGELIVLGGLMDDQAGESVAKVPLLGDIPLIGHLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 8565 - protein, 713 aa, Escherichia coli B185
MAKFTPSFSRIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHSTRADLQGNVDIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 8566 - protein, 231 aa, Escherichia coli B185
MSKRTFAVIITLLCSFCIGQALAGGIVLQRTRVIYDASRKEAALPVANKGAETPYLLQSWVDNIDGTSRAPFIITPPLFRLEAGDDSSLRIIKTADNLPENKESLFYINVRAIPAKKKSDDVNANELTLVFKTRIKMFYRPAHLKGLVNDAWKSLEFKRSDHSLNIYNPTEYYVVFAGLAVDKADLTSKIEYIAPGEHKQLPLPASGGKNVKWAAINDYGGSSGTETRPLQ

SEQ ID NO: 8567 - protein, 863 aa, Escherichia coli B185
MIMAAVPGQKLVHCNNKYKNTGHQGMPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 8568 - protein, 678 aa, Escherichia coli B185
MVPSTFSRLKAARCLPVVLAALIFVGCGTHTPDQSTAYMQGTAQADSAFYLQQMQQSSDDTRINWQLLAIRALVKEGKTGQAVELFNQLPQELNDSQRREKTLLAVEIKLAQKDFAGAQNLLAKITPADLEQNQQARYWQAKIDASQGRPSIDLLRALIAQEPLLGAKEKQQNIDAIWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGTPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 8569 - protein, 412 aa, Escherichia coli B185
MKQWIAALLLMLIPSVQAAKPQKVTLMVDDVPVAQVLQALAEQEKLNLVVSPDVSGTVSLHLTDVPWKQALQTVVKSAGLITRQEGNILSVHSIAWQNDNIARQEAEQARAQANLPLENRNITLQYADAGELAKAGEKLLSAKGSMTVDKRTNRLLLRDNKTALSALEKWVAQMDLPVGQVELSAHIVTINEKSLRELGVKWTLADAQQAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 8570 - protein, 660 aa, Escherichia coli B185
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLIDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASESSNPMVDRSTIQRDAQLSYKLAPQGNDWLNADAKIYWSEVRINAQNTGSSGEYREQITKGARLENRSTLFADSFASHLLTYGGEYYRQEQHPGGVTTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 8571 - protein, 857 aa, Escherichia coli B185
MSRKTVSRTFSSFSISVVAVAVASTFSAHAGKFNPKFLEDVQGVGQHVDLTMFEKGQEQQLPGIYRVSVYVNEQRMETRTLEFKEATEAQRKAMGESLVPCLSRTQLAEMGVRVESFPTLNQVPAEACVPFDEIIPQASSHFDFSEQKLVLSFPQAAMHQVARGTVPESLWDEGIPALLLDYSFSGSNSEYDSSGSSSSYVDDNGTVHHDDGKDTLKSDSYYLNLRSGLNLGAWRLRNYSTWSHSGGKAQWDNIGTSLSRAIIPFKAQLTMGDTATAGDIFDSVQMRGAMLASDEEMLPDSQRGFAPIVRGIAKSNAEVSIEQNGYVIYRTYVQPGAFEINDLYPTANSGDLTVIIKEADGSEQRFIQPFSSVPIFQREGHLKYSFAAGEYQAGNYDSASPRFGQLDLIYGLPWGMTAYGGVLISNNYNAFALGIGKNFGYIGAISIDVTQAKSELNNDRDSQGQSYRFLYSKSFESGTDFRLAGYRYSTSGFYTFQEATDVRSDADSDYNRYHKRSEIQGNLTQQLGAYGSVYLNLTQQDYWNDAGKQNTVSAGYNGRIGKVSYSIAYSWNKSPEWDESDRLWSFNISVPLGRAWSNYRVMTDQDGRTNQQVGVSGTLLEDRNLSYSVQEGYASNGVGNSGNANVGYQGGSGNVNVGYSYGKDYRQLNYSVRGGVIVHSEGVTLSQPLGETMTLISVPGARNARVVNNGGVQVDWMGNAVVPYATPYRENEVSLRSDSLGDDVDVENAFQKVVPTRGAIVRARFDTRVGYRVLMTLLRSAGSPVPFGATATLITDKQNDVSSIVGEEGQLYISGMPEEGQVLIKWGNDASQQCVAPYKLSLELKQGGIIPVSANCQ

SEQ ID NO: 8572 - protein, 229 aa, Escherichia coli B185
MMKSKFVALALSLFLSQSVLAGGVGLSSTRVIYDGSKKEASLTVQNKSKTEEFLIQSWVDDAAGSKKTPFIITPPLFKLDPEKNNILRIVNITPGLPQDRESVYWVNVKAIPSKSDDSENKNVLQIAVRTRIKLFYRPAGLKGDVKTAPNELRFTRNGNQLRVDNPTVFNITFNQFFANDKEIEKAGMVPAKGALNITLPAGVGSVSKIKYNAINDFGSSAEMITKNVD

SEQ ID NO: 8573 - protein, 209 aa, Escherichia coli B185
MAMAGIVVGGTRVIFYGDKPDTTISIFNKETNLPYLLQTWVDPFNKEDKSKPPFSVIPPVSRIEPQQEKILRILKTAGELPKDRESVFWLNVKNIPPSIDKKNTNVLEIAIKTRIKLFWRPAAVKIIPEQAIKNVKWSRQGNNLIVENPNPIHINVMSVTVDDKDVSLNMIHPFETLTLPIPAGVAGKSLVWRFINDYGAISQPLKKNL

SEQ ID NO: 8574 - protein, 208 aa, Escherichia coli B185; identical to SEQ ID NO: 5717

SEQ ID NO: 8575 - protein, 614 aa, Escherichia coli B185
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLVDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTYHLTVRGKIANLFDKDYETVYGYQTAGREYTLSGSYTF

SEQ ID NO: 8576 - protein, 446 aa, Escherichia coli B185
MMITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEVNPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYTGNANTNTNFGKAVPADFNGGSFGRGDSDEWTFGAQMEIWW

SEQ ID NO: 8577 - protein, 237 aa, Escherichia coli B185; identical to SEQ ID NO: 6384

SEQ ID NO: 8578 - protein, 478 aa, Escherichia coli B185
MTRIKINARRIFSLLIPFFFFTSVHAEQTAAPAKPVTVEAKNETFAPQHPDQYLSWKATSEQSERVDALEEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 8579 - protein, 368 aa, Escherichia coli B185
MNKTITALAIMMASFATNASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAVDKINAYYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 8580 - protein, 241 aa, Escherichia coli B185; identical to SEQ ID NO: 6143

SEQ ID NO: 8581 - protein, 878 aa, Escherichia coli B185
MSYLNLRLYQRNTQCLHIRKHRLAGFFVRLVVACAFAAQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 8582 - protein, 816 aa, Escherichia coli B185
MLRTTRWVAAIIFLYSFPGYAEETFDTHFMIGGMRGEKVSEYRFDNKQPLPGNYELDFYVNHQWRGKKDITIPESPAKPCLPKVLLTTLGVKTDNLNTEDNCILLDEAVHGGQYQWDISEHRLNLTVPQAYINELERGYVPPESWDRGIDAFYTSYNLSQYRSYDSNNNSHTASYGRFNSGLNLFSWQLHSDASYSKPDDMKGKWQSNTLYLERGWSQILSTVQIGENYTSSLIFDSLRFSGIRLFRDMQMLPDSMQSFTPLVQGVAQSNALITVSQNGYTIYQKEVPPGPFTIADLQLSGSGSDLDVSIKEADGSVRSFLVPYSSVPNMLQPGVSNFDFIAGRSQIYGVKNQEDFLEANYIYGLNNLLTLYGGTILSDNYNAITLGNGWNTPLGAISFDATRSSSKLNNDTRHEGTSYQVAYNKYLLQTATHFSVAAWRYASQDYRTFSDHLYENDKINHQSDYDDFYDIGRKNSLSANIMQPLSNNLGNVSLSALWRNYWGRSGNAKDYQFSYSNNWQHISYTFSASQSYDENDKEEERFNLFISIPFYWGDDIAKTRHQINLSNSTSFSKDGYSSNNTGITGIAGEHDQLNYGIYVNQQQQNNDTSLGTNLSWRTPIATIDGSYSHSKNAWQSGGSISSGLVVWPGGINITNQLSDTFAILDAPGLEGAHINGQKYNRTNSKGQVVYDLMIPHRENHLVLDTANSESETELQGNRQIIAPYRGAVSYVQFTTDQRKPWYIQALRPDGSPLTFGYDVLDLQENNIGVVGQGSLLFIRVDEIPTGIKVALNDEQNLFCTITFQHVIDENKTYICQ

SEQ ID NO: 8583 - protein, 227 aa, Escherichia coli B185
MRIITALLMSFFILPVHAGVVIYGTRIIYPEKNREVLVQLMNQSKNTSLIQAWIDDGNTTIAPEKIQVPFILTPPVSRVAGGSGQQLKIRKMPNNLPHNKESLFYLNVLDIPPNNPQNAGKNKIKLALQNRIKLLWRPSGIAPVDKKSLSQLNIKKKNNAISINNETANWITVTTIKAQNVKVNNESILLPPFSNNDITLKNNHASEYELTVVDDYGNNIHSKIAAR

SEQ ID NO: 8584 - protein, 784 aa, Escherichia coli B185; identical to SEQ ID NO: 6283

SEQ ID NO: 8585 - protein, 241 aa, Escherichia coli B185
MFPLVKKTVSALFVSTLLSSAPAFADIIISGTRIIYNADKKDVNVRLENKGNRPLLIQNWLDTGDDNADPSQIKVPFTATPPVSRVEPKRGQTVKVMYTGATALPKDRESVYWFNVLEVPPKPKDAEADKNLLQLAFRTRIKLFYRPSGLQGEPAEAPAKITWKLNNAQLQANNPTPYYVSFNEVKLESGGKTYNVNSSMVAPFSQASFGVTGLPGSVSSGKVVFKAINDFGGNIDGSATF

SEQ ID NO: 8586 - protein, 747 aa, Escherichia coli B185; identical to SEQ ID NO: 5775

SEQ ID NO: 8587 - protein, 275 aa, Escherichia coli B185
MSHWCRNWHMAKSLFRALVALSFLAPLWLNAAPRVITLSPANTELAFAAGITPVGVSSYSDYPPQAQKIEQVSTWQGMNLERIVALKPDLVIAWRGGNAERLVDQLASLGIKVMWVDATSIEQIANALRQLAPWSPQPDKAEQAAQSLLDQYAQLKAQYADKPKKRVFLQFGINPPFTSGKESIQNQVLEVCGGENIFKDSRVPWPQVSREQVLARSPQAIVITGGPDQIPKIKQYWGEQLKIPVIPLTSDWFERASPRIILAAQQLCNALSQVD

SEQ ID NO: 8588 - protein, 161 aa, Escherichia coli B185; identical to SEQ ID NO: 5769

SEQ ID NO: 8589 - protein, 446 aa, Escherichia coli B354; identical to SEQ ID NO: 7485

SEQ ID NO: 8590 - protein, 237 aa, Escherichia coli B354; identical to SEQ ID NO: 6384

SEQ ID NO: 8591 - protein, 478 aa, Escherichia coli B354; identical to SEQ ID NO: 5711

SEQ ID NO: 8592 - protein, 368 aa, Escherichia coli B354
MNKTITALAIMMASFAANASVLPETPVPFKSGTGAIDNDTVYIGLGSAGTAWYKLDTQAKDKRWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGMSNDSLIFVGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 8593 - protein, 784 aa, Escherichia coli B354; identical to SEQ ID NO: 6283

SEQ ID NO: 8594 - protein, 866 aa, Escherichia coli B354
MKTTTSTKRHNLTRIAMYCSIMYSGATIGAESVEYDPTFLMGGNASSIDVSRYSDGNPTLPGVYDVSIYVNEQPVANLEIPFIAIPDKKNAQACITLKNLLQLHIKTPPADEENTILLPRDETLGNCLDLSLAIPKSSVSYDPSEQRLDINVPQAWVMKNYQNYVDPSLWENGINAATLSYNINAYRSENSNYTNDSVYTSFNGGVNLGAWRLRSSGNYSWRNDAGSNVEFMNRYVQRDITAIRSQLIMGESYTTGETFDSVSIRGIRLYSDSRMLPPVLANFAPTIRGVANTNAKVSITQSGYKIYETTVPPGPFVIDDLSPSGYGSDLIVTIEEADGSKRTFSQPFSSVIQMLRPGVSRWDISGGQINKDDLHHEPNLLQATYYRGLSNLFTGYTGFQVTDNHYAAGLLGIGMNTSVGAISFDVTHSSVDIPDDKRYQGQSYRISWNKFFDLTDTSLNIAAYRYSTQDYLGLNDALTLIDEVEHPTQDLDPKTMRNYGRMKNQFTVSINQPLRFGKDDYGSFYTSGSWSDYWGGGKSRSNYSVGYSNSASWGSYSISAQRSWDEYSQTENSIYLSFSIPIEKLMGTEHRDSGFQSIDTQLSTNMDGNNQFNMSSSGYSNDNRVSYSVNAGYGMNKTGKDLSNIGGYASYESPWGTLAGSASATSDNNRQYSVNTDGGFVLHSGGLTFSNDSFSDNDTIALVKAPGAKGARINYGNNTVDRWGYGVTSALSPYQENKIALDTENLENDIEMKSTSTVAVPRQGSVIFAGFETNQGQSAIMNIKRSDGKGIPFAADIHDETNAIIGNVGQGGQAFVRGIQQQGTIKITWLEASMPKTCIAQYQQPNVTSEKIQQTIILNNILCQLQ

SEQ ID NO: 8595 - protein, 243 aa, Escherichia coli B354
MLNKKNIVALCVASSMAFSMPVMADIVISGTRVIYKSDQKSVSVRLENKGNSHLLVQSWLDTGDDNAEPGSINVPFTATPPVSRIDAKRGQTIKLMYTGSTVLPSDKESVFWFNVLEVPPKPDASKVENQSLLQLAFRTRIKLFYRPAGLNGNPSEAPLALKWKWAEGKSGLSVYNPTPYYVSFNNAELIAGGKSNPLNVKMVAPKSEEIFTISGSGGKATSGKVHFSAINDFGGAIEGDVNL

SEQ ID NO: 8596 - protein, 747 aa, Escherichia coli B354
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLIGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSQFATGDIDHTLLTGVDFMRMRNDINAWFGYDDSVPLLDLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 8597 - protein, 275 aa, Escherichia coli B354
MSHWCRNWHMAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLLDQYAQLKAQYADKPKKRVFLQFGINPPFTSGKESIQNQVLEVCGGENIFKDSRVPWPQVSREQVLARSPQAIVITGGPDQIPKIKQYWGEQLKIPVIPLTSDWFERASPRIILAAQQLCNALSQVD

SEQ ID NO: 8598 - protein, 241 aa, Escherichia coli B354; identical to SEQ ID NO: 6143

SEQ ID NO: 8599 - protein, 875 aa, Escherichia coli B354
MNLRLYQRNTQCLHIRKHRLAGLFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTVGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 8600 - protein, 816 aa, Escherichia coli B354
MLRTTRWVAAIIFLYSFPGYAEETFDTHFMIGGMRGEKVSEYRFDNKQPLPGNYELDFYVNHQWRGKKDITIPESPAKPCLPKVLLTTLGVKTDNLNTEDNCILLDEAVHGGQYQWDISEHRLNLTVPQAYINELERGYVPPESWDRGIDAFYTSYNLSQYRSYDSNNNSNTASYGRFNSGLNLFSWQLHSDASYSKPDDMKGKWQSNTLYLERGWSQILSTVQIGENHTSSLIFDSLRFSGIRLFRDMQMLPDSMQSFTPLVQGVAQSNALITVSQNGYTIYQKEVPPGPFTIADLQLSGSGSDLDVSIKEADGSVRSFLVPYSSVPNMLQPGVSNFDFIAGRSQIYGVKNQEDFLEANYIYGLNNLLTLYGGTILSDNYNAITLGNGWNTPLGAISFDATRSSSKLNNDTRHEGTSYQVAYNKYLLQTATHFSVAAWRYASQDYRTFSDHLYENDKINHQSDYDDFYDIGRKNSLSANIMQPLSNNLGNVSLSALWRNYWGRSGNAKDYQFSYSNSWQRISYTFSASQSYDENDKVEERFNLFISIPFYWGDDIAKTRHQINLSNSTSFSKDGYSSNNTGITGIAGEHDQLNYGIYVNQQQQNNDTSLSTNLSWRTPIATIDGSYSHSKNAWQSGGSISSGLVVWPGGINITNQLSDTFAILDAPGLEGAHINGQKYNRTNSKGQVVYDLIIPHRENHLVLDIANSESETELQGNRQIIAPYRGAVSYVQFTTDQRKPWYIQALRPDGSPLTFGYDVLDLQENNIGVVGQGSRLFIRVDEIPTGIKVALNDEQNLFCTITFQHVIDENKTYICQ

SEQ ID NO: 8601 - protein, 227 aa, Escherichia coli B354; identical to SEQ ID NO: 8084

SEQ ID NO: 8602 - protein, 161 aa, Escherichia coli B354; identical to SEQ ID NO: 5769

SEQ ID NO: 8603 - protein, 221 aa, Escherichia coli B354
MKNYLWLVALFPLLSGCESQAILVKKDDAYFAPPTTEAPPPADGRAGGVFETGYNWSLTADRRAYRVGDILTVILEESTQSSKQAKTNFGKSNTVDIGAPTIFGHTKDKLSGSIDANRDFDGSATSQQQNSLRGEITVSVHAVQPNGILEIRGEKWLTLNQGDEYIRLSGLVRADDIQNDNSVSSQRIADARISYAGRGALSDANAAGWLTRLFNHPLFPI

SEQ ID NO: 8604 - protein, 351 aa, Escherichia coli B354; identical to SEQ ID NO: 5767

SEQ ID NO: 8605 - protein, 230 aa, Escherichia coli B354; identical to SEQ ID NO: 6360

SEQ ID NO: 8606 - protein, 869 aa, Escherichia coli B354
MKIPTTTDIPQRYTWCLAGICYSSLAILPSFLSYAESYFNPAFLLENGTSVADLSRFERGNHQPAGVYRVDLWRNDEFIGSQDIVFESTTVNTGDKSGGLMPCFNQALLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 8607 - protein, 746 aa, Escherichia coli B354
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 8608 - protein, 193 aa, Escherichia coli B354; identical to SEQ ID NO: 6300

SEQ ID NO: 8609 - protein, 243 aa, Escherichia coli B354
MTFMKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPAPEKNSDHAVLQVAIQSRIKVFWRPSALRKKAGEKVELQLQVSQQGNQLNLKNPTGYYLTIAYLGRNEQGILPGFKTVMVAPFSTVITNTGSYSGSQFYLGYMDDYGALRMTTLNCNGHCRLQAVEAKK

SEQ ID NO: 8610 - protein, 816 aa, Escherichia coli B354
MNIYRLSFISCLVMAIPSALAVEFNLNVLDKSMRDRIDISLLKEKGVIAPGEYFVSVAVNNNQISNGQKIDWKKNGDQTIPCINDLLVDKFGLKPEVRQSLPRLNQCVDFSSRPEILFIFDQASQQLNITIPQAWLAWHSDNWTPPSTWKEGVAGVLMDYNLFASSYRPQDGSNSTNLNAYGTAGINAGAWRLRSDYQLNQTDSDDNHEQSGEISRTYLFRPLPQLGSKLTLGETDFSSNIFDGFSYTGAALASDDRMLPWELRGYAPQISGIAQTNATVTVSHSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLISGDDYHSAAMGIGQNMLWLGALSFDVTWASSQFDTQQDERGLSYRFNYSKQVDATNSTISLAAYRFSDRHFHSYANYLDHKYNDNDAQDEKQTISLSVGQPITPLNLNLYANLLHQTWWNADASTTANITAGFNVDIGNWRDISISTSFNTTHYEDKDRDNQIYLSISLPFGNGGRVGYDMQNSSQSTTHRMSWNDTLDERNSWGMSTGLQSDRPDNGAQVSGNYQHLSSAGEWDISGTYAANDYSSVSSSWSGSFTATQYGAAFHRRSTTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDNSGISVGMVGEEGHAWLSGVAENQMLTVVWGDSQHCSLHLPEHMEDTANRLILPCH

SEQ ID NO: 8611 - protein, 430 aa, Escherichia coli B354; identical to SEQ ID NO: 5758

SEQ ID NO: 8612 - protein, 331 aa, Escherichia coli B354; identical to SEQ ID NO: 6551

SEQ ID NO: 8613 - protein, 760 aa, Escherichia coli B354
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQAIGDTTAVRLNVMGEKTHDAGRDKIKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDNSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADTKLGYRVNRNLDFQLNVYNLFDTDYVASINKSGYRYHPGEPRTFLLTANMHF

SEQ ID NO: 8614 - protein, 203 aa, Escherichia coli B354; identical to SEQ ID NO: 8073

SEQ ID NO: 8615 - protein, 362 aa, Escherichia coli B354; identical to SEQ ID NO: 5813

SEQ ID NO: 8616 - protein, 224 aa, Escherichia coli B354
MTVSLTAILLSCSFTWAAGKGGVGLAATRLVYSEGEEQISLGVRNTSPDVPYLIQSWVMTPDNKKSADFIITPPLFVLNPANENLLRIMYIGAPLAKDRETFFFTSVRAVPSTTKREEGNTLKIATQSVIKLFWRPKGLAYPLGEAPAKLRCTSSADMVTVSNPTPYFITLTDLKIGGKVVKNQMISPFDKYQFPLPKGAQNSSVTYRTINDYGAETPQLNCKS

SEQ ID NO: 8617 - protein, 866 aa, Escherichia coli B354
MPRTHRQHSLLTSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNIDAFPAFKQLDKQACAPLAEIIPDASVTFDVNKLRLEISVPQIAIKSNARGYVPPERWDEGINALLLGYSFSGANSIHSSSDSDSTDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSINSYSVPFSSVPLLQRQGRIKYAVTLAKYRTNSNDQQESKFAQATLQWGGPWGTTWYGGGQYAEYYRAAMLGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGDYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHTTQNLGLTETLLDDGNLSYSVQQGYNSEGKTANGSASMDYKGEFADARVGYNYSDSGSQQQLNYALSGSLVAHSRGITLGQSLGETNVLIAAPGAENTRVANSTGLKTDWRGYTVVPYATSYRENRIVLDAASLKRNVDLENAVVNVVPTKGALVLAEFNAHAGARVLMKTSKQGIPLRFGAIATLDGVQTNSGIIDDDGSLYMSGLPAQGAITVRWGEAPDQICHISYDLTEQQINAAITRMDAICR

SEQ ID NO: 8618 - protein, 236 aa, Escherichia coli B354
MTNTWNRLTLAIFAVLSLLVVGKLQAGVVVGGMRFIFPADRESISISLTNTSQESWLINSKINRPTRWAGGEASTGSAPLLVAPPLVLLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNAGVVPPKSQRQTSWCQAIAPCHVSWRTINDYGGLSAKKEQNLL

SEQ ID NO: 8619 - protein, 517 aa, Escherichia coli B354; identical to SEQ ID NO: 6817

SEQ ID NO: 8620 - protein, 191 aa, Escherichia coli B354; identical to SEQ ID NO: 8071

SEQ ID NO: 8621 - protein, 232 aa, Escherichia coli B354
MQKNAAHTYAISSLLVLSLTSCAWIPSTPLVQGATSAQPVPGPTPVANGSIFQSAQPINYGYQPLFEDRRPRNIGDTLTIVLQENVSASKSSSANASRDGKTNFGFDTVPRYLQGLFGNARADVEASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 8622 - protein, 729 aa, Escherichia coli B354
MLSTQFNRDNQHQTTSKPSLLAACIALALLPSAAFAAPATEETVIVEGSATTPVDDENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 8623 - protein, 213 aa, Escherichia coli B354; identical to SEQ ID NO: 5744

SEQ ID NO: 8624 - protein, 203 aa, Escherichia coli B354; identical to SEQ ID NO: 6347

SEQ ID NO: 8625 - protein, 656 aa, Escherichia coli B354
MRLKKRYLCTALSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEANLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 8626 - protein, 565 aa, Escherichia coli B354
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTESTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWLEDIATAKSNPNRPATEIYRDLRSAAASGWDFSSRWMDDPQQLNTLRTTSIVPVDLNSLMFKMEKILARASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPVKQKEAEPTP

SEQ ID NO: 8627 - protein, 205 aa, Escherichia coli B354
MPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTADDAEEMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 8628 - protein, 366 aa, Escherichia coli B354; identical to SEQ ID NO: 7946

SEQ ID NO: 8629 - protein, 871 aa, Escherichia coli B354
MHQVLLLPRFARLTIALSLATAVFPVDAEYYFNPRFLSNDLAESVDLSAFTKGREAPPGTYRVDIYLNDEFMTSRDITFIADDNNADLIPCLSTDLLVSLGIKKSALLDNKENSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDIYQTTVPPGPFNIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSIKSVYSKSFYQTGTNIQVAGYRYSTQGFYNLSDSAYSRMSGYTVKPPTGDSNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSATSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 8630 - protein, 236 aa, Escherichia coli B354; identical to SEQ ID NO: 7814

SEQ ID NO: 8631 - protein, 111 aa, Escherichia coli B354
MKKQIEGMTMKKVLALVVAAAMGLSSAAFAAETATTPAPTATTTKAAPAKTTHHKKQHKAAPAQKAQAAKKHHKNAKTEQKAPEQKAQAAKKHAKKHSHQQPAKPAAQPAA

SEQ ID NO: 8632 - protein, 122 aa, Escherichia coli B354; identical to SEQ ID NO: 5737

SEQ ID NO: 8633 - protein, 551 aa, Escherichia coli B354
MDRRRFIKGSMAMAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNVVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 8634 - protein, 704 aa, Escherichia coli B354
MAFFMKIFSVRQTVLPALLVLSPVVFAADEQTMIVSATPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVITQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSSRDDMSMMMYAGERETTQYQPIPMLPQLNPSHAGGVITLQRHYQGIDSRWTHRGELGVPVTFTTGLNYENMSENRKGYNNFRLNSGVPEYGQKGELRRDERNLMWNVDPYLQTQWQLSEKLSLDAGVRYSSVWFDSNDHYVTPGNGDDSGDVSYHKWLPAGSLKYAMTDAWNIYLAAGRGFETPTINELSYLADGQSGMNFGLKPSTNDTIEIGSKTRIGYGLLSLALFQTDTDDEIVVDSSSGGRTTYKNAGKTRRQGAELAWDQRFAEDFRVKASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPAPGRNYGVGMNIAWRFE

SEQ ID NO: 8635 - protein, 397 aa, Escherichia coli B354
MKRKVLAMLVPALLVAGAANAAEVYNKDGNKLDLYGKVAGLHYFSDDAGSDGDMSYARIGFKGETQIADQFTGYGQWEFNIGANGPESDKGNTATRLAFAGLGFGQNGTFDYGRNYGVVYDIEAWTDMLPEFGGDTYAGADNFLNGRANGVATYRNNGFFGQVDGLNFALQYQGNNEGSGGLWDQEGSGNGNNRKLSKENGDGFGMSTSYDFDFGLSLGAAYSNSDRTDNQRATGLGEQRSNKYAGGETAEAWTVGAKYDANNVYLAAMYAETRNMTAYGSGKDNNDIDRGGIANKTQNFEVVAQYQFDFGLRPSIAYLQSKGKDLGGWAHDGNGDPRYTNKDLVKYVDIGATYYFNKNMSTYVDYKINLLDNDDDFYKANGIATDDIVAVGLVYQF

SEQ ID NO: 8636 - protein, 826 aa, Escherichia coli B354
MLRMTPLASAIVALLLGIEAYAAEETFDTHFMIGGMKDQQVANIRLDDNQPLPGQYDIDIYVNKQWRGKYEIIVKDNPQETCLSREVIKRLGINTDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGTWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVTTPRRQIYMSNSTAFDDQGFASNNTGLSGTVGNRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTEQRKPWFIKALRTDGQPLTFGYEVNDIHGHNIGVVGQGSQLFIRTNEVPPSVNVAIDKQQGLSCTITFGKEIDESRNYICQ

SEQ ID NO: 8637 - protein, 224 aa, Escherichia coli B354
MKGLLALLISSMVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKVTFKKLLVNRSGNGLVIKNDSANWVTISDVKANNVKVNYETIMIAPLESQSINVKSNNANNWHLTIIDDHGNYISDKI

SEQ ID NO: 8638 - protein, 650 aa, Escherichia coli B354
MSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRVYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 8639 - protein, 828 aa, Escherichia coli B354; identical to SEQ ID NO: 6558

SEQ ID NO: 8640 - protein, 169 aa, Escherichia coli B354
MKKESKKMKTILPAVLFAAFATTSAWAAESVQPLEKIAPYPQAEKGMKRQVIQLTPQEDESTLKVELLIGQTLEVDCNLHRLGGKLESKTLEGWGYDYYVFDKVSSPVSTMMACPDGKKEKKFVTAYLGDAGMLRYNSKLPIVVYTPDNVDVKYRIWKAEEKIDNAVVR

SEQ ID NO: 8641 - protein, 368 aa, Escherichia coli B354; identical to SEQ ID NO: 7779

SEQ ID NO: 8642 - protein, 192 aa, Escherichia coli B354
MKSKKYFIILLALTAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRLLQCGNEIYSAIKDLQSKAPDKNIVIFTHNHCLTYIAKDKRDATFKPDYLDGLVMHVEKGKVYLDGEFVNH

SEQ ID NO: 8643 - protein, 274 aa, Escherichia coli B354
MNKTAIALLALLASSASLAATPWQKITQPVPGSAQSIGSFSNGCIVGADTLPIQSEHYQVMRTDQRRYFGHPDLVMFIQRLSSQVSNLGLGTVLIGDMGMPAGGRFNGGHASHQTGLDVDIFLQLPKTRWTSAQLLRPQALDLVSRDGKHVVPTLWKPEIFSLIKLAAQDKDVTRIFVNPAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 8644 - protein, 249 aa, Escherichia coli B354
MTKHLSAKTLTAVLSLLAATVSYSTQASVTPDRTRLIFNESDKSISVTLRNNDPKLPYLAQSWIEDEKGVKISSPLAVLPPVQRIDAMMNGQVKIQGLPDIHKLPADRESMFYFNVREIPPKSNKSNTLQIALQTRIKLFWRPKALEKNTTQNPWQHKVTLTRNGQEFTVNNPTPYYVIFSNASAQKNGNPAAGFSPIVMSPKTSAPLNVKMGSVPVLTYVNDYGARMPLFFTCNGNSCQVDEEQSRKG

SEQ ID NO: 8645 - protein, 883 aa, Escherichia coli B354
MDTPMPEHSFLRLRGLSWWIALAISGSPFNALADDTIQFDGRFLDLKGNTKIDLGRFSQKGYVEPGKYNLRVHVNNQPLPDDYDIYWYATENDPNKSYACLSPELVAQFGLKEDIAKNLQWIRDGQCLNTALLAGTEISGDLGQSALLVSVPQAYLEYTDSEWDPPSRWDDGIPGLIADYSINAQTRHENGGDDTNDISGNGTVGVNVGPWRLRADWQSDYQHTRSNDDGDTDDSGTQKNWEWSRYYAWRALPSLKAKLSLGEDYLNSDIFDGFSYIGGSISTDDQMLPPNLRGYAPDISGVAHTTAKVTVTQMGRVIYETQVPAGPFRIQDIGDSVSGTLHVRIEEQNGQVQEYDVSTASMPFLTRPGQVRYKVTMGRPQNWDHQVAGSFFSGGEASWGIANGWSLYGGALADENYQSAALGLGRDLALLGALAFDVTHSRVQLDDNSVYGNKTLDGNSYRVSYAKDFDELNSRVTFAGYRFSEKNYMTMSEYLDANDDDRARTGNDKEMYTVTYNQNFTDARVSVYLNYSHHTYWDRQDQTNYNMMLSHYFNLGSLRNLSVSLTGYRYEYDKSADKGVYLSLSLPWGDNSTISYNGNYGSGADSNQVSLYHRIDDASHYTLSAGTSENHSSVDGYYSHDGTLAKVDLSANYHEGQYTSAGISLQGGATLTAHGGALHRTQNMGGTRLLIDADGVANVPVEGNGSAVYTNMFGKAVVADVNDYYRNQAYIDLNKLPENAEATKSVVQATLTEGAIGYRKFAVISGEKAMAVLRLQDGSHPPFGAEVKNDNQQQVGLVDDEGNVYLAGVKPGEHMTVFWEGESHCDISLPDPLPNDLFNGLLLPCQQKGGSSPVIPHDIQPVIQEQTQQVTPMEPPMSVSSNQ

SEQ ID NO: 8646 - protein, 518 aa, Escherichia coli B354; identical to SEQ ID NO: 6358

SEQ ID NO: 8647 - protein, 432 aa, Escherichia coli B354; identical to SEQ ID NO: 5727

SEQ ID NO: 8648 - protein, 567 aa, Escherichia coli B354; identical to SEQ ID NO: 6075

SEQ ID NO: 8649 - protein, 678 aa, Escherichia coli B354
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAAEIKLAQKDFAGAQNLLAKITPADLEQNQQARYWQVKIDASQGRPSIDLLRALIAQEPLLGAKEKQQNIDATWQALSSMTQEQANTLVINADENILQGWLDLQRIWFDNRNDPDMMKAGIADWQKRYPNNPGAKMLPTQLVNVKAFKPASTNKIALLLPLNGQAAVFGRTIQQGFEAAKNIGTQPVATQVAAAPAADVAEQPQPQTVDGVASPAQASVSDLTGEQPAAQPVPVSAPAATTAAVSAPANPSAELKIYDTSSQPLSQILNQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 8650 - protein, 360 aa, Escherichia coli B354
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPGSVDLYSDVDDITISKEPFLYGQVVDNTGQPIRWEGRASNFADYLLKNRLKSRSNGLRIIYSVTINMVPNHLDKRAHKYLGLVRQASRKYGIDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 8651 - protein, 679 aa, Escherichia coli B354; identical to SEQ ID NO: 8362

SEQ ID NO: 8652 - protein, 713 aa, Escherichia coli B354
MAKFTPSFSGIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHSTRADLQGNVDIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDFAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 8653 - protein, 821 aa, Escherichia coli B354
MSGVVCSLLFVLPVHAVEFNVDMIDAEDRENIDISRFEKKGYIPPGRYLVRVQINKNMLPQTLILEWVKADNESGSLLCLTKENLTNFGLNTEFIESLQNIAGSECLDLSQRQELTTRLDKATMILSLSVPQAWLKYQATNWTPPEFWDAGIAGFILDYNVYASQYAPHHGDSTQNVSSYGTLGFNLGAWRLRSDYQYNQNFADGRSVNHDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGQLDVTVEEEDGRTSTFQVGSASIPYLTRKGQVRYKTSLGKPTSVGHNDINNPFFWTVEASWGWLNNVSLYGGGMFTADDYQAITTGIGFNLNQFGSLSFDVTGADASLQQQNSDNLRGYSYRFNYAKHFESTGSQITFAGYRFSDKDYVSMSEYLSSRNGDESIDNEKESYVISLNQYFETLELNSYLNVTRNTYWDSASNTNYSVSVSKNFDIGEFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTATRHGVALHDYSYGDNARMMVDTDGISGVEINSNRTVTNGLGIAVIPSLSNYTTSMLRVNNNDLPEGVDVENSVIRTTLTQGAIGYAKLNATTGYQIVGVIRQENGRFPPLGVNVTDKATGKDVGLVAEDGFVYLSGIQENSILHLTWGDNTCEVTPPNQSNISESAIILPCKTVK

SEQ ID NO: 8654 - protein, 249 aa, Escherichia coli B354; identical to SEQ ID NO: 5852

SEQ ID NO: 8655 - protein, 412 aa, Escherichia coli B354
MKQWIAALLLMLIPGAQAAKPQKVTLMVDDVPVAQVLQALAEQEKLNLVVSPDVSGTVSLHLTDVPWKQALQTVVKSAGLITRQEGNILSVHSVAWQNDNIARQEAEQARAQANLPLENRSITLKYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 8656 - protein, 266 aa, Escherichia coli B354
MMYNQEMRMHQFPLSSLMINVLICILICCTNAQAGVVVGGTRFVYPEKQSSISVELKNTASKDMLVKISVTPDDGRQLKGTLESQPLLPDKAFIATPPLLVLKQDKNTKIRINRVGGQLPIDRESLFILNVAALPAQEQNSQLKNENQLQVAVRNRMKIFYRPETLSGNPLDAYQQLRWSRKNEAVTVFNPTPWYVTLYNLSIDGKSINGGMVAPFSHRQQDWCQRQGYCEINWQTLDLYNNALPVWSVKLTVLQNNVMSAVAIHG

SEQ ID NO: 8657 - protein, 250 aa, Escherichia coli B354
MRWISKNKCFSNRNINSLLKTQYVIRAGALFLLSAISINAIAAGGFGLGSTRLVYPSDSQQITLSVQNGGANTSYLIQSWIDDNQSSKKSQDFVVTPPLFMLPTRKEASLRIMFIGKSQLPTDRETLFWMNVKAIPPTDEKNTQKNTLQLALQNRIKLFYRPTNLPVQAGKARDMLRFKYEGKQLRVINPSPYYLTVTGIRVQGAKLPNAFVPPKSDVTVSSPVTLAGEITYQTINDYGATTARQKGTMQ

SEQ ID NO: 8658 - protein, 650 aa, Escherichia coli B354
MKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGAGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRIASLLKSLDVEESEEGNTRVYYLKYAKATNLVEVLTGVSEKLKDEKGNERKPSSSGAMDNVAITADEQTNSLVITADQSVQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQQRIDGKSKALVGSEDLPVLDENTFNSHTPAPSAR

SEQ ID NO: 8659 - protein, 505 aa, Escherichia coli B354
MSQYGNPTTCEIDNGGVIVADGFQASKAYSADSIVDYNDAHYKTSVDQGAWGFVPGGDNPWKKYEPAKAWSASTVYVKGDRVVVDGQAYEALFWTQSDNPALVANQNATGSNSRPWKPLGKAQSYSNEELNNAPQFNPETLYTSDTLIRFNGANYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 8660 - protein, 660 aa, Escherichia coli B354
MSRPQFTSLRLSLLALAVSATLPTFAFATETMTVTATGNARSSFEAPMMVSVIDTSAPENQTATSASDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGTRLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 8661 - protein, 208 aa, Escherichia coli B354; identical to SEQ ID NO: 5717

SEQ ID NO: 8662 - protein, 236 aa, Escherichia coli B7A; identical to SEQ ID NO: 7814

SEQ ID NO: 8663 - protein, 871 aa, Escherichia coli B7A
MHQVLILPRFARLTIALGLATAVFPVDAEYYFNPRFLSNDLAESVDLSAFTKGREAPPGTYRVDIYLNDEFMTSRDITFIADDNNADLIPCLSTDLLVSLGIKKSALLDNKEHSAEKHVPDNSACTPLQDRLADASTEFDVGQQHLSLSVPQIYVGRMARGYVSPELWEEGINAGLLNYSFNGNSINNRSNHNAGKSNYAYLNLQSGINIGSWRLRDNSTWSYNSGSSNSSNSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLTFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 8664 - protein, 700 aa, Escherichia coli B7A
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLIGLFTGYKYNYHNLTVDLFGRVDNLFDKEYVGSVIVNESNGRYYEPSPGRNYGVGMNIAWRFE

SEQ ID NO: 8665 - protein, 539 aa, Escherichia coli B7A; identical to SEQ ID NO: 6525

SEQ ID NO: 8666 - protein, 363 aa, Escherichia coli B7A; identical to SEQ ID NO: 7893

SEQ ID NO: 8667 - protein, 162 aa, Escherichia coli B7A; identical to SEQ ID NO: 5896

SEQ ID NO: 8668 - protein, 828 aa, Escherichia coli B7A; identical to SEQ ID NO: 6558

SEQ ID NO: 8669 - protein, 663 aa, Escherichia coli B7A
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNAVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 8670 - protein, 239 aa, Escherichia coli B7A
MAAIPWRPFNLRGIKMKGLLSLLIFSMVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKSNNANNWYLTIIDDHGNYISDKI

SEQ ID NO: 8671 - protein, 880 aa, Escherichia coli B7A; identical to SEQ ID NO: 6318

SEQ ID NO: 8672 - protein, 250 aa, Escherichia coli B7A; identical to SEQ ID NO: 6317

SEQ ID NO: 8673 - protein, 274 aa, Escherichia coli B7A; identical to SEQ ID NO: 8357

SEQ ID NO: 8674 - protein, 351 aa, Escherichia coli B7A; identical to SEQ ID NO: 6367

SEQ ID NO: 8675 - protein, 243 aa, Escherichia coli B7A; identical to SEQ ID NO: 6145

SEQ ID NO: 8676 - protein, 111 aa, Escherichia coli B7A
MKKQIEGMTMKKVLGLVVAAAMGLSSAAFAAETATTPAPTATTTKAAPAKTTHHKKQHKAAPAQKAQAAKKHHKNTKAEQKAPEQKAQAAKKHAGKHSHQQPAKPAAQPAA

SEQ ID NO: 8677 - protein, 331 aa, Escherichia coli B7A; identical to SEQ ID NO: 6456

SEQ ID NO: 8678 - protein, 760 aa, Escherichia coli B7A
MENNRNFPARQFHSLTFFAGLCIGITPVAQALAAEGQTNADDTLVVEASTPSLYAPQQSADPKFSRPVADTTRTMTVISEQVIKDQGATNLIDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 8679 - protein, 266 aa, Escherichia coli B7A; identical to SEQ ID NO: 5772

SEQ ID NO: 8680 - protein, 747 aa, Escherichia coli B7A; identical to SEQ ID NO: 6343

SEQ ID NO: 8681 - protein, 246 aa, Escherichia coli B7A; identical to SEQ ID NO: 6342

SEQ ID NO: 8682 - protein, 866 aa, Escherichia coli B7A
MTIKPTKNYHNHLTRIATFCALLYCNSAFCAELVEYDHTFLMGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGSLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 8683 - protein, 200 aa, Escherichia coli B7A; identical to SEQ ID NO: 6311

SEQ ID NO: 8684 - protein, 380 aa, Escherichia coli B7A
MNIYRAVTSFFNNSSKKGLTMKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNNQVIYGNNGLNASGQNAEVWAAGLKYDANNIYLATTYSETQNMTVFGNNHIANKAQNFEAVAQYQFDFGLRPSVAYLHSKGKDLGVWGDQDLVEYVDVGATYYFNKNMSTFVDYKINLIDKSDFTKASGVATDDIVAVGMVYQF

SEQ ID NO: 8685 - protein, 517 aa, Escherichia coli B7A; identical to SEQ ID NO: 6406

SEQ ID NO: 8686 - protein, 851 aa, Escherichia coli B7A
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGLPAQGAITVRWGEAPDQICHISYQLTEQQINSAITRMDAICR

SEQ ID NO: 8687 - protein, 224 aa, Escherichia coli B7A
MTVSLTAILLSCSSAWAAGKGGIGLAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLGEAPAKLSCTSSADMVTVSNPTPYFITLTDLKIGGKVVKNQMISPFDKYQFSLPKGAKNSSVTYRTINDYGAETPQLNCKS

SEQ ID NO: 8688 - protein, 362 aa, Escherichia coli B7A; identical to SEQ ID NO: 5809

SEQ ID NO: 8689 - protein, 774 aa, Escherichia coli B7A
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDANRWQSTRPYDRFWGRRKLASLGYQFQPDSQHKFNIQGFYTQTLRSGYLEQGKRITLSPRNYWVRGIELRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 8690 - protein, 368 aa, Escherichia coli B7A
MNKTITALTIIMASFAANASVLPETPVPFKSGTGAIDNDTVYIGLGSAGTAWYKLDTQAKDKRWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAYYFDKKAEDYFFNKFLLSFDPSTQQWSYAGESPWYGTAGAAVVNKGDKTWLINGEAKPGLRTDAVFELDFTGDNLKWNKLDPVSSPDGVAGGFAGISNDSLIFAGGAGFKGSRENYQNGKNYAHEGLKKSYSVDIHLWYNGKWDKSGELSQGRAYGVSLPWNNSLLIIGGETTGGKAVMDSVLISVKDNKVTVQN

SEQ ID NO: 8691 - protein, 241 aa, Escherichia coli B7A; identical to SEQ ID NO: 6143

SEQ ID NO: 8692 - protein, 856 aa, Escherichia coli B7A
MAGFFVRLFVACAFAAQAPLSSAELYFNPRFLADDPQAVADLSRFENGQELPPGTYRVDIYLNNGYMATRDVTFNTGDSEQGIVPCLTRAQLASMELNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLVGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 8693 - protein, 816 aa, Escherichia coli B7A
MNIYRLSLVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGVLMDYNLFASSYRPQDGSSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAIGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQNFTVVWGDSQHCSLHLPEHMEDTANRLILPCH

SEQ ID NO: 8694 - protein, 243 aa, Escherichia coli B7A; identical to SEQ ID NO: 6463

SEQ ID NO: 8695 - protein, 746 aa, Escherichia coli B7A; identical to SEQ ID NO: 6296

SEQ ID NO: 8696 - protein, 446 aa, Escherichia coli B7A; identical to SEQ ID NO: 6459

SEQ ID NO: 8697 - protein, 203 aa, Escherichia coli B7A; identical to SEQ ID NO: 6414

SEQ ID NO: 8698 - protein, 412 aa, Escherichia coli B7A
MKQWIAALLLMLIPGVQAAKPQKVTLMVDDVPVAQVLQALAEQEKLNLVVSPDVSGTVSLHLTDVPWKQALQTVVKSAGLITRQEGNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGVVLAIDKQEIETQVEVKSGETLALGGIFTRKNKSGQDSVPLLGDIPWFGQLFRHDGKEDERRELVVFITPRLVSSE

SEQ ID NO: 8699 - protein, 359 aa, Escherichia coli B7A
MKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPTRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 8700 - protein, 518 aa, Escherichia coli B7A; identical to SEQ ID NO: 7565

SEQ ID NO: 8701 - protein, 678 aa, Escherichia coli B7A; identical to SEQ ID NO: 7364

SEQ ID NO: 8702 - protein, 869 aa, Escherichia coli B7A
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDEHDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTWENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGNGANSRCIAHYVLPKQSLQQAVTVISAVCTHPGS

SEQ ID NO: 8703 - protein, 230 aa, Escherichia coli B7A; identical to SEQ ID NO: 6360

SEQ ID NO: 8704 - protein, 191 aa, Escherichia coli B7A; identical to SEQ ID NO: 5748

SEQ ID NO: 8705 - protein, 232 aa, Escherichia coli B7A
MQKNAAHTYAISSLLVLSLTGCAWIPSTPLVQGATSAQPVPGPTPVANGSIFQSAQPINYGYQPLFEDRRPRNIGDTLTIVLQENVSASKSSSANASRDGKTNFGFDTVPRYLQGLFGNARADVEASGGNTFNGKGGANASNTFNGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 8706 - protein, 122 aa, Escherichia coli B7A; identical to SEQ ID NO: 5737

SEQ ID NO: 8707 - protein, 565 aa, Escherichia coli B7A
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTHGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 8708 - protein, 203 aa, Escherichia coli B7A; identical to SEQ ID NO: 6347

SEQ ID NO: 8709 - protein, 213 aa, Escherichia coli B7A; identical to SEQ ID NO: 5744

SEQ ID NO: 8710 - protein, 729 aa, Escherichia coli B7A
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTQGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGIYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 8711 - protein, 193 aa, Escherichia coli B7A; identical to SEQ ID NO: 6300

SEQ ID NO: 8712 - protein, 478 aa, Escherichia coli B7A
MTRIKINARRIFSLLIPFFFFTSVHAEQTAAPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQINAEKQDFIKTVIPQWEEQARKNGLLSQ

SEQ ID NO: 8713 - protein, 237 aa, Escherichia coli B7A
MRKITQAISAVCLLFALNSSAVALASSPSPLNPGTNVARLAEQAPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPVTNMNPVIFAGDKPGQNTKSQWLQDKNIRIFYGDSDNDITAARDVGACGIRILRASNSTYKPLPQAGAFGEEVIVNSEY

SEQ ID NO: 8714 - protein, 249 aa, Escherichia coli B7A; identical to SEQ ID NO: 6450

SEQ ID NO: 8715 - protein, 834 aa, Escherichia coli B7A
MYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEVAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 8716 - protein, 232 aa, Escherichia coli B7A; identical to SEQ ID NO: 6064

SEQ ID NO: 8717 - protein, 686 aa, Escherichia coli B7A; identical to SEQ ID NO: 6453

SEQ ID NO: 8718 - protein, 231 aa, Escherichia coli B7A
MSKRTFAVIITLLCSFCIGQALAGGIVLQQTRVIYDASRKEAALPVANKGAETPYLLQSWVDNIDGTSRAPFIITPPLFRLEAGDDSSLRIIKTADNLPENKESLFYINVRAIPAKKKSDDVNANELTLVFKTRIKMFYRPAHLKGRVNDAWTSLEFKRSDHSLNIYNPTEYYVVFAGLAVDKTDLTSKIEYIAPGEHKQLPLPASGGKNVKWAAINDYGGSSGTETRPLQ

SEQ ID NO: 8719 - protein, 261 aa, Escherichia coli B7A
MINNFTEVKVKKKEKLKVVSIFVFCIVTPSFANEKLEIKEKEFSLKLDRSRLIFNENSRGALLTVENSHEYPILVQTRIIDEDRKGKSESLIATPPLFKLNEGEKSKIRIYKKYISNLPMDRETLFWTCTKGIPPTEKDLWAVENAENIEAKKSSLGVNLAVENCIKVFYRPKGIPSVRFDSGKDLVWSIKGDKIKVYNKTPNYMNFKELTIGNRNIENPAYVPPFSERFFDIKIIEGENINWTVITDFGGESQIHHERIK

SEQ ID NO: 8720 - protein, 121 aa, Escherichia coli B7A
MNTVLSVQGASAPVKKKSFFSKFTRLNMLRLVRAVIPVAVLMMLFPELAMASAGKGTDLMAKGNDTVKATFGKDSSIVKWVVLAEVLVGAVMYMMTKNVKFLVGFAIISVFIAVGMTVVGL

SEQ ID NO: 8721 - protein, 208 aa, Escherichia coli B7A; identical to SEQ ID NO: 5717

SEQ ID NO: 8722 - protein, 614 aa, Escherichia coli B7A
MIKKASLLTAFSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 8723 - protein, 265 aa, Escherichia coli B7A
MIYKFSSMKNITFIFFILLASPLYANGDKLYRADSRPPDEIKRSGGLMPRGHNEYFDRGTQMNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNSSRTITDDTCNEETQNLSTIYLRKYQSKVKRQIFSDYQSEVDIYNRIRDEL

SEQ ID NO: 8724 - protein, 287 aa, Escherichia coli B7A
MPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTADDAEEMIGKLTGMPIPLNSLRQWILGLPGDATDYKLDDQYRLSDRNSYALTEAERNASELTRWAGRKCPSGRVMGLANKGWVRGEPQDGGWIGWMIKPLGRWSLIMEIDEGFAVGMSPAELSAEQLLSKLWLWEGKAESYGWGSNSTQEAQFSVLDAITASELINDIEALFE

SEQ ID NO: 8725 - protein, 732 aa, Escherichia coli chi7122
MISKKYTLWALNPLLLTMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAVFLQSGYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTVDLLGSYQLPVGTLSFSIENLFDRDYTTVWGQRAPLYYSPGYGPASLYDYKGRGRTFGLNYSVLF

SEQ ID NO: 8726 - protein, 798 aa, Escherichia coli cloneA_i1
MYVNDQPIMSQSIAFAVIEGKKNAQACITQKNLLQFHISSPDKNSEKAILLKRDDDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVRIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAIMNIVRSDGKNIPFAADIYDEQNNIIGNVGQGGQAFVRGIGQEGNIRITWIEEGKPVSCFAHYQQNTTSEKIAQSIILNGLRCQIQ

SEQ ID NO: 8727 - protein, 246 aa, Escherichia coli cloneA_i1; identical to SEQ ID NO: 5857

SEQ ID NO: 8728 - protein, 747 aa, Escherichia coli cloneA_i1; identical to SEQ ID NO: 7499

SEQ ID NO: 8729 - protein, 266 aa, Escherichia coli cloneA_i1; identical to SEQ ID NO: 7500

SEQ ID NO: 8730 - protein, 161 aa, Escherichia coli cloneA_i1; identical to SEQ ID NO: 5769

SEQ ID NO: 8731 - protein, 351 aa, Escherichia coli cloneA_i1
MKKSTLALVVMGIVASVSVQAAEIYNKDGNKLDVYGKVKAMHYMSDNDSKDGDQSYIRFGFKGETQINVQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPISGGFANKTQNFEAVAQYQFDFGLRPSLGYVLSKGKDIEGIGDEDLVNYVDVGATYYFNKNMSAFVDYKINQLDSDNKLNINNDDIVAVGMTYHF

SEQ ID NO: 8732 - protein, 424 aa, Escherichia coli cloneA_i1
MTTSNWVQYEHTRNSRIPEGLAGGTEGKFNEKAAQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 8733 - protein, 193 aa, Escherichia coli cloneA_i1; identical to SEQ ID NO: 6300

SEQ ID NO: 8734 - protein, 430 aa, Escherichia coli cloneA_i1; identical to SEQ ID NO: 5758

SEQ ID NO: 8735 - protein, 331 aa, Escherichia coli cloneA_i1
MKKPVVIGLAVVVLAAVVAGGYWWYQTRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPNKPYHGQIGFVSPTAEFTPKTVETPDLRTDLVYRLRIVVTDADDALRQGMPVTVQFGDEAGHE

SEQ ID NO: 8736 - protein, 203 aa, Escherichia coli cloneA_i1
MKKIAITCALLSSLVASSVWADAASDLKSRLDKVSSFHASFTQKVTDGSGAAVQEGQGDLWVKRPNLFNWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKSQQNGAVDATKFPFPPPQGVTVDDQRK

SEQ ID NO: 8737 - protein, 362 aa, Escherichia coli cloneA_i1
MMKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGRVYDALGYTDMLPEFGGDTAYSDDFFVGRVGGVATYRNSNFFGLVDGLSFAVQYLGKNERDTARRSNGDGVGGSISYEYEGFGIVGAYGAADRTNLQEESSLGKGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 8738 - protein, 191 aa, Escherichia coli cloneA_i1; identical to SEQ ID NO: 5748

SEQ ID NO: 8739 - protein, 232 aa, Escherichia coli cloneA_i1; identical to SEQ ID NO: 5747

SEQ ID NO: 8740 - protein, 729 aa, Escherichia coli cloneA_i1
MLSTQFNRDNQHQAIIKPSLLAGCIALALLPSAAFAAPVTEETVIVEGSATAPDDGENDYNVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPKTDWSPQSLAQDDTTHMKSLYAATRVTLADPLHLILGARYTNWRVDTLTYSMEKNHTTPYAGLVFDINDNWSTYASYTSIFQPQNDRDSSGKYLTPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 8741 - protein, 213 aa, Escherichia coli cloneA_i1; identical to SEQ ID NO: 5744

SEQ ID NO: 8742 - protein, 203 aa, Escherichia coli cloneA_i1; identical to SEQ ID NO: 7450

SEQ ID NO: 8743 - protein, 656 aa, Escherichia coli cloneA_i1
MRLKKRYLCTVLTLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGFCYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 8744 - protein, 565 aa, Escherichia coli cloneA_i1; identical to SEQ ID NO: 7493

SEQ ID NO: 8745 - protein, 539 aa, Escherichia coli cloneA_i1; identical to SEQ ID NO: 7564

SEQ ID NO: 8746 - protein, 700 aa, Escherichia coli cloneA_i1
MKIFSVRQTVLPALLVLSPVVFAADEQTMIVSAAPQVVSDLDTPPAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGHQPPTIEASSYYGSFGSWRYGLKATGATGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNRGVPEYGQKGELRRDERNLMWNVDPYLQTQWQLTDKLSLDAGVRYSSVWFDSNDHYVTPGNGDDSGDASYHKWLPAGSLKYAMTDAWNVYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMAFASIGYIPEDGWYAGTEARYMGDIMADDENTAKAPSYTLVGLFTGYKYNYHNLTVDLFGRVDNLFDKEYVGSVIVNESNGRYYEPAPGRNYGVGINIAWRFE

SEQ ID NO: 8747 - protein, 118 aa, Escherichia coli cloneA_i1 [sequence omitted]

SEQ ID NO: 8748 - protein, 360 aa, Escherichia coli cloneA_i1; identical to SEQ ID NO: 5891

SEQ ID NO: 8749 - protein, 740 aa, Escherichia coli cloneA_i1
MADASSEFDVGQQHLSLSVPQIYVGRMARGYVSPDLWEEGINAGLLNYSFDGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGNLQVTIKEADGSIQTLYVPYSSVPVLQRAGYTRYALAMGEYRSGNNLQSTPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFHNSNASYSMSNDLKGGMTNLSGVYGTLLPDNNLNYSVQVGNTQGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVSLNANSLADNVELDETVVTVIPTHGAIARATFNAQIGGKVLMTLKYGNKSVPFGAIVTHGENKNGSIVAENGQVYLTGLPQSGKLQVSWGKDKNSNCIVDYKLPVVSPGTLLNQQTAICR

SEQ ID NO: 8750 - protein, 236 aa, Escherichia coli cloneA_i1; identical to SEQ ID NO: 7624

SEQ ID NO: 8751 - protein, 111 aa, Escherichia coli cloneA_i1; identical to SEQ ID NO: 5889

SEQ ID NO: 8752 - protein, 289 aa, Escherichia coli cloneA_i1
MATWHLTDRFDIGGGVRFSHDKSGTQYHGSILGNPFGDQGKSNDDQALGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 8753 - protein, 826 aa, Escherichia coli cloneA_i1; identical to SEQ ID NO: 7523

SEQ ID NO: 8754 - protein, 224 aa, Escherichia coli cloneA_i1; identical to SEQ ID NO: 5893

SEQ ID NO: 8755 - protein, 641 aa, Escherichia coli cloneA_i1
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 8756 - protein, 162 aa, Escherichia coli cloneA_i1; identical to SEQ ID NO: 8101

SEQ ID NO: 8757 - protein, 363 aa, Escherichia coli cloneA_i1; identical to SEQ ID NO: 7508

SEQ ID NO: 8758 - protein, 200 aa, Escherichia coli cloneA_i1; identical to SEQ ID NO: 5898

SEQ ID NO: 8759 - protein, 274 aa, Escherichia coli cloneA_i1; identical to SEQ ID NO: 5899

SEQ ID NO: 8760 - protein, 250 aa, Escherichia coli cloneA_i1; identical to SEQ ID NO: 7503

SEQ ID NO: 8761 - protein, 781 aa, Escherichia coli cloneA_i1
MAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKNWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSVDGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNAGEHMMVFWEGSAQCEIVLPKPLPADLFSGLLLPCEQKGTAAPDSSAPEIKPVIQDQTRQVTPTEAPTSISATQ

SEQ ID NO: 8762 - protein, 518 aa, Escherichia coli cloneA_i1; identical to SEQ ID NO: 7565

SEQ ID NO: 8763 - protein, 432 aa, Escherichia coli cloneA_i1; identical to SEQ ID NO: 5727

SEQ ID NO: 8764 - protein, 328 aa, Escherichia coli cloneA_i1
MKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGGITAAQAACCESFRMIRFRLPILLTP

SEQ ID NO: 8765 - protein, 239 aa, Escherichia coli cloneA_i1; identical to SEQ ID NO: 5991

SEQ ID NO: 8766 - protein, 843 aa, Escherichia coli cloneA_i1
MNLVMRGMKDRIPFAVNNITCVILLSLFCNAASAVEFNTDVLDAADKKNIDFTRFSEAGYVLPGQYLLDVIVNGQSISPASLQISFVEPALSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLAASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 8767 - protein, 682 aa, Escherichia coli cloneA_i1; identical to SEQ ID NO: 6110

SEQ ID NO: 8768 - protein, 686 aa, Escherichia coli cloneA_i1; identical to SEQ ID NO: 7542

SEQ ID NO: 8769 - protein, 711 aa, Escherichia coli cloneA_i1
MFTPSFSGLKGRALFSLLFAAPMIHATDSVTTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQENYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 8770 - protein, 754 aa, Escherichia coli cloneA_i1
MIDAEDRENIDISRFEKKGYIPPGRYLVRVQINKNMLPQTLILEWVKADNESGSLLCLTKENLTNFGLNTEFIESLQNIAGSECLDLSQRQELTTRLDKATMILSLSVPQAWLKYQATNWTPPEFWDTGIAGFILDYNVPPSQYAPHHGDSTQNVSSYGTLGFNLGAWRLRSDYQYNQNFADGRSVNRDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGLLDVTVEEEDGRTSTFQVGSASIPYLTRKGQVRYKTSLGKPTSVGHNDINNPFFWTAEASWGWLNNVSLYGGGMFTADDYQAITTGIGFNLNQFGSLSFDVTGADASLQQQNSGNLRGYSYRFNYAKHFESTGSQITFAGYRFSDKDYVSMSEYLSSRNGDESIDNEKESYVISLNQYFETLELNSYLNVTRNTYWDSASNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTATRHGIALHDYSYGDNARMMVDTDGISGIEINSNRTVTNGLGIAVIPSLSNYTTSMLRVNNNDLPEGVDVENSVIRTTLTLKWSTKTGHRVRVFSSIDFPIRLVVTHHYIRAVLVRCNIQRYSPLLRELHR

SEQ ID NO: 8771 - protein, 280 aa, Escherichia coli cloneA_i1
MKSPLITTGMICLLGICNFAQATVSPDRTRIIFNASNKSATVRLTNQSKIDPYLAQSWIEDASGKKTRDYISTLPPMERIEPDEQIQIRLMALASLNDLPQDRETLFYYNVREIPPRAKEQNVMQIAMQSRLKLFWRPKAIELKEGEMIPLQKVTITRTAAGLTLNNPTPYHITVGYIGTNGKTLMPGADSIMVVPFTSATQHLSSLPSTFQLGFVADYGGLEMFKVECNSIQSLCQSSPAKKGKIWLRFFVYWRFFACFLTFQLLLLIAIRMGTEEQPS

SEQ ID NO: 8772 - protein, 678 aa, Escherichia coli cloneA_i1; identical to SEQ ID NO: 7525

SEQ ID NO: 8773 - protein, 654 aa, Escherichia coli cloneA_i1; identical to SEQ ID NO: 6816

SEQ ID NO: 8774 - protein, 900 aa, Escherichia coli cloneA_i1
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSTSNTPASNTPANGASATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEITQYGNPASCSVKPDNNGGAVTPVDPTPETPETPVTPTPDNNEPSTPADSSNDYSLQAWSGQEGSEIYHVIFNGNVYQNAWWVGSEDCPRGTSVENSNNPWRLVRTATAAEMSQYGNPTTCEIDNGGVIIADGFQASKAYSANSIVDYNDAHYKTSVDQDAWGFVPGGDNPWKKYEPAKAWSASTVYVKGDRVVVDGQAYEALFWTQSDNPALIANQNATGSNSRPWKPLGKTQSYSNEELNNAPQFNPETLYASDTLIRFNGENYISQSKVQKVSPSDSNPWRVFVDWTGTKERVGTPKKAWPKHVYAPYVDFTLNTIPDLAALAKSHNVNHFTLAFVVSKDANTFLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 8775 - protein, 386 aa, Escherichia coli cloneA_i1; identical to SEQ ID NO: 5860

SEQ ID NO: 8776 - protein, 259 aa, Escherichia coli cloneA_i1
MRQYRLLSPMIKVVIVLFSLLFSTAQAGLVIGGTRFAYPENQSSISVELKNTSDRDMLVKVAVSPDDARQLTGTVESLPSYSETVFIATPPLFVLKPDKNTKIRINRVGGSLSADRESLFILNVAALPTLENSHSVKTDNQLQIAVRNRMKIFYRPSNLSEDPNMSYQKLRWARKNEIVTVYNPGPRYVTLYNLHVDGKVIDGGMVAPFSHRQQSWCKSQGVCEIAWQTLDVYNNVLPAWKVKMNLLQMDVSGLQVKTD

SEQ ID NO: 8777 - protein, 250 aa, Escherichia coli cloneA_i1; identical to SEQ ID NO: 5862

SEQ ID NO: 8778 - protein, 660 aa, Escherichia coli cloneA_i1
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTPVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGVTTTLVLGNAFDKEYWSPQGIPQDGRNGKIFVSYQW

SEQ ID NO: 8779 - protein, 429 aa, Escherichia coli cloneA_i1
MTLKDFSKFVKDEIGFSYNGYYRSGWGTASHGSPKSWAIGSLGRFGNEYSGWFDLQLKQRVYNENGKRVDAIVMMDGNVGQQYSTGWFGDNAGGENFMQFSDMYVTTKGFLPFAPEADFWVGKHGAPKIEIQMLDWKTQRTDAAAGVGLENWKVGPGKIDIALVREDVDDYDRSLQNKQQINTNTIDLRYKDIPLWDKVTLMVSGRYVTANESASEKDNQDNNGYYDWKDTWMFGTSLTQKFDKGGFNEFSFLVANNSIASNFGRYAGASPFTTFNGRYYGYHTGGTAVRLTSQGEAYIGDHFIVANAIVYSFGNDIYSYETGAHSDFESIRAVVRPAYIWDQYNQTGVELGYFTQQNKDANSNKFNESGYKTTLFHTFKVNTSMLTSRPEIRFYATYIKALENELDGFTFEDNKDDQFAVGAQAEIWW

SEQ ID NO: 8780 - protein, 208 aa, Escherichia coli cloneA_i1
MKKIWLALAGLVLAFSASAAQYEDGKQYTTLEKPVAGAPQVLEFFSFFCPHCYQFEEVLHISDNVKKKLPEGVKMTKYHVNFMGGDLGKELTQAWAVAMALGVEDKVTVPLFEGVQKTQTIRSASDIRDVFINAGIKGEEYDAAWNSFVVKSLVAQQEKAAADVQLRGVPAMFVNGKYQLNPQGMDTSTMDVFVQQYADTVKYLSEKK

SEQ ID NO: 8781 - protein, 614 aa, Escherichia coli cloneA_i1
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDHPGTEISAGWGSNSYQNYDVSTQQQLGDKTRVTLLGDYAHTHGYDVVAYGNTGTQAQPDNDGFLSKTLYGALEHNFTDVWSGFVRGYGYDNRTNYDAYYSPGLPLVDTRKLYSQSWDAGLRYNGELIKSQLITSYSHSKDYNYDPHYGRYDSSATLDDMKQYTVQWANNIIIGHGNIGAGVDWQKQSTAPGTAYVEDGYDQRNTGIYLTGLQQVGDFTFEGAGRSDDNSQFGRHGTWQTSAGWEFIEGYRFIASYGTSYKAPNLGQLYGTYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 8782 - protein, 446 aa, Escherichia coli cloneA_i1; identical to SEQ ID NO: 5873

SEQ ID NO: 8783 - protein, 237 aa, Escherichia coli cloneA_i1; identical to SEQ ID NO: 7546

SEQ ID NO: 8784 - protein, 478 aa, Escherichia coli cloneA_i1; identical to SEQ ID NO: 6796

SEQ ID NO: 8785 - protein, 368 aa, Escherichia coli cloneA_i1
MNKTITALAIMMASFAANASVLPETPVPFKSGTGAIDNDTVYIGLGSAGTAWYKLDTQAKDKKWTALAAFPGGPRDQATSAFIDGDLYVFGGIGKNSKGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGDNLKWNRLAPVSSPDGVAGGFAGISNDSLIFAGGAGFKGSRENYQNGKNYAHEGLKKSYSTDIHLWHNGKWDKSGELSQGRAYGVSLPWNNSLLIIGGESAGGKAVTDSVLISVKDNKVTVQN

SEQ ID NO: 8786 - protein, 216 aa, Escherichia coli cloneA_i1
MAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 8787 - protein, 691 aa, Escherichia coli cloneA_i1
MAGFFVRLFVACAFAAQAPLSSAELYFNPRFLADDPQAVADLSRFENGQELPPGTYRVDIYLNNGYMATRDVTFNTGDSEQGIVPCLTRAQLASMGLNMASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQP

SEQ ID NO: 8788 - protein, 784 aa, Escherichia coli DEC10A; identical to SEQ ID NO: 6283

SEQ ID NO: 8789 - protein, 170 aa, Escherichia coli DEC10A [sequence omitted]

SEQ ID NO: 8790 - protein, 765 aa, Escherichia coli DEC10A
MQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 8791 - protein, 246 aa, Escherichia coli DEC10A; identical to SEQ ID NO: 6342

SEQ ID NO: 8792 - protein, 747 aa, Escherichia coli DEC10A
MARSKTAQPKHSLRKIAVVVATAVSGMSVYAQAAVEPKEDTITVTVAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLSGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 8793 - protein, 266 aa, Escherichia coli DEC10A; identical to SEQ ID NO: 5772

SEQ ID NO: 8794 - protein, 161 aa, Escherichia coli DEC10A; identical to SEQ ID NO: 5769

SEQ ID NO: 8795 - protein, 368 aa, Escherichia coli DEC10A
MNKTITALAIMMASFAANASVLPETPVPFKSGTGAIDNDTVYIGLGSAGTAWYKLDTQAKDKKWKALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 8796 - protein, 241 aa, Escherichia coli DEC10A; identical to SEQ ID NO: 6143

SEQ ID NO: 8797 - protein, 878 aa, Escherichia coli DEC10A
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 8798 - protein, 221 aa, Escherichia coli DEC10A
MKNYLWLVALLPLLSGCESQAILVKKDDAYFAPPKTEAPPPADGRAGGVFETGYNWSLTADRRAYRVGDILTVILEESTQSSKQAKTNFGKSNTVDIGAPTIFSHTKDKLSGSIDANRDFDGSATSQQQNSLRGEITVSVHAVQPNGILEIRGEKWLTLNQGDEYIRLSGLVRADDIQNDNSVSSQRIADACISYAGRGALSDANAAGWLTRLFNHPLFPI

SEQ ID NO: 8799 - protein, 351 aa, Escherichia coli DEC10A
MKKSTLALVVMGIVASASVQAAEIYNKDGNKLDVYGKVKAMHYMSDNASKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNFYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 8800 - protein, 230 aa, Escherichia coli DEC10A; identical to SEQ ID NO: 7861

SEQ ID NO: 8801 - protein, 869 aa, Escherichia coli DEC10A
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERISLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGIRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGTVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGRKPVPFGSLVRENSTGITSMVGDDGQVYLSGAPLSGELLVQWGDGANSRCIAHYVLPKQSLQQAVTVISAVCTHPGS

SEQ ID NO: 8802 - protein, 360 aa, Escherichia coli DEC10A
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTQANGDGFGFSTTYEYEGFGVGATYAKSDRTNNQVIYGNNSLNASGQNAEVWAAGLKYDANNIYLATTYSETQNMTVFGKNHIANKAQNFEVVAQYQFDFGLRPSVAYLQSKGKDLGAWGDQDLVEYIDVGATYYFNKNMSTFVDYKINLIDKSDFTKASGVATDDIVAVGMVYQF

SEQ ID NO: 8803 - protein, 746 aa, Escherichia coli DEC10A
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDILVNQTLTLGTEWNQQRMKDLSSNTQALTGANTGGAIDGMSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 8804 - protein, 193 aa, Escherichia coli DEC10A; identical to SEQ ID NO: 6300

SEQ ID NO: 8805 - protein, 243 aa, Escherichia coli DEC10A
MTFMKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPAPEKNSDHAVLQVAIQSRIKVFWRPAALRKKAGEKVELQLQVSQQGNQLTLKNPTAYYLTIAYLGRNEKGVLPGFKTVMVAPFSTVNTNIGNYSGSQFYLGYMDDYGALRMTTLNYSGQCHLQAVEAKK

SEQ ID NO: 8806 - protein, 816 aa, Escherichia coli DEC10A
MNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGVLMDYNLFASSYRPQDGSSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNDVSWGMLSNTSLYGGLLLSGDDYHSAAIGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 8807 - protein, 430 aa, Escherichia coli DEC10A; identical to SEQ ID NO: 5758

SEQ ID NO: 8808 - protein, 331 aa, Escherichia coli DEC10A; identical to SEQ ID NO: 6456

SEQ ID NO: 8809 - protein, 760 aa, Escherichia coli DEC10A; identical to SEQ ID NO: 6322

SEQ ID NO: 8810 - protein, 203 aa, Escherichia coli DEC10A; identical to SEQ ID NO: 6414

SEQ ID NO: 8811 - protein, 361 aa, Escherichia coli DEC10A; identical to SEQ ID NO: 7868

SEQ ID NO: 8812 - protein, 224 aa, Escherichia coli DEC10A; identical to SEQ ID NO: 7869

SEQ ID NO: 8813 - protein, 591 aa, Escherichia coli DEC10A; identical to SEQ ID NO: 7870

SEQ ID NO: 8814 - protein, 130 aa, Escherichia coli DEC10A
MPVDRETLFELSIASVPSGKVENQSVKVAMRSVFKLFWRPEGLPGDPLEAYQQLRWTRNSQGVQLTNPTPYYINLIQLSVNGKALSNAGVVPPKSQRQTSWCQAIAPCHVAWRAINDYGGLSAKKEQNLP

SEQ ID NO: 8815 - protein, 178 aa, Escherichia coli DEC10A
MFSAGSAVAADYKIDKEGQHAFVNFRIQHLGYSWLYGTFKDFDGTFTFDEKNPAADKVNVTINTTSVDTNHAERDKHLRSADFLNTAKYPQATFTSTSVKKDGDELDITGDLTLNGVTKPVTLEAKLIGQGDDPWGGKRAGFEAEGKIKLKDFNIKTDLGPASQEVDLIISVEGVQQK

SEQ ID NO: 8816 - protein, 232 aa, Escherichia coli DEC10A; identical to SEQ ID NO: 5747

SEQ ID NO: 8817 - protein, 686 aa, Escherichia coli DEC10A
MIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQHIDVNSPTWGGLPRWNTDGSSNSYDRARSTAPDWAYNDKEINKVFMTLKQRFADTWQATLNATHSEVEFDSKMMYVDAYVNKADGMLIGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHIKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 8818 - protein, 213 aa, Escherichia coli DEC10A; identical to SEQ ID NO: 5744

SEQ ID NO: 8819 - protein, 732 aa, Escherichia coli DEC10A
MMRKKYMPRALGPLLLVVLSPAVAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLRQELVGQVYYRDESLRFYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLPLTKSVNVSDSKLEGVKVDSYELGWRFTGDNLRTQIAAYYSLSNKSVERNKDLTISVKDDRRRIYGVEGAVDYLIPDTDWSTGVNFNVLKTESKVNGQWQKYDVKESSPSKATAYISWAPEPWSLRVQSTTSFDVSDAEGNDINGYTTVDFISSWLLPVGTLSFSVENLFDRDYTTVWGQRAPLYYSPGYGPASLYDYKGRGRTFGLNYSVLF

SEQ ID NO: 8820 - protein, 289 aa, Escherichia coli DEC10A
MVKEAVSHIPAPRDGRDYDPEVLKQAVNDAVANIPVPADGKSITPDDVRPMLEQMVKEAVSHIPAPRDGRDYDPEVLKQAVNDAVANIPVPADGKSITPDDVRPMLEQMVKEAVSHIPAPRDGRDYDPEVLKQAVLEAVNALPAPQDGRDATALEVLPAIDDQKSFPRGTYATHLGGLWRAYEKTHGMRGWECLVDGVADIDVSMTDERLFSVVIRQSSGQCTEKTFSLPVMLYRGVFRAGETYHPGDTVTWGGSLWHCNSMTGDKPGEAHSSGWTLAAKRGRDAGGGK

SEQ ID NO: 8821 - protein, 186 aa, Escherichia coli DEC10A
KGERGDTGPAGATGERGPAGDAGPAGPQGPKGDRGERGETGLTGNAGPQGPKGDTGAAGPAGPQGPKGETGAAGPVGATGPQGPKGDPGETQIRFRLGPASIIETNSNGWFPGTDGALITGLTFLTPKMPHRFRGCFSICRSGLVTGRGRMLRGLMKWAVIQAEQENDSKPAHLNRLGLFPPALQK

SEQ ID NO: 8822 - protein, 89 aa, Escherichia coli DEC10A; identical to SEQ ID NO: 6232

SEQ ID NO: 8823 - protein, 203 aa, Escherichia coli DEC10A; identical to SEQ ID NO: 6347

SEQ ID NO: 8824 - protein, 565 aa, Escherichia coli DEC10A; identical to SEQ ID NO: 6492

SEQ ID NO: 8825 - protein, 207 aa, Escherichia coli DEC10A; identical to SEQ ID NO: 5743

SEQ ID NO: 8826 - protein, 539 aa, Escherichia coli DEC10A; identical to SEQ ID NO: 6525

SEQ ID NO: 8827 - protein, 700 aa, Escherichia coli DEC10A
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRQNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 8828 - protein, 236 aa, Escherichia coli DEC10A; identical to SEQ ID NO: 6472

SEQ ID NO: 8829 - protein, 395 aa, Escherichia coli DEC10A
MAVKISGVLKDGTGKPVENCTIQLKARRTSSTVVVNTVASENPDEAGRYSMDVEYGQYSVILLVEGFPPSHAGTITVYEDSQPGTLNDFLGAMSEDDVRPEALRRFELMVEEVARHAEEAKKNAGEAETSARNAGISASQAEESAANADTSAGEASESARQAAESAASAKQSEDASSSSASAAAQKASESSQSAAEAELSRKTAESAAGNAARDATTAPEKARESAESAQSAEQSRIAAEEAVNRIPTVVGPPGPKGEPGPAGPQGPKGDKGERGDTGPVGATGERGPAGDAGPAGPQGPKGDRGERGETGLTGNAGPQGPKGDTGAAGPAGPQGPKGETGAAGPVGATGPQGPKGDPGETQIRFRLGPASIIETKQPWLVPGYRWCAHHRTDLS

SEQ ID NO: 8830 - protein, 111 aa, Escherichia coli DEC10A; identical to SEQ ID NO: 7885

SEQ ID NO: 8831 - protein, 367 aa, Escherichia coli DEC10A
KARRTSSTVVVNTVASENPDEAGRYSMDVEYGQYSVILLVEGFPPSHAGTITVYEDSQPGTLNDFLGAMSEDDVRPEALRRFELMLEEAARHAEEAKKNAGEAETSARNAGISASQAEESAAHADTSAGDASESARQAAESAAAAKQSEEASSSSASAAAQKASESSQSAAEAELSRKTAESAAGNAARDATTATEKARESAESAQSAEQSRIAAEEAVNRIPTVVGPPGPKGEQGPAGPQGPKGDKGERGDTGPVGATGERGPAGDAGPAGPQGPKGDRGERGETGLTGNAGPQGPKGDTGAAGPAGPQGPKGETGAAGPVGATGPQGPKGDPGEAQIRFRLGPETLLRQTAMAGSRIQMAHSSPD

SEQ ID NO: 8832 - protein, 118 aa, Escherichia coli DEC10A [sequence omitted]

SEQ ID NO: 8833 - protein, 673 aa, Escherichia coli DEC10A
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIEDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPDGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 8834 - protein, 162 aa, Escherichia coli DEC10A; identical to SEQ ID NO: 5896

SEQ ID NO: 8835 - protein, 363 aa, Escherichia coli DEC10A; identical to SEQ ID NO: 7893

SEQ ID NO: 8836 - protein, 826 aa, Escherichia coli DEC10A
MLRMTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAASYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 8837 - protein, 224 aa, Escherichia coli DEC10A; identical to SEQ ID NO: 6435

SEQ ID NO: 8838 - protein, 641 aa, Escherichia coli DEC10A; identical to SEQ ID NO: 7667

SEQ ID NO: 8839 - protein, 200 aa, Escherichia coli DEC10A; identical to SEQ ID NO: 6311

SEQ ID NO: 8840 - protein, 460 aa, Escherichia coli DEC10A
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHIEGEFFLVLKLPGGSLTAGRYMAAHWEMKTISLRRLASVAICLHSARSRLMLLTRTPNWIKTPLMAKVRWTVTPSV

SEQ ID NO: 8841 - protein, 274 aa, Escherichia coli DEC10A; identical to SEQ ID NO: 7895

SEQ ID NO: 8842 - protein, 250 aa, Escherichia coli DEC10A
MFNLTNTAKIVVPALALLATVVSFSSHASVTPDRTRLVFNESDKSISVTLRNNDPTLPYLAQSWIEDAKGNKISSPLAVLPPVQRIDAMMNGQVKVQGLPDINKLPADRESVFYFNVREIPPKSNKPNTLQIALQTRIKLFWRPKALENTSMKSPWQHKVTLIRNGQDFTVNNPTPYYVIISNASAKKGGNPPAGFTPLMMEPKTSAPLNAKMDSVPVLTYINDYGARMPLYFICTGNSCQVDEEQSRKG

SEQ ID NO: 8843 - protein, 518 aa, Escherichia coli DEC10A; identical to SEQ ID NO: 6358

SEQ ID NO: 8844 - protein, 432 aa, Escherichia coli DEC10A; identical to SEQ ID NO: 5727

SEQ ID NO: 8845 - protein, 359 aa, Escherichia coli DEC10A; identical to SEQ ID NO: 5847

SEQ ID NO: 8846 - protein, 834 aa, Escherichia coli DEC10A
MYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEEAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 8847 - protein, 249 aa, Escherichia coli DEC10A; identical to SEQ ID NO: 6450

SEQ ID NO: 8848 - protein, 231 aa, Escherichia coli DEC10A; identical to SEQ ID NO: 6351

SEQ ID NO: 8849 - protein, 838 aa, Escherichia coli DEC10A
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQNLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 8850 - protein, 678 aa, Escherichia coli DEC10A; identical to SEQ ID NO: 6353

SEQ ID NO: 8851 - protein, 208 aa, Escherichia coli DEC10A; identical to SEQ ID NO: 5717

SEQ ID NO: 8852 - protein, 386 aa, Escherichia coli DEC10A; identical to SEQ ID NO: 7908

SEQ ID NO: 8853 - protein, 198 aa, Escherichia coli DEC10A
MVYLSNNADKSISVFSKEEKIPYLIQAWVDPFNKEDKSKAPFTVIPPVSRLEPSQEKILRIIHTKGVSLPDDRESVFWLNIKNIPPSASNKATNSLEIAVKTRIKLFWRPANIRLIPEDAAPKVKWRREGRNLIAENPNPIHISVMDVIVDGHDVPLNMIRPFETLTLPLPANSAGGQMTWRFINDYGAVSDPIKMTL

SEQ ID NO: 8854 - protein, 228 aa, Escherichia coli DEC10A; identical to SEQ ID NO: 6185

SEQ ID NO: 8855 - protein, 843 aa, Escherichia coli DEC10A; identical to SEQ ID NO: 7909

SEQ ID NO: 8856 - protein, 614 aa, Escherichia coli DEC10A; identical to SEQ ID NO: 6303

SEQ ID NO: 8857 - protein, 446 aa, Escherichia coli DEC10A; identical to SEQ ID NO: 6459

SEQ ID NO: 8858 - protein, 478 aa, Escherichia coli DEC10A
MTRIKINARRIFSLLIPFFFFTSVHAEQTAAPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKLQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 8859 - protein, 512 aa, Escherichia coli DEC10A; identical to SEQ ID NO: 6251

SEQ ID NO: 8860 - protein, 774 aa, Escherichia coli DEC10A
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLSPRLASRSTVLMDGIPVPFAPYGQPQLSLAPVSLGNMDAIDVVRGGGAVRYGPQSVGGVVNFVTCAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 8861 - protein, 368 aa, Escherichia coli DEC10B; identical to SEQ ID NO: 8795

SEQ ID NO: 8862 - protein, 241 aa, Escherichia coli DEC10B; identical to SEQ ID NO: 6143

SEQ ID NO: 8863 - protein, 863 aa, Escherichia coli DEC10B
MHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 8864 - protein, 784 aa, Escherichia coli DEC10B; identical to SEQ ID NO: 6283

SEQ ID NO: 8865 - protein, 170 aa, Escherichia coli DEC10B [sequence omitted]

SEQ ID NO: 8866 - protein, 866 aa, Escherichia coli DEC10B; identical to SEQ ID NO: 7345

SEQ ID NO: 8867 - protein, 246 aa, Escherichia coli DEC10B; identical to SEQ ID NO: 6342

SEQ ID NO: 8868 - protein, 747 aa, Escherichia coli DEC10B
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLSGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 8869 - protein, 266 aa, Escherichia coli DEC10B; identical to SEQ ID NO: 5772

SEQ ID NO: 8870 - protein, 161 aa, Escherichia coli DEC10B; identical to SEQ ID NO: 5769

SEQ ID NO: 8871 - protein, 221 aa, Escherichia coli DEC10B; identical to SEQ ID NO: 8798

SEQ ID NO: 8872 - protein, 351 aa, Escherichia coli DEC10B; identical to SEQ ID NO: 8799

SEQ ID NO: 8873 - protein, 614 aa, Escherichia coli DEC10B; identical to SEQ ID NO: 6303

SEQ ID NO: 8874 - protein, 230 aa, Escherichia coli DEC10B; identical to SEQ ID NO: 7861

SEQ ID NO: 8875 - protein, 780 aa, Escherichia coli DEC10B
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERISLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGIRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGTVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKILAALCRRKARWFVPILIPA

SEQ ID NO: 8876 - protein, 360 aa, Escherichia coli DEC10B; identical to SEQ ID NO: 8802

SEQ ID NO: 8877 - protein, 746 aa, Escherichia coli DEC10B; identical to SEQ ID NO: 8803

SEQ ID NO: 8878 - protein, 193 aa, Escherichia coli DEC10B; identical to SEQ ID NO: 6300

SEQ ID NO: 8879 - protein, 430 aa, Escherichia coli DEC10B; identical to SEQ ID NO: 5758

SEQ ID NO: 8880 - protein, 243 aa, Escherichia coli DEC10B
MTFMKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPAPEKNSDHAVLQVAIQSRIKVFWRPAALRKKAGEKVELQLQVSQQGNQLTLKNPTAYYLTIVYLGRNEKGVLPGFKTVMVAPFSTVNTNIGNYSGSQFYLGYMDDYGALRMTTLNYSGQCHLQAVEAKK

SEQ ID NO: 8881 - protein, 559 aa, Escherichia coli DEC10B
MLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNDVSWGMLSNTSLYGGLLLSGDDYHSAAIGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 8882 - protein, 331 aa, Escherichia coli DEC10B; identical to SEQ ID NO: 6456

SEQ ID NO: 8883 - protein, 760 aa, Escherichia coli DEC10B; identical to SEQ ID NO: 6322

SEQ ID NO: 8884 - protein, 203 aa, Escherichia coli DEC10B; identical to SEQ ID NO: 6414

SEQ ID NO: 8885 - protein, 361 aa, Escherichia coli DEC10B; identical to SEQ ID NO: 7868

SEQ ID NO: 8886 - protein, 224 aa, Escherichia coli DEC10B; identical to SEQ ID NO: 7869

SEQ ID NO: 8887 - protein, 591 aa, Escherichia coli DEC10B; identical to SEQ ID NO: 7870

SEQ ID NO: 8888 - protein, 130 aa, Escherichia coli DEC10B; identical to SEQ ID NO: 8814

SEQ ID NO: 8889 - protein, 68 aa, Escherichia coli DEC10B
MYGKTFSLPVMLYRGVFRAGETYHPGDTVTWGGSLWHCNSMTGDKPGEAHSSGWTLAAKRGRDAGGGK

SEQ ID NO: 8890 - protein, 669 aa, Escherichia coli DEC10B
MIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPDLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 8891 - protein, 732 aa, Escherichia coli DEC10B; identical to SEQ ID NO: 8819

SEQ ID NO: 8892 - protein, 191 aa, Escherichia coli DEC10B; identical to SEQ ID NO: 5748

SEQ ID NO: 8893 - protein, 232 aa, Escherichia coli DEC10B; identical to SEQ ID NO: 5747

SEQ ID NO: 8894 - protein, 729 aa, Escherichia coli DEC10B
MLSTQFNRDNQYQASTKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQHIDVNSPTWGGLPRWNTDGSSNSYDRARSTAPDWAYNDKEINKVFMTLKQRFADTWQATLNATHSEVEFDSKMMYVDAYVNKADGMLIGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHIKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 8895 - protein, 213 aa, Escherichia coli DEC10B; identical to SEQ ID NO: 5744

SEQ ID NO: 8896 - protein, 89 aa, Escherichia coli DEC10B; identical to SEQ ID NO: 6232

SEQ ID NO: 8897 - protein, 203 aa, Escherichia coli DEC10B; identical to SEQ ID NO: 6347

SEQ ID NO: 8898 - protein, 565 aa, Escherichia coli DEC10B; identical to SEQ ID NO: 6492

SEQ ID NO: 8899 - protein, 207 aa, Escherichia coli DEC10B; identical to SEQ ID NO: 5743

SEQ ID NO: 8900 - protein, 539 aa, Escherichia coli DEC10B; identical to SEQ ID NO: 6525

SEQ ID NO: 8901 - protein, 700 aa, Escherichia coli DEC10B; identical to SEQ ID NO: 7945

SEQ ID NO: 8902 - protein, 871 aa, Escherichia coli DEC10B
MHQVLIMPRFARLTIALGLATAVFPVDAEYYFNPRFLSNDLAESVDLSAFTKGREAPPGTYRVDIYLNDEFMTSRDITFIADDNNAELIPCLSTDLLVSLGIKKIALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVITVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 8903 - protein, 236 aa, Escherichia coli DEC10B; identical to SEQ ID NO: 6472

SEQ ID NO: 8904 - protein, 111 aa, Escherichia coli DEC10B; identical to SEQ ID NO: 7885

SEQ ID NO: 8905 - protein, 118 aa, Escherichia coli DEC10B [sequence omitted]

SEQ ID NO: 8906 - protein, 673 aa, Escherichia coli DEC10B; identical to SEQ ID NO: 8833

SEQ ID NO: 8907 - protein, 363 aa, Escherichia coli DEC10B; identical to SEQ ID NO: 7893

SEQ ID NO: 8908 - protein, 359 aa, Escherichia coli DEC10B
MVVNTVASENPDEAGRYSMDVEYGQYSVILLVEGFPPSHAGTITVYEDSQPGTLNDFLGAMSEDDVRPEALRRFELMVEEVARHAEEAKKNAGEAETSARNAGISASQAEESAANADTSAGEASESARQAAESAASAKQSEDASSSSASAAAQKASESSQSAAEAELSRKTAESAAGNAARDATTATEKARESAESAQSAEQSRIAAEEAVNRIPTVVGPPGPKGEQGPAGPQGPKGDKGERGDTGPVGATGERGPAGDAGPAGPQGPKGDRGERGETGLTGMQVHRVQREIPVRQARQAHRDRKEKQVRLARWGQPDLRDRRATRGRHKSVFVWGRRALLRQTAMAGSRIQMAHSSPD

SEQ ID NO: 8909 - protein, 826 aa, Escherichia coli DEC10B; identical to SEQ ID NO: 8836

SEQ ID NO: 8910 - protein, 224 aa, Escherichia coli DEC10B; identical to SEQ ID NO: 6435

SEQ ID NO: 8911 - protein, 631 aa, Escherichia coli DEC10B; identical to SEQ ID NO: 6430

SEQ ID NO: 8912 - protein, 162 aa, Escherichia coli DEC10B; identical to SEQ ID NO: 5896

SEQ ID NO: 8913 - protein, 200 aa, Escherichia coli DEC10B; identical to SEQ ID NO: 6311

SEQ ID NO: 8914 - protein, 274 aa, Escherichia coli DEC10B; identical to SEQ ID NO: 7895

SEQ ID NO: 8915 - protein, 250 aa, Escherichia coli DEC10B; identical to SEQ ID NO: 8842

SEQ ID NO: 8916 - protein, 881 aa, Escherichia coli DEC10B
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHIEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNRLPENAEATQSVVQATLTEGAIGYRKFAVISGQKAMAVLRLSDGSHPPFGAEVKNDNEQTVGLVDDDGNVYLAGVKPGEHMSVFWSGVAHCDINLPDPLPADLFNGLLLPCQHKGNVAPITSPAVKPAIQEQTQRVTPTEPPTSISVNQ

SEQ ID NO: 8917 - protein, 518 aa, Escherichia coli DEC10B; identical to SEQ ID NO: 6358

SEQ ID NO: 8918 - protein, 432 aa, Escherichia coli DEC10B; identical to SEQ ID NO: 5727

SEQ ID NO: 8919 - protein, 359 aa, Escherichia coli DEC10B; identical to SEQ ID NO: 5847

SEQ ID NO: 8920 - protein, 834 aa, Escherichia coli DEC10B; identical to SEQ ID NO: 8846

SEQ ID NO: 8921 - protein, 231 aa, Escherichia coli DEC10B; identical to SEQ ID NO: 6351

SEQ ID NO: 8922 - protein, 721 aa, Escherichia coli DEC10B
MDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQNLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 8923 - protein, 678 aa, Escherichia coli DEC10B; identical to SEQ ID NO: 6353

SEQ ID NO: 8924 - protein, 386 aa, Escherichia coli DEC10B; identical to SEQ ID NO: 7908

SEQ ID NO: 8925 - protein, 208 aa, Escherichia coli DEC10B; identical to SEQ ID NO: 5717

SEQ ID NO: 8926 - protein, 243 aa, Escherichia coli DEC10B; identical to SEQ ID NO: 6145

SEQ ID NO: 8927 - protein, 228 aa, Escherichia coli DEC10B; identical to SEQ ID NO: 6185

SEQ ID NO: 8928 - protein, 843 aa, Escherichia coli DEC10B; identical to SEQ ID NO: 7909

SEQ ID NO: 8929 - protein, 450 aa, Escherichia coli DEC10B
MNDDFSGEIKNEKPMKVLEKLSRLYHLTWYYDENILYIYKTNEISRSIITPTYLDIDSLLKYLRDTISVNKNSCNVRKITTFNSIEVRGVPECIKYITSLSESLDKEAQSKAKNKDVVRVFKLNYASATDITYKYRDQNVVVPGVVSILKTMASNGSLPSTGKGAVERNGNLFDNSVKISADPRLNAVVVKDREITMDIYRQLISELDIEQRQIEISVSIIDVDANDLQQLGVNWSGTLNAGQGSIAFNSSTAQANLSSSVISNANNFMIRVNALQQNSKAKILSQPSIITLNNMQAILDKNVTFYTKVSGEKVASLESITSGTLLRVTPRILDDNSNSLTGKRRERVRLLLDIQDGNQSTNQSNAQDASSILPEVQNSEMTTEATLSAGESLLLGGFIQDKESSSKDGIPLLSDIPVIGNLFSSTTKQKHSVVRLFLIKATPIKSASSE

SEQ ID NO: 8930 - protein, 446 aa, Escherichia coli DEC10B; identical to SEQ ID NO: 6459

SEQ ID NO: 8931 - protein, 478 aa, Escherichia coli DEC10B; identical to SEQ ID NO: 5711

SEQ ID NO: 8932 - protein, 774 aa, Escherichia coli DEC10B
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLSPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 8933 - protein, 368 aa, Escherichia coli DEC10C; identical to SEQ ID NO: 8795

SEQ ID NO: 8934 - protein, 241 aa, Escherichia coli DEC10C; identical to SEQ ID NO: 6143

SEQ ID NO: 8935 - protein, 856 aa, Escherichia coli DEC10C
MAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 8936 - protein, 784 aa, Escherichia coli DEC10C; identical to SEQ ID NO: 6283

SEQ ID NO: 8937 - protein, 170 aa, Escherichia coli DEC10C [sequence omitted]

SEQ ID NO: 8938 - protein, 161 aa, Escherichia coli DEC10C; identical to SEQ ID NO: 5769

SEQ ID NO: 8939 - protein, 765 aa, Escherichia coli DEC10C; identical to SEQ ID NO: 8790

SEQ ID NO: 8940 - protein, 230 aa, Escherichia coli DEC10C; identical to SEQ ID NO: 7855

SEQ ID NO: 8941 - protein, 747 aa, Escherichia coli DEC10C; identical to SEQ ID NO: 8792

SEQ ID NO: 8942 - protein, 266 aa, Escherichia coli DEC10C; identical to SEQ ID NO: 5772

SEQ ID NO: 8943 - protein, 222 aa, Escherichia coli DEC10C
MLIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRLIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 8944 - protein, 869 aa, Escherichia coli DEC10C; identical to SEQ ID NO: 8801

SEQ ID NO: 8945 - protein, 221 aa, Escherichia coli DEC10C; identical to SEQ ID NO: 8798

SEQ ID NO: 8946 - protein, 351 aa, Escherichia coli DEC10C; identical to SEQ ID NO: 8799

SEQ ID NO: 8947 - protein, 360 aa, Escherichia coli DEC10C; identical to SEQ ID NO: 8802

SEQ ID NO: 8948 - protein, 746 aa, Escherichia coli DEC10C; identical to SEQ ID NO: 8803

SEQ ID NO: 8949 - protein, 193 aa, Escherichia coli DEC10C; identical to SEQ ID NO: 6300

SEQ ID NO: 8950 - protein, 243 aa, Escherichia coli DEC10C; identical to SEQ ID NO: 8805

SEQ ID NO: 8951 - protein, 816 aa, Escherichia coli DEC10C; identical to SEQ ID NO: 8806

SEQ ID NO: 8952 - protein, 430 aa, Escherichia coli DEC10C; identical to SEQ ID NO: 5758

SEQ ID NO: 8953 - protein, 224 aa, Escherichia coli DEC10C; identical to SEQ ID NO: 7869

SEQ ID NO: 8954 - protein, 591 aa, Escherichia coli DEC10C; identical to SEQ ID NO: 7870

SEQ ID NO: 8955 - protein, 128 aa, Escherichia coli DEC10C; identical to SEQ ID NO: 7871

SEQ ID NO: 8956 - protein, 331 aa, Escherichia coli DEC10C; identical to SEQ ID NO: 6456

SEQ ID NO: 8957 - protein, 760 aa, Escherichia coli DEC10C; identical to SEQ ID NO: 6322

SEQ ID NO: 8958 - protein, 203 aa, Escherichia coli DEC10C; identical to SEQ ID NO: 6414

SEQ ID NO: 8959 - protein, 361 aa, Escherichia coli DEC10C; identical to SEQ ID NO: 7868

SEQ ID NO: 8960 - protein, 392 aa, Escherichia coli DEC10C
MAVKISGVLKDGTGKPVENCTIQLKARRTSSTVVVNTVASENPDEAGRYSMDVEYGQYSVILLVEGFPPSHAGTITVYEDSQPGTLNDFLGAMSEDDVRPEALRRFELMVEEVARHAEEAKKNAGEAETSARNAGISASQAEESAANADTSAGEASESARQAAESAAAAKQSEEASSSSASAAAQKASESSQSAAEAELSRKTAESAAGNAARDATTATEKARESAESAQSAEQSRIAAEEAVNRIPTVVGPPGPKGEPGPAGPQGPKGDKGERGDTGPVGATGERGPAGDAGPAGPQGPKGDKGERGETGLTGNAGPQGPKGDTGAAGPAGPQGPKGETGSGWPGGGNRTSGTEGRPGGRHKYGSVWGRETLLRQTAMAGSRIQMAHSSPD

SEQ ID NO: 8961 - protein, 731 aa, Escherichia coli DEC10C
MRKKYMPRALGPLLLVVLSPAVAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLRQELVGQVYYRDESLRFYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLPLTKSVNVSDSKLEGVKVDSYELGWRFTGDNLRTQIAAYYSLSNKSVERNKDLTISVKDDRRRIYGVEGAVDYLIPDTDWSTGVNFNVLKTESKVNGQWQKYDVKESSPSKATAYISWAPEPWSLRVQSTTSFDVSDAEGNDINGYTTVDFISSWLLPVGTLSFSVENLFDRDYTTVWGQRAPLYYSPGYGPASLYDYKGRGRTFGLNYSVLF

SEQ ID NO: 8962 - protein, 232 aa, Escherichia coli DEC10C; identical to SEQ ID NO: 5747

SEQ ID NO: 8963 - protein, 729 aa, Escherichia coli DEC10C; identical to SEQ ID NO: 8894

SEQ ID NO: 8964 - protein, 210 aa, Escherichia coli DEC10C
MSRYALITALAMFLAGCVGQREPAPVEEVKPAPEQPAEPQQPVPTVPSVPTIPQQPGPIEHEDQTAPPAPHIRHYDWNGAMQPMVSKMLGADGVTAGSVLLVDSVNNRTNGSLNAAEATETLRNALANNGKFTLVSAQQLSMAKQQLGLSPQDSLGTRSKAIGIARNVGAHYVLYSSASGNVNAPTLQMQLMLVQTGEIIWSGKGAVSQQ

SEQ ID NO: 8965 - protein, 263 aa, Escherichia coli DEC10C
VNDAVANIPVPADGKSITPDDVRPMLEQMVKEAVSHIPAPRDGRDYDPEVLKQAVNDAVANIPVPADGKSITPDDVRPMLEQMVKEAVSHIPAPRDGRDYDPEVLKQAVLEAVNALPAPQDGRDATALEVLPAIDDQKSFPRGTYATHLGGLWRAYEKTHGMRGWECLVDGVADIDVSMTDERLFSVVIRQSSGQCTEKTFSLPVMLYRGVFRAGETYHPGDTVTWGGSLWHCNSMTGDKPGEAHSSGWTLAAKRGRDAGGGK

SEQ ID NO: 8966 - protein, 391 aa, Escherichia coli DEC10C
MAVKISGVLKDGTGKPVENCTIQLKARRTSSTVVVNTVASENPDEAGRYSMDVEYGQYSVILLVEGFPPSHAGTITVYEDSQPGTLNDFLGAMSEDDVRPEALRRFELMVEEAARHAEEAKKNAGEAETSARNAGISASQAEESAANADTSAGDASESARQAVESAAAAKQSEEASSSSASAAAQKASESSQSAAEAELSRKTAESAAGNAARDATTATEKARESAESAQSAEQSRIAAEEAVNRIPTVVGPPGPKGEPGPAGPQGPKGDKGERGDTGPAGATGERGPRGDTGPAGPQGPKGDRGERGETGLTGDAGPQGPKGDTGAAGPAGPQGPKGETGAAGPVGATGPQGPKGDPGETQIRFVWGRRALLRQTAMAGSRIQMAHSSPD

SEQ ID NO: 8967 - protein, 203 aa, Escherichia coli DEC10C; identical to SEQ ID NO: 6347

SEQ ID NO: 8968 - protein, 565 aa, Escherichia coli DEC10C; identical to SEQ ID NO: 6492

SEQ ID NO: 8969 - protein, 207 aa, Escherichia coli DEC10C; identical to SEQ ID NO: 5743

SEQ ID NO: 8970 - protein, 551 aa, Escherichia coli DEC10C; identical to SEQ ID NO: 5742

SEQ ID NO: 8971 - protein, 672 aa, Escherichia coli DEC10C
MIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRQNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 8972 - protein, 113 aa, Escherichia coli DEC10C
MEKDQKNENTLQLAIISRIKMFYRPTNLAMAPEEAPAMLRFRRSGSKLTLINPTPYFITVTNMKAGNSNLPNTMVPPKGEVSVDITHAATGDISFQTINDYGALTPRIKATMQ

SEQ ID NO: 8973 - protein, 111 aa, Escherichia coli DEC10C; identical to SEQ ID NO: 7885

SEQ ID NO: 8974 - protein, 673 aa, Escherichia coli DEC10C; identical to SEQ ID NO: 8833

SEQ ID NO: 8975 - protein, 118 aa, Escherichia coli DEC10C [sequence omitted]

SEQ ID NO: 8976 - protein, 826 aa, Escherichia coli DEC10C; identical to SEQ ID NO: 8836

SEQ ID NO: 8977 - protein, 224 aa, Escherichia coli DEC10C; identical to SEQ ID NO: 6435

SEQ ID NO: 8978 - protein, 631 aa, Escherichia coli DEC10C; identical to SEQ ID NO: 6430

SEQ ID NO: 8979 - protein, 162 aa, Escherichia coli DEC10C; identical to SEQ ID NO: 5896

SEQ ID NO: 8980 - protein, 363 aa, Escherichia coli DEC10C; identical to SEQ ID NO: 7893

SEQ ID NO: 8981 - protein, 881 aa, Escherichia coli DEC10C; identical to SEQ ID NO: 8916

SEQ ID NO: 8982 - protein, 89 aa, Escherichia coli DEC10C; identical to SEQ ID NO: 6232

SEQ ID NO: 8983 - protein, 200 aa, Escherichia coli DEC10C; identical to SEQ ID NO: 6311

SEQ ID NO: 8984 - protein, 274 aa, Escherichia coli DEC10C; identical to SEQ ID NO: 7895

SEQ ID NO: 8985 - protein, 250 aa, Escherichia coli DEC10C; identical to SEQ ID NO: 8842

SEQ ID NO: 8986 - protein, 518 aa, Escherichia coli DEC10C; identical to SEQ ID NO: 6358

SEQ ID NO: 8987 - protein, 432 aa, Escherichia coli DEC10C; identical to SEQ ID NO: 5727

SEQ ID NO: 8988 - protein, 351 aa, Escherichia coli DEC10C
MIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 8989 - protein, 669 aa, Escherichia coli DEC10C
MIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRNVLKRDKWGLAGQLRELKESNLILNSLLLTPLGESHLVTVGGEYQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPDLKPEESVSYEAGVYYDNPAGLNANITGFMTDFSNKIVSYSINDNTNSYINSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKVTDALTLNAAVNNLLNKDYSDVSLYSAGKSTLYAGDYFQTGSSTTGYVIPERNYWMSLNYQF

SEQ ID NO: 8990 - protein, 822 aa, Escherichia coli DEC10C
MIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEEAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 8991 - protein, 231 aa, Escherichia coli DEC10C
MSSIAWGAIIPDRTRIIMNESDKGEALKLTNQSKNLPYLAQTWIEDTKGNKSRDFIVTVPPMVRLNPSEQIQIRMISQEKIAQLPNDRETLFYFNVREIPPKTDKKNVMQVTMQHALKLFWRPKAIELEDDGVMSYEKVEIIRRNDGSIRFNNKMPYHVTLGYIGTNGITMLPQTQSLMVTPYSHADTQFKNVPSAFQVGYINDFGGLSFYEINCPTVNNSCNVSVAKRDK

SEQ ID NO: 8992 - protein, 231 aa, Escherichia coli DEC10C; identical to SEQ ID NO: 6351

SEQ ID NO: 8993 - protein, 823 aa, Escherichia coli DEC10C
MALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQNLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 8994 - protein, 678 aa, Escherichia coli DEC10C; identical to SEQ ID NO: 6353

SEQ ID NO: 8995 - protein, 386 aa, Escherichia coli DEC10C; identical to SEQ ID NO: 7908

SEQ ID NO: 8996 - protein, 208 aa, Escherichia coli DEC10C; identical to SEQ ID NO: 5717

SEQ ID NO: 8997 - protein, 840 aa, Escherichia coli DEC10C
MHLPLYHYRAHFSFSLLALTIASSLPAYGGKFNPKFLENVQGIDQHIDLSVYDSPVGQQIPGKYRVSVFVNEEKMASRTLDFSTASEAKRKASGESLMPCLSRVQLEEMGVRVDSFPALKMSPPEACVAFDEIIPQATSRFDFNTQTLHLSFPQAAMMMTARGTVDPSRWDEGIPALLLDYSFSGSNGRNEGTGSSSDSTSDSYYLNLRSGLNVGPWRLRNNSIWNRTDGKNQWDNVGTSLNRAIIPLKSQITLGDTATPGEIFDSVQMRGALLASDDEMLPDSQRGFAPVVRGIAKSNAEVSIEQNGYVIYRTFVQPGAFEINDLYATSGSGDLTVIIKEADGSEQRFIQPFSAVAIFQREGYLKYSLAAGEYRAGNYDSDKPHFGQFTAMYGLPWGMTAYGGALLSADYNALALGLGKNFGTIGAVSVDVTQAKSQLRNNEKEEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSVAYTWTRSPEWEEDDRLWSFSVSIPLGGAWSSYRMTTDQNGKTSQQASVSGTLLEDRNLSYNVQQGYTSNGVGYSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNVELQEAFQKVVPTRGAVVRSRFDTRVGYRVLMSLKQANGNAVPFGATAALIDESKPASSIVGEEGQLYISGMPEEGELQVSWGNEQAQRCRVPFRLPENKDNAAIVMVNAVCEK

SEQ ID NO: 8998 - protein, 614 aa, Escherichia coli DEC10C; identical to SEQ ID NO: 6303

SEQ ID NO: 8999 - protein, 243 aa, Escherichia coli DEC10C; identical to SEQ ID NO: 6145

SEQ ID NO: 9000 - protein, 514 aa, Escherichia coli DEC10C
MCNEKNKFFIFTALFCCSAQAAPSSLEKRLGKNEYFIITKSSPVRAILNDFAANYSIPVFISNSVNDDFSGEIKNEKPMKVLEKLSRLYHLTWYYDENILYIYKTNEISRSIITPTYLDIDSLLKYLRDTISVNKNSCNVRKITTFNSIEVRGVPECIKYITSLSESLDKEAQSKAKNKDVVRVFKLNYASATDITYKYRDQNVVVPGVVSILKTMASNGSLPSTGKGAVERNGNLFDNSVKISADPRLNAVVVKDREITMDIYRQLISELDIEQRQIEISVSIIDVDANDLQQLGVNWSGTLNAGQGSIAFNSSTAQANLSSSVISNANNFMIRVNALQQNSKAKILSQPSIITLNNMQAILDKNVTFYTKVSGEKVASLESITSGTLLRVTPRILDDNSNSLTGKRRERVRLLLDIQDGNQSTNQSNAQDASSILPEVQNSEMTTEATLSAGESLLLGGFIQDKESSSKDGIPLLSDIPVIGNLFSSTTKQKHSVVRLFLIKATPIKSASSE

SEQ ID NO: 9001 - protein, 445 aa, Escherichia coli DEC10C
MITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYNGDSKVNPNYGKAVPADFNGGSFGRGDSDEWTFGAQMEIWW

SEQ ID NO: 9002 - protein, 237 aa, Escherichia coli DEC10C
MRKITQAISAVCLLFALNSSAVALASSPSPLNPGTNVARLAEQAPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPATNMNPVIFAGDKLGQNTKSQWLQDKNIRIFYGDSDNDITAARDVGARGIRILRASNSTYKPLPQAGAFGEEVIVNSEY

SEQ ID NO: 9003 - protein, 478 aa, Escherichia coli DEC10C; identical to SEQ ID NO: 8858

SEQ ID NO: 9004 - protein, 774 aa, Escherichia coli DEC10C; identical to SEQ ID NO: 8932

SEQ ID NO: 9005 - protein, 866 aa, Escherichia coli DEC10D; identical to SEQ ID NO: 7345

SEQ ID NO: 9006 - protein, 246 aa, Escherichia coli DEC10D; identical to SEQ ID NO: 6342

SEQ ID NO: 9007 - protein, 747 aa, Escherichia coli DEC10D; identical to SEQ ID NO: 8792

SEQ ID NO: 9008 - protein, 266 aa, Escherichia coli DEC10D; identical to SEQ ID NO: 5772

SEQ ID NO: 9009 - protein, 161 aa, Escherichia coli DEC10D; identical to SEQ ID NO: 5769

SEQ ID NO: 9010 - protein, 221 aa, Escherichia coli DEC10D; identical to SEQ ID NO: 8798

SEQ ID NO: 9011 - protein, 351 aa, Escherichia coli DEC10D; identical to SEQ ID NO: 8799

SEQ ID NO: 9012 - protein, 230 aa, Escherichia coli DEC10D; identical to SEQ ID NO: 7861

SEQ ID NO: 9013 - protein, 593 aa, Escherichia coli DEC10D
MYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGTVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGRKPVPFGSLVRENSTGITSMVGDDGQVYLSGAPLSGELLVQWGDGANSRCIAHYVLPKQSLQQAVTVISAVCTHPGS

SEQ ID NO: 9014 - protein, 360 aa, Escherichia coli DEC10D; identical to SEQ ID NO: 8802

SEQ ID NO: 9015 - protein, 746 aa, Escherichia coli DEC10D; identical to SEQ ID NO: 8803

SEQ ID NO: 9016 - protein, 193 aa, Escherichia coli DEC10D; identical to SEQ ID NO: 6300

SEQ ID NO: 9017 - protein, 243 aa, Escherichia coli DEC10D; identical to SEQ ID NO: 8805

SEQ ID NO: 9018 - protein, 816 aa, Escherichia coli DEC10D; identical to SEQ ID NO: 8806

SEQ ID NO: 9019 - protein, 430 aa, Escherichia coli DEC10D; identical to SEQ ID NO: 5758

SEQ ID NO: 9020 - protein, 361 aa, Escherichia coli DEC10D; identical to SEQ ID NO: 7868

SEQ ID NO: 9021 - protein, 224 aa, Escherichia coli DEC10D; identical to SEQ ID NO: 7869

SEQ ID NO: 9022 - protein, 591 aa, Escherichia coli DEC10D; identical to SEQ ID NO: 7870

SEQ ID NO: 9023 - protein, 130 aa, Escherichia coli DEC10D; identical to SEQ ID NO: 8814

SEQ ID NO: 9024 - protein, 331 aa, Escherichia coli DEC10D; identical to SEQ ID NO: 6456

SEQ ID NO: 9025 - protein, 760 aa, Escherichia coli DEC10D
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPTGVAKGSPVTTVDTAKSGNLVNWKVGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 9026 - protein, 203 aa, Escherichia coli DEC10D; identical to SEQ ID NO: 6414

SEQ ID NO: 9027 - protein, 191 aa, Escherichia coli DEC10D; identical to SEQ ID NO: 5748

SEQ ID NO: 9028 - protein, 232 aa, Escherichia coli DEC10D; identical to SEQ ID NO: 5747

SEQ ID NO: 9029 - protein, 729 aa, Escherichia coli DEC10D; identical to SEQ ID NO: 8894

SEQ ID NO: 9030 - protein, 213 aa, Escherichia coli DEC10D; identical to SEQ ID NO: 5744

SEQ ID NO: 9031 - protein, 203 aa, Escherichia coli DEC10D; identical to SEQ ID NO: 6347

SEQ ID NO: 9032 - protein, 565 aa, Escherichia coli DEC10D; identical to SEQ ID NO: 6492

SEQ ID NO: 9033 - protein, 207 aa, Escherichia coli DEC10D; identical to SEQ ID NO: 5743

SEQ ID NO: 9034 - protein, 539 aa, Escherichia coli DEC10D; identical to SEQ ID NO: 6525

SEQ ID NO: 9035 - protein, 700 aa, Escherichia coli DEC10D; identical to SEQ ID NO: 7945

SEQ ID NO: 9036 - protein, 236 aa, Escherichia coli DEC10D; identical to SEQ ID NO: 6472

SEQ ID NO: 9037 - protein, 111 aa, Escherichia coli DEC10D; identical to SEQ ID NO: 7885

SEQ ID NO: 9038 - protein, 118 aa, Escherichia coli DEC10D [sequence omitted]

SEQ ID NO: 9039 - protein, 673 aa, Escherichia coli DEC10D; identical to SEQ ID NO: 8833

SEQ ID NO: 9040 - protein, 826 aa, Escherichia coli DEC10D; identical to SEQ ID NO: 8836

SEQ ID NO: 9041 - protein, 224 aa, Escherichia coli DEC10D; identical to SEQ ID NO: 6435

SEQ ID NO: 9042 - protein, 650 aa, Escherichia coli DEC10D
MSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 9043 - protein, 162 aa, Escherichia coli DEC10D; identical to SEQ ID NO: 5896

SEQ ID NO: 9044 - protein, 363 aa, Escherichia coli DEC10D; identical to SEQ ID NO: 7893

SEQ ID NO: 9045 - protein, 200 aa, Escherichia coli DEC10D; identical to SEQ ID NO: 6311

SEQ ID NO: 9046 - protein, 274 aa, Escherichia coli DEC10D; identical to SEQ ID NO: 7895

SEQ ID NO: 9047 - protein, 250 aa, Escherichia coli DEC10D; identical to SEQ ID NO: 8842

SEQ ID NO: 9048 - protein, 518 aa, Escherichia coli DEC10D; identical to SEQ ID NO: 6358

SEQ ID NO: 9049 - protein, 353 aa, Escherichia coli DEC10D
MTERELSIIRALGEEFSTVLADLQRTFEGKMAAQAQAFEEKLASLSAVLQKHVTVDEVHPVLQAMVDDAVGTIPVPRDGRDYDPDVLQQAVNDAVANIPVPADGKSITPDDVRPMLEQMVKEAVSHIPAPRDGRDYDPEVLKQAVNDAVANIPVPADGKSITPDDVRPMLEQMVKEAVSHIPAPRDGRDYDPEVLKQAVLEAVNALPAPQDGRDATALEVLPAIDDQKSFPRGTYATHLGGLWRAYEKTHGMRGWECLVDGVADIDVSMTDERLFSVVIRQSSGQCTEKTFSLPVMLYRGVFRAGETYHPGDTVTWGGSLWHCNSMTGDKPGEAHSSGWTLAAKRGRDAGGGK

SEQ ID NO: 9050 - protein, 432 aa, Escherichia coli DEC10D; identical to SEQ ID NO: 5727

SEQ ID NO: 9051 - protein, 359 aa, Escherichia coli DEC10D; identical to SEQ ID NO: 5847

SEQ ID NO: 9052 - protein, 669 aa, Escherichia coli DEC10D; identical to SEQ ID NO: 8989

SEQ ID NO: 9053 - protein, 696 aa, Escherichia coli DEC10D
MQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 9054 - protein, 125 aa, Escherichia coli DEC10D; identical to SEQ ID NO: 7904

SEQ ID NO: 9055 - protein, 231 aa, Escherichia coli DEC10D; identical to SEQ ID NO: 6351

SEQ ID NO: 9056 - protein, 721 aa, Escherichia coli DEC10D; identical to SEQ ID NO: 8922

SEQ ID NO: 9057 - protein, 678 aa, Escherichia coli DEC10D; identical to SEQ ID NO: 6353

SEQ ID NO: 9058 - protein, 843 aa, Escherichia coli DEC10D; identical to SEQ ID NO: 7909

SEQ ID NO: 9059 - protein, 208 aa, Escherichia coli DEC10D; identical to SEQ ID NO: 5717

SEQ ID NO: 9060 - protein, 130 aa, Escherichia coli DEC10D
MPDDRESVFWLNIKNIPPSASNKATNSLEIAVKTRIKLFWRPANIRLIPEDAAPKVKWRREGRNLIAENPNPIHISVMDVIVDGHDVPLNMIRPFETLTLPLPANSAGGQMTWRFINDYGAVSDPIKMTL

SEQ ID NO: 9061 - protein, 614 aa, Escherichia coli DEC10D; identical to SEQ ID NO: 6303

SEQ ID NO: 9062 - protein, 386 aa, Escherichia coli DEC10D; identical to SEQ ID NO: 7908

SEQ ID NO: 9063 - protein, 446 aa, Escherichia coli DEC10D; identical to SEQ ID NO: 6459

SEQ ID NO: 9064 - protein, 237 aa, Escherichia coli DEC10D; identical to SEQ ID NO: 9002

SEQ ID NO: 9065 - protein, 514 aa, Escherichia coli DEC10D; identical to SEQ ID NO: 9000

SEQ ID NO: 9066 - protein, 774 aa, Escherichia coli DEC10D; identical to SEQ ID NO: 8932

SEQ ID NO: 9067 - protein, 650 aa, Escherichia coli DEC10D
MTVNKIKNIFNNATLTTKSAFNTASSSVRSAGKKLILLIPDNYEAQGVGINELVKAADELGIEIHRTERDDTAIANQFFGAAEKVVGLTERGVAIFAPQLDKLLQKYQKVGSKKGRTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGSLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAAFSLKKPELIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQSGKYEYMTSLIVNGKDTWSVKGIKNHKGVYDYSKLIQFVEKNNKHYQARMISELGDKDDVVYSGAGSSEVFAGEGHDTVSYNKTDVGKLTIDATGASNLVSI

SEQ ID NO: 9068 - protein, 784 aa, Escherichia coli DEC10D; identical to SEQ ID NO: 6283

SEQ ID NO: 9069 - protein, 170 aa, Escherichia coli DEC10D [sequence omitted]

SEQ ID NO: 9070 - protein, 368 aa, Escherichia coli DEC10D; identical to SEQ ID NO: 8795

SEQ ID NO: 9071 - protein, 241 aa, Escherichia coli DEC10D; identical to SEQ ID NO: 6143

SEQ ID NO: 9072 - protein, 863 aa, Escherichia coli DEC10D; identical to SEQ ID NO: 8863

SEQ ID NO: 9073 - protein, 784 aa, Escherichia coli DEC10E; identical to SEQ ID NO: 6283

SEQ ID NO: 9074 - protein, 170 aa, Escherichia coli DEC10E [sequence omitted]

SEQ ID NO: 9075 - protein, 765 aa, Escherichia coli DEC10E
MQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKAYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEKGNVIGNVGQGGQAFVRGIEQQGNISIKWLEESKPVSCLAHYQQSSEAEKIAQSIILNGIRCQIQ

SEQ ID NO: 9076 - protein, 230 aa, Escherichia coli DEC10E; identical to SEQ ID NO: 7855

SEQ ID NO: 9077 - protein, 747 aa, Escherichia coli DEC10E; identical to SEQ ID NO: 6343

SEQ ID NO: 9078 - protein, 266 aa, Escherichia coli DEC10E
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLQDQYAQLKAQYADKPKKRVFLQFGINPPFTSGKESIQNQVLEVCGGENIFKDSRVPWPQVSREQVLARSPQAIVITGGPDQIPKIKQYWGEQLKIPVIPLTSDWFERASPRIILAAQQLCNALSQVD

SEQ ID NO: 9079 - protein, 161 aa, Escherichia coli DEC10E; identical to SEQ ID NO: 5769

SEQ ID NO: 9080 - protein, 351 aa, Escherichia coli DEC10E
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAESWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 9081 - protein, 230 aa, Escherichia coli DEC10E; identical to SEQ ID NO: 6294

SEQ ID NO: 9082 - protein, 869 aa, Escherichia coli DEC10E
MKIPTTTDIPQRYTWCLAGICYSSLAILPSFLSYAESYFNPAFLLENGTSVADLSRFERGNHQPARVYRVDLWRNDEFIGSQDIVFESTTENTGDKSGGLMPCFNQVLLERIGLNSSAFPELAQQQNNKCINLLKAVPDATINFDFAAMRLNITIPQITLLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDELIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQATYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 9083 - protein, 365 aa, Escherichia coli DEC10E; identical to SEQ ID NO: 7354

SEQ ID NO: 9084 - protein, 746 aa, Escherichia coli DEC10E
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQDHQSARAGTYATTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTNF

SEQ ID NO: 9085 - protein, 193 aa, Escherichia coli DEC10E; identical to SEQ ID NO: 6300

SEQ ID NO: 9086 - protein, 331 aa, Escherichia coli DEC10E; identical to SEQ ID NO: 6456

SEQ ID NO: 9087 - protein, 760 aa, Escherichia coli DEC10E
MENNRNFPARQFNSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 9088 - protein, 207 aa, Escherichia coli DEC10E
MRNNDEKIAITCALLSSLVASSVWADAASDLKSRLDKVSSFHASFTQKVTDGSGAAVQEGQGDLWVKRPNLFNWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKSQQNGAVDAAKFTFTPPQGVTVDDQRK

SEQ ID NO: 9089 - protein, 361 aa, Escherichia coli DEC10E
MKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGNGKKAEQWATGLKYDANNIYLAANYGETRNATPINNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 9090 - protein, 224 aa, Escherichia coli DEC10E; identical to SEQ ID NO: 7869

SEQ ID NO: 9091 - protein, 591 aa, Escherichia coli DEC10E; identical to SEQ ID NO: 7870

SEQ ID NO: 9092 - protein, 130 aa, Escherichia coli DEC10E; identical to SEQ ID NO: 8814

SEQ ID NO: 9093 - protein, 232 aa, Escherichia coli DEC10E; identical to SEQ ID NO: 5747

SEQ ID NO: 9094 - protein, 729 aa, Escherichia coli DEC10E; identical to SEQ ID NO: 5745

SEQ ID NO: 9095 - protein, 213 aa, Escherichia coli DEC10E; identical to SEQ ID NO: 5744

SEQ ID NO: 9096 - protein, 203 aa, Escherichia coli DEC10E; identical to SEQ ID NO: 6347

SEQ ID NO: 9097 - protein, 565 aa, Escherichia coli DEC10E
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPHQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFDWTNGVTLKMLDLICPKEQPCDNVPATRPTVKSATTQPSTKEAQPTP

SEQ ID NO: 9098 - protein, 207 aa, Escherichia coli DEC10E; identical to SEQ ID NO: 5743

SEQ ID NO: 9099 - protein, 539 aa, Escherichia coli DEC10E
MAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIGPVITLSSGEAKQIEILYIEPIDGYRIQFDWYPTSDSTDPVDMRMYLRCQGDAISETWLYQYFPPAPDKRQYVDDRVMS

SEQ ID NO: 9100 - protein, 700 aa, Escherichia coli DEC10E; identical to SEQ ID NO: 7945

SEQ ID NO: 9101 - protein, 243 aa, Escherichia coli DEC10E; identical to SEQ ID NO: 8324

SEQ ID NO: 9102 - protein, 816 aa, Escherichia coli DEC10E; identical to SEQ ID NO: 8325

SEQ ID NO: 9103 - protein, 430 aa, Escherichia coli DEC10E; identical to SEQ ID NO: 5758

SEQ ID NO: 9104 - protein, 236 aa, Escherichia coli DEC10E
MQTTRTPYSISFMATVLLLLLFACHSTVANAAVALGATRVIYPANQKQVLLPVTNNDPASVYLIQSWIENSGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDIPHAATGDISFQTINDYGALTPRIKATMQ

SEQ ID NO: 9105 - protein, 111 aa, Escherichia coli DEC10E; identical to SEQ ID NO: 7885

SEQ ID NO: 9106 - protein, 118 aa, Escherichia coli DEC10E [sequence omitted]

SEQ ID NO: 9107 - protein, 387 aa, Escherichia coli DEC10E
MKRKVLAMLVPALLVAGAANAAEIYNKNGNKLDLYGKVDARHTFSDNPGDDGDETIIELGFKGETQITDQLTGYGQALTKTKASDTEGSDNTYVKLAFAGLKFGEMGSFDYGRNYGVIYDVEAWTDMLPVFGGDFYTWTDNFMAGRANGVATYRNSDFFGLVEGLNFALQYQGNNEGSNAGEDQEGTKNGHEDVRFQNGDGFGLSTSYDFDFGLSLGAAYSNSDRTNSQVALGGYHYNEYSKFAGGDTAEAWTFGAKYDANNVYLAMMYAETRNMTPYGNVGIANKTQNFEAVAQYQFDFGLRPSLAYVYSKGKDLGGNDYNNNGHQEYVDQDLVNYVEIGATYYFNKNFSTYVDYKINLLDKDDDFYDNNGIATDDVVGVGLVYQF

SEQ ID NO: 9108 - protein, 826 aa, Escherichia coli DEC10E
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKHSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLTFGYEVNDIHGHNIGVVGQGSQLFIRTNEIPPSVNVAIDKQQGLSCTITFGKEIDESRNYICQ

SEQ ID NO: 9109 - protein, 224 aa, Escherichia coli DEC10E; identical to SEQ ID NO: 6435

SEQ ID NO: 9110 - protein, 641 aa, Escherichia coli DEC10E; identical to SEQ ID NO: 7954

SEQ ID NO: 9111 - protein, 162 aa, Escherichia coli DEC10E; identical to SEQ ID NO: 6365

SEQ ID NO: 9112 - protein, 367 aa, Escherichia coli DEC10E; identical to SEQ ID NO: 5796

SEQ ID NO: 9113 - protein, 200 aa, Escherichia coli DEC10E; identical to SEQ ID NO: 6311

SEQ ID NO: 9114 - protein, 274 aa, Escherichia coli DEC10E
MNKTAIALLALLASSASLAATPWQKITQPVPGSAQSIGSFSNGCIVGADTLPIQSEHYQVMRTDQRRYFGHPDLVMFIQRLSSQVSNLGMGTVLIGDMGMPAGGRFNGGHASHQTGLDVDIFLQLPKTRWTSAQLLRPQALDLVSRDGKHVVPTLWKSEIFSLIKLAAQDKDVTRIFVNPAIKQQLCLDAGTDRDWLRKVRPWFQHRAHMHVRLRCPADSLECEDQPLPPPGDGCGAELQSWFAPPKPGTTKPEKKTPPPLPPSCQALLDEHVI

SEQ ID NO: 9115 - protein, 250 aa, Escherichia coli DEC10E; identical to SEQ ID NO: 6317

SEQ ID NO: 9116 - protein, 880 aa, Escherichia coli DEC10E; identical to SEQ ID NO: 6482

SEQ ID NO: 9117 - protein, 518 aa, Escherichia coli DEC10E; identical to SEQ ID NO: 6358

SEQ ID NO: 9118 - protein, 432 aa, Escherichia coli DEC10E; identical to SEQ ID NO: 5727

SEQ ID NO: 9119 - protein, 359 aa, Escherichia coli DEC10E; identical to SEQ ID NO: 6332

SEQ ID NO: 9120 - protein, 523 aa, Escherichia coli DEC10E; identical to SEQ ID NO: 7963

SEQ ID NO: 9121 - protein, 822 aa, Escherichia coli DEC10E; identical to SEQ ID NO: 7370

SEQ ID NO: 9122 - protein, 107 aa, Escherichia coli DEC10E
MSSIAWGAIIPDRTRIIMNESDKGEALKLTNQSKNLPYLAQTWIEDTKGNKSRDFIVTVPPMVRLNPSEQIQIRMISQEKIAQLPNDRETLFYFNVREIPPKTDKKM

SEQ ID NO: 9123 - protein, 231 aa, Escherichia coli DEC10E; identical to SEQ ID NO: 6351

SEQ ID NO: 9124 - protein, 721 aa, Escherichia coli DEC10E
MDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 9125 - protein, 678 aa, Escherichia coli DEC10E; identical to SEQ ID NO: 6353

SEQ ID NO: 9126 - protein, 386 aa, Escherichia coli DEC10E; identical to SEQ ID NO: 7908

SEQ ID NO: 9127 - protein, 843 aa, Escherichia coli DEC10E; identical to SEQ ID NO: 7909

SEQ ID NO: 9128 - protein, 208 aa, Escherichia coli DEC10E; identical to SEQ ID NO: 5717

SEQ ID NO: 9129 - protein, 243 aa, Escherichia coli DEC10E; identical to SEQ ID NO: 6145

SEQ ID NO: 9130 - protein, 408 aa, Escherichia coli DEC10E
MSGDSGGQSNGSPKSWAIGSLGRFGNEYSGWFDLQLKQRVYNENGKRVDAVVMMDGNVGQQYSTGWFGDNAGGENFMQFSDMYVTTKGFLPFAPEADFWVGKHGAPKIEIQMLDWKTQRTDAAAGVGLENWKVGPGKIDIALVREDVDDYDRSLQNKQQINTNTIDLRYKDIPLWDKATLMVSGRYVTANESASEKDNQDNNGYYDWKDTWMFGTSLTQKFDKGGFNEFSFLVANNSIASNFGRYAGASPFTTFNGRYYGDHTGGTAVRLTSQGEAYIGDHFIVANAIVYSFGNDIYSYETGAHSDFESIRAVVRPAYIWDQYNQTGVELGYFTQQNKDANSNKFNESGYKTTLFHTFKVNTSMLTSRPEIRFYATYIKALENELDGFTFEDNKDDQFAVGAQAEIWW

SEQ ID NO: 9131 - protein, 377 aa, Escherichia coli DEC10E
MRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 9132 - protein, 446 aa, Escherichia coli DEC10E; identical to SEQ ID NO: 6459

SEQ ID NO: 9133 - protein, 237 aa, Escherichia coli DEC10E; identical to SEQ ID NO: 6313

SEQ ID NO: 9134 - protein, 368 aa, Escherichia coli DEC10E
MNKTITALAIMMASFAANASVLPETPVPFKSSTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGESAGGKAVTDSVLISVKDNKVTVQN

SEQ ID NO: 9135 - protein, 241 aa, Escherichia coli DEC10E; identical to SEQ ID NO: 6143

SEQ ID NO: 9136 - protein, 878 aa, Escherichia coli DEC10E
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMLQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLALGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCIANYQLPPESQQQLLTQLSAECR

SEQ ID NO: 9137 - protein, 120 aa, Escherichia coli DEC10E
MNTVLSIQGASAPVKKKSFFSKFTRLNMLRLARAVIPAAVLMMFFPQLAMAAQGQDLMASGNTTVKATFGKDSSVVKWVVLAEVLVGAVMYMMTKNVKFLAGFAIISVFIAVGMAVVGLK

SEQ ID NO: 9138 - protein, 368 aa, Escherichia coli DEC10F; identical to SEQ ID NO: 7849

SEQ ID NO: 9139 - protein, 121 aa, Escherichia coli DEC10F
MNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 9140 - protein, 863 aa, Escherichia coli DEC10F
MHIRKHRLAGFFVRLFVACAFAAQTPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNRSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNVWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 9141 - protein, 784 aa, Escherichia coli DEC10F; identical to SEQ ID NO: 6283

SEQ ID NO: 9142 - protein, 170 aa, Escherichia coli DEC10F [sequence omitted]

SEQ ID NO: 9143 - protein, 866 aa, Escherichia coli DEC10F; identical to SEQ ID NO: 7345

SEQ ID NO: 9144 - protein, 230 aa, Escherichia coli DEC10F; identical to SEQ ID NO: 7855

SEQ ID NO: 9145 - protein, 747 aa, Escherichia coli DEC10F; identical to SEQ ID NO: 8868

SEQ ID NO: 9146 - protein, 266 aa, Escherichia coli DEC10F; identical to SEQ ID NO: 5772

SEQ ID NO: 9147 - protein, 161 aa, Escherichia coli DEC10F; identical to SEQ ID NO: 5769

SEQ ID NO: 9148 - protein, 221 aa, Escherichia coli DEC10F; identical to SEQ ID NO: 7859

SEQ ID NO: 9149 - protein, 351 aa, Escherichia coli DEC10F
MKKSTLALVVMGIVASASVQAAEIYNKDGNKLDVYGKVKAMHYMSDNASKDSDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNFYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 9150 - protein, 617 aa, Escherichia coli DEC10F
MHQVLIMPRFARLTIALGLATAVFPVDAEYYFNPRFLSNDLAESVDLSAFTKGREAPPGTYRVDIYLNDEFMTSRDITFIADDNNAELIPCLSTDLLVSLGIKKIALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSDKRFLLATFCALFTATLQAADVTITVNGRVVAKPCTIQTKEANVNLGDLYTRNLQQPGSASGWHNITLSLTDCPVETSAVTAIVTGSTDNTGYYKNEGTAENIQIELRDDQDAALKNGDSKTVIVDEITRNAQFPLKARAITVNGNASQGTIEALINVIYTWQ

SEQ ID NO: 9151 - protein, 236 aa, Escherichia coli DEC10F; identical to SEQ ID NO: 6472

SEQ ID NO: 9152 - protein, 230 aa, Escherichia coli DEC10F; identical to SEQ ID NO: 7861

SEQ ID NO: 9153 - protein, 869 aa, Escherichia coli DEC10F; identical to SEQ ID NO: 8801

SEQ ID NO: 9154 - protein, 360 aa, Escherichia coli DEC10F; identical to SEQ ID NO: 8802

SEQ ID NO: 9155 - protein, 746 aa, Escherichia coli DEC10F; identical to SEQ ID NO: 6296

SEQ ID NO: 9156 - protein, 193 aa, Escherichia coli DEC10F; identical to SEQ ID NO: 6300

SEQ ID NO: 9157 - protein, 243 aa, Escherichia coli DEC10F
MTFMKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPAPEKNSDHAVLQVAIQSRIKVFWRPAALRKKAGEKVELQLQVSQQGNQLTLKNPTAYYLTIAYLGRNEKGVLPGFKTVMVAPFSTVNTNIGNYSGSQFYLGYMDDYGALRMTTLNCSGQCHLQAVEAKK

SEQ ID NO: 9158 - protein, 816 aa, Escherichia coli DEC10F; identical to SEQ ID NO: 8806

SEQ ID NO: 9159 - protein, 430 aa, Escherichia coli DEC10F; identical to SEQ ID NO: 5758

SEQ ID NO: 9160 - protein, 331 aa, Escherichia coli DEC10F
MKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLSGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGNEAGHE

SEQ ID NO: 9161 - protein, 760 aa, Escherichia coli DEC10F; identical to SEQ ID NO: 6322

SEQ ID NO: 9162 - protein, 203 aa, Escherichia coli DEC10F; identical to SEQ ID NO: 6414

SEQ ID NO: 9163 - protein, 361 aa, Escherichia coli DEC10F; identical to SEQ ID NO: 7868

SEQ ID NO: 9164 - protein, 224 aa, Escherichia coli DEC10F; identical to SEQ ID NO: 7869

SEQ ID NO: 9165 - protein, 851 aa, Escherichia coli DEC10F
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYCYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGLPAQGAITVRWGEAPDQICHISYQLTEQQINSAITRMDAICR

SEQ ID NO: 9166 - protein, 226 aa, Escherichia coli DEC10F; identical to SEQ ID NO: 7934

SEQ ID NO: 9167 - protein, 405 aa, Escherichia coli DEC10F
MTERELSIIRALGEEFSTVLADLQRTFEGKMASQAQAFEEKLTSLSAVLQKHVTVDEVRPVLQAMVDDAVGAIPVPRDGRDYDPDVLQQAVNDAVANIPQPADGKSLTPDDVRPMLEQMVKEAVSHIPVPRDGRDYDPEVLQKAVNDAVANIPQPADGKSLTPDDVRPMLEQMVKEAVSHIPVPRDGRDYDPDVLQKAVNDAVANIPQPADGKSLTPDDVRPMLEQMVKEAVSHIHVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTEDKPGEAHSSAWTLAAKRGRDAGG

SEQ ID NO: 9168 - protein, 121 aa, Escherichia coli DEC10F; identical to SEQ ID NO: 6175

SEQ ID NO: 9169 - protein, 763 aa, Escherichia coli DEC10F
MPSVLKPGLALPAGQYYIDVVVNNENTGKARLIITPEEEKAGMLCLSSEWLKNANVPIRLDGYVGEYNEKAGCYQLARSPYTRVDFNYGNQALIFSVPQTNIISQTDPSRWDYGVNAFRLQYDGNVMGQSSSGTSANGSADLDINLGRWVLSSSMNGSRDSDGKTDFAVRDATLSTALSSVRGDLKLGKSWTRNDQFSDFGFYGVSLRSNSNMTPGEYRGYAPLISGVATTTSRITITQNGYTVYSRVVQPGPYELNDVRPVGNGDLEVTVEDASGRKTVTRYPVTTLPTLLRPGEVQYDFSVGRRSSGSDIGHPFTDGDKGVFWLGSLAYGLGSTTLSSATILHNRYRAGGITLTQSLGVLGAMSVGGSMSHAEYDNKEVKRGHSISAKYAKSFANTTNLHLMAYRYQSKGYVEFANFAPQDRYARYNQKSRYEMQVTQRLPWNANLGVSAWREDYWSQPGQAVGANLNTGFTLFDYVSFTVNAGFNRYPYKEKDDYTVSLSATVPFTVAGVRHYTSSSVSHSSVSGTQFRTSASAMPNDRLGYSVSAAASDKGARSASASMNYGFDAIQTNAGISQSRNNTSYNAGFSGSVVATAESGLLFTRDQSDTMGVVHIPDVPGVRFNGSPETNSKGYTVVGLSDYSQNRIDIDMENVPDNLDLDVTSYSVVPTEKAVVYREFRANYVKRYFLQVKDRQGRILNGGDAKTEQGLNAGFITRNGVLSMSLLSEPKEVKVSLDGGKTCRISMAGIKPGTERVQEVFCE

SEQ ID NO: 9170 - protein, 228 aa, Escherichia coli DEC10F
MVKWGLSALLAFTLSGQALAAFTVSGTRFIYGEGKKNISFEVTNNANDTYGGQVWVDNVSEGGGVYMVPTPPFFKVSPKQKQIVRIMKTDGGALPSDRESLFWLNIQEIPPKPKTDGNVLSVAINTRVKLFYRPKALMAGRKGAEKKIEVIRRNGTTYLKNPTPYYFAVAKVKVNGKDVALKSDEEQKLAILAPFGEVAVSQVPVTAKNISVDTINDWGGVENHVLKG

SEQ ID NO: 9171 - protein, 230 aa, Escherichia coli DEC10F; identical to SEQ ID NO: 5947

SEQ ID NO: 9172 - protein, 805 aa, Escherichia coli DEC10F; identical to SEQ ID NO: 6052

SEQ ID NO: 9173 - protein, 191 aa, Escherichia coli DEC10F; identical to SEQ ID NO: 5748

SEQ ID NO: 9174 - protein, 232 aa, Escherichia coli DEC10F; identical to SEQ ID NO: 5747

SEQ ID NO: 9175 - protein, 686 aa, Escherichia coli DEC10F
MIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQHIDVNSPTWGGLPRWNTDGSSNSYDRARSTAPDWAYNDKEINKVFMTLKQRFADTWQATLNATHSEVEFDSKMMYVDAYVNKADGMLIGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 9176 - protein, 213 aa, Escherichia coli DEC10F; identical to SEQ ID NO: 5744

SEQ ID NO: 9177 - protein, 539 aa, Escherichia coli DEC10F; identical to SEQ ID NO: 6525

SEQ ID NO: 9178 - protein, 700 aa, Escherichia coli DEC10F; identical to SEQ ID NO: 7945

SEQ ID NO: 9179 - protein, 111 aa, Escherichia coli DEC10F; identical to SEQ ID NO: 7885

SEQ ID NO: 9180 - protein, 118 aa, Escherichia coli DEC10F [sequence omitted]

SEQ ID NO: 9181 - protein, 673 aa, Escherichia coli DEC10F; identical to SEQ ID NO: 6170

SEQ ID NO: 9182 - protein, 826 aa, Escherichia coli DEC10F; identical to SEQ ID NO: 8836

SEQ ID NO: 9183 - protein, 224 aa, Escherichia coli DEC10F; identical to SEQ ID NO: 6435

SEQ ID NO: 9184 - protein, 631 aa, Escherichia coli DEC10F; identical to SEQ ID NO: 6430

SEQ ID NO: 9185 - protein, 162 aa, Escherichia coli DEC10F; identical to SEQ ID NO: 5896

SEQ ID NO: 9186 - protein, 363 aa, Escherichia coli DEC10F; identical to SEQ ID NO: 7893

SEQ ID NO: 9187 - protein, 200 aa, Escherichia coli DEC10F; identical to SEQ ID NO: 6311

SEQ ID NO: 9188 - protein, 274 aa, Escherichia coli DEC10F; identical to SEQ ID NO: 7895

SEQ ID NO: 9189 - protein, 250 aa, Escherichia coli DEC10F; identical to SEQ ID NO: 7896

SEQ ID NO: 9190 - protein, 881 aa, Escherichia coli DEC10F
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNRLPENAEATQSVVQATLTEGAIGYRKFAVISGQKAMAVLRLSDGSHPPFGAEVKNDNEQTVGLVDDDGNVYLAGVKPGEHMSVFWSGVAHCDINLPDPLPADLFNGLLLPCQHKGNVAPITSPAVKPAIQEQTQRVTPTEPPTSISVNQ

SEQ ID NO: 9191 - protein, 518 aa, Escherichia coli DEC10F
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKETKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLIYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 9192 - protein, 432 aa, Escherichia coli DEC10F; identical to SEQ ID NO: 5727

SEQ ID NO: 9193 - protein, 359 aa, Escherichia coli DEC10F; identical to SEQ ID NO: 5847

SEQ ID NO: 9194 - protein, 774 aa, Escherichia coli DEC10F; identical to SEQ ID NO: 7975

SEQ ID NO: 9195 - protein, 696 aa, Escherichia coli DEC10F; identical to SEQ ID NO: 6320

SEQ ID NO: 9196 - protein, 732 aa, Escherichia coli DEC10F; identical to SEQ ID NO: 8819

SEQ ID NO: 9197 - protein, 686 aa, Escherichia coli DEC10F; identical to SEQ ID NO: 6453

SEQ ID NO: 9198 - protein, 834 aa, Escherichia coli DEC10F
MYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEEAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTINEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 9199 - protein, 249 aa, Escherichia coli DEC10F; identical to SEQ ID NO: 6450

SEQ ID NO: 9200 - protein, 231 aa, Escherichia coli DEC10F; identical to SEQ ID NO: 6351

SEQ ID NO: 9201 - protein, 806 aa, Escherichia coli DEC10F
MLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQNLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 9202 - protein, 678 aa, Escherichia coli DEC10F
MVPSTFSRLKAARCLPVVLAALIFAGCGTHTPEQSTAYMQGTAQADSAFYLQQMQQSSDDTRINWQLLAIRALVKEGKTGQAVELFNQLPQELNDSQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPAPVSTPAATTTAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGTPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 9203 - protein, 386 aa, Escherichia coli DEC10F; identical to SEQ ID NO: 7908

SEQ ID NO: 9204 - protein, 208 aa, Escherichia coli DEC10F; identical to SEQ ID NO: 5717

SEQ ID NO: 9205 - protein, 130 aa, Escherichia coli DEC10F; identical to SEQ ID NO: 9060

SEQ ID NO: 9206 - protein, 228 aa, Escherichia coli DEC10F; identical to SEQ ID NO: 6185

SEQ ID NO: 9207 - protein, 843 aa, Escherichia coli DEC10F; identical to SEQ ID NO: 7909

SEQ ID NO: 9208 - protein, 614 aa, Escherichia coli DEC10F; identical to SEQ ID NO: 6303

SEQ ID NO: 9209 - protein, 450 aa, Escherichia coli DEC10F; identical to SEQ ID NO: 8929

SEQ ID NO: 9210 - protein, 446 aa, Escherichia coli DEC10F; identical to SEQ ID NO: 6459

SEQ ID NO: 9211 - protein, 478 aa, Escherichia coli DEC10F; identical to SEQ ID NO: 5711

SEQ ID NO: 9212 - protein, 276 aa, Escherichia coli DEC10F
MTLIEFLMRRNSIFGLHLLVPGILVLSGQELLRRTLIFHLNGTNTTFMKKLLIALLYLCLLPDTLAGIRLNKTRVIMNEDESSGSITFVNTGEDNYLVQAYILDTEKNVTSDDFLVVPPVFRSDGGRNNVLKILKRKEPVVKDRESVYKLVFNAIPGTTRTSEKDRAKVSFSLGFVIKMFYRPDALKSAPDEAYGKLSFLNRDNGIVQIYNDSEYNLSFSELKFDNKSIDINKQPSMIRPFDSVFIKVDRVPSKVLWKFINDYGGETPEYLYTFKR

SEQ ID NO: 9213 - protein, 249 aa, Escherichia coli DEC10F
MRMVWNRFVCCLTLWIIVIYSLLTSFAHADGGISLDTTRVVYHANGKYATLRVRNSDEKSSYLIQPSVSGSLDENNQQSLDFVVSPSLFRPGKISEGVIKIMVVAPERMKKDRESLYWVNVKAIPASSKGDLNSDFNQVSGGVKIAVGNTIKLLFRPEGLAGTPQEGARNLRFTREKSGKLKVINNSPFYISIGALKVNGATVKSKNMMMVAPFSGFIFDDVPLSSEVKNVSWKAINDNGGLDEYFYKK

SEQ ID NO: 9214 - protein, 121 aa, Escherichia coli DEC11A; identical to SEQ ID NO: 5676

SEQ ID NO: 9215 - protein, 258 aa, Escherichia coli DEC11A
MNKRSAVTKFFTNRVTKVLGMTLALMMASQSAMASLAADQTRYVFRGDKDALTITVTNNDKTHTFGGQAWVDNIVEKDTRPTFVVTPSFFKVKPNGQQTLRIIMASDHLPKDKESVYWLNLQDIPPALEGSGLAIALRTKLKLFYRPKALLEGRKGAEEGISLQSRPDGRTMLVNTTPYIYAIGGLLDANGKKITTDSETTQKLLMFMPGDEVQVKGNVVKVESLDDYGDLKTWTINQKKSTAGTNVDENVQPQKSAA

SEQ ID NO: 9216 - protein, 787 aa, Escherichia coli DEC11A
MAALESGASYAGEKLDMSFIQGGAGTNPDVWAALNSNYAPGRYLVELSLNGKILGKHILDVTPEDSNELCLTEEWLTKAGVYISTDYFREGYDATRKCYALSKAQAVKVDFDVSTQSLVLTIPQKGLVKVPENVDWDYGTSAFRVNYSANANTGRHNTSAFGSADLKANIGHWVVSSSATASTGDSGDNNASINMFTATRAIRSLSADLAVGKTSTGDSLLGSTGTYGISLSRNNSMKPGNLGYSPVFSGIANGPSRVTLIQNGRILHSEMVPAGPFSITDVQLYTSGDVTMKITGEDGREQTQVFPLSVVNGQLNPGQHEFNIAAGLPDDDSHLKGGVFAASYGYGLNNLTLRAGGVFNHDWLGGSAGVVAGLSYLGAVSVDGAYATAKYRDGNHAGNKVQVAWNKQLEITNTGLRVSWAHQSEEYEDMSSFDPSKLWGEENHGRHTKDEWNMGISQPVGGLFNLSVSGWQRSYYPISGAGYSSLYSDGKDTGLTGTLSTQIKGVSLNFGVSGSRNSQGNDNWSASASVSVPFTLFDRRYSSSTSVSTSKSGGVAFSTGVSGSLNDRFSYGLGGGRDGDGGASGYFNASYSGDRAYLSGALNYSQSGGTSGSVSASGSVLAVPAARDIMFSRTSADTVAVVNVKNTPGVKVMSGNGETDKDGNLVVPLNSYDWNTVTVDAGTLPLDTELGNTSQKVVPTDKAVVWMPFDALKVHRYLLQVKQRNGEFVPGGTWARDSKKTPLGFVANNGVLMINAVDAPGDITLGQCRIPATKLRDTEKLQEITCE

SEQ ID NO: 9217 - protein, 747 aa, Escherichia coli DEC11A; identical to SEQ ID NO: 6343

SEQ ID NO: 9218 - protein, 266 aa, Escherichia coli DEC11A; identical to SEQ ID NO: 5772

SEQ ID NO: 9219 - protein, 161 aa, Escherichia coli DEC11A; identical to SEQ ID NO: 5769

SEQ ID NO: 9220 - protein, 351 aa, Escherichia coli DEC11A; identical to SEQ ID NO: 5767

SEQ ID NO: 9221 - protein, 230 aa, Escherichia coli DEC11A; identical to SEQ ID NO: 6294

SEQ ID NO: 9222 - protein, 820 aa, Escherichia coli DEC11A
MKIPTTTDIPQRYTWCLAGICYSSLAILLSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQITLLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYATLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSIGITSMWVMTGKFI

SEQ ID NO: 9223 - protein, 746 aa, Escherichia coli DEC11A
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYVTTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 9224 - protein, 193 aa, Escherichia coli DEC11A; identical to SEQ ID NO: 6300

SEQ ID NO: 9225 - protein, 243 aa, Escherichia coli DEC11A; identical to SEQ ID NO: 6463

SEQ ID NO: 9226 - protein, 659 aa, Escherichia coli DEC11A
MDYNLFASSYRPQDGSSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 9227 - protein, 430 aa, Escherichia coli DEC11A; identical to SEQ ID NO: 5758

SEQ ID NO: 9228 - protein, 331 aa, Escherichia coli DEC11A
MKKPVVIGLAVVVLAAVVAGGYWWYQSRQDNGLTLYGNVDIRTVNLSFRVGGRVESLAVDEGDAIKAGQVLGELDHKPYEIALMQAKAGVSVALAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGNEAGHE

SEQ ID NO: 9229 - protein, 659 aa, Escherichia coli DEC11A
MRFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 9230 - protein, 203 aa, Escherichia coli DEC11A; identical to SEQ ID NO: 6414

SEQ ID NO: 9231 - protein, 361 aa, Escherichia coli DEC11A; identical to SEQ ID NO: 7868

SEQ ID NO: 9232 - protein, 224 aa, Escherichia coli DEC11A; identical to SEQ ID NO: 7869

SEQ ID NO: 9233 - protein, 851 aa, Escherichia coli DEC11A
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGLPAQGAITVRWGEAPDQICHISYQLTEQQINSAITRMDAICR

SEQ ID NO: 9234 - protein, 226 aa, Escherichia coli DEC11A; identical to SEQ ID NO: 7934

SEQ ID NO: 9235 - protein, 365 aa, Escherichia coli DEC11A; identical to SEQ ID NO: 7931

SEQ ID NO: 9236 - protein, 232 aa, Escherichia coli DEC11A; identical to SEQ ID NO: 5747

SEQ ID NO: 9237 - protein, 729 aa, Escherichia coli DEC11A; identical to SEQ ID NO: 5745

SEQ ID NO: 9238 - protein, 213 aa, Escherichia coli DEC11A; identical to SEQ ID NO: 5744

SEQ ID NO: 9239 - protein, 203 aa, Escherichia coli DEC11A; identical to SEQ ID NO: 6347

SEQ ID NO: 9240 - protein, 565 aa, Escherichia coli DEC11A; identical to SEQ ID NO: 6492

SEQ ID NO: 9241 - protein, 207 aa, Escherichia coli DEC11A; identical to SEQ ID NO: 5743

SEQ ID NO: 9242 - protein, 353 aa, Escherichia coli DEC11A; identical to SEQ ID NO: 9049

SEQ ID NO: 9243 - protein, 700 aa, Escherichia coli DEC11A
MKIFSVRQTVLPALLVLSPVVFAADEQTMIVSAAPQVVSELDTPAAVSVVDGEEMRLATSRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 9244 - protein, 871 aa, Escherichia coli DEC11A
MHQVLILPRFARLTIALGLATAVFPVDAEYYFNPRFLSNDLAESVDLSAFTKGREAPPGTYRVDIYLNDEFMTSRDITFIADDNNADLIPCLSTDLLVSLGIKKSALLDNKEHSAEKHVPDNSACTPLQDRLADASTEFDVGQQHLSLSVPQIYVGRMARGYVSPELWEEGINAGLLNYSFNGNSINNRSNHNAGKSNYAYLNLQSGINIGSWRLRDNSTWSYNSGSSNSSNSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 9245 - protein, 236 aa, Escherichia coli DEC11A; identical to SEQ ID NO: 7814

SEQ ID NO: 9246 - protein, 539 aa, Escherichia coli DEC11A; identical to SEQ ID NO: 6525

SEQ ID NO: 9247 - protein, 111 aa, Escherichia coli DEC11A; identical to SEQ ID NO: 8460

SEQ ID NO: 9248 - protein, 118 aa, Escherichia coli DEC11A [sequence omitted]

SEQ ID NO: 9249 - protein, 826 aa, Escherichia coli DEC11A; identical to SEQ ID NO: 8499

SEQ ID NO: 9250 - protein, 224 aa, Escherichia coli DEC11A; identical to SEQ ID NO: 6435

SEQ ID NO: 9251 - protein, 641 aa, Escherichia coli DEC11A; identical to SEQ ID NO: 7667

SEQ ID NO: 9252 - protein, 162 aa, Escherichia coli DEC11A; identical to SEQ ID NO: 6365

SEQ ID NO: 9253 - protein, 367 aa, Escherichia coli DEC11A; identical to SEQ ID NO: 5784

SEQ ID NO: 9254 - protein, 200 aa, Escherichia coli DEC11A; identical to SEQ ID NO: 6311

SEQ ID NO: 9255 - protein, 274 aa, Escherichia coli DEC11A; identical to SEQ ID NO: 8357

SEQ ID NO: 9256 - protein, 250 aa, Escherichia coli DEC11A; identical to SEQ ID NO: 6317

SEQ ID NO: 9257 - protein, 880 aa, Escherichia coli DEC11A; identical to SEQ ID NO: 6482

SEQ ID NO: 9258 - protein, 472 aa, Escherichia coli DEC11A; identical to SEQ ID NO: 5729

SEQ ID NO: 9259 - protein, 432 aa, Escherichia coli DEC11A; identical to SEQ ID NO: 5727

SEQ ID NO: 9260 - protein, 359 aa, Escherichia coli DEC11A; identical to SEQ ID NO: 6332

SEQ ID NO: 9261 - protein, 512 aa, Escherichia coli DEC11A; identical to SEQ ID NO: 6251

SEQ ID NO: 9262 - protein, 686 aa, Escherichia coli DEC11A; identical to SEQ ID NO: 6453

SEQ ID NO: 9263 - protein, 834 aa, Escherichia coli DEC11A; identical to SEQ ID NO: 8715

SEQ ID NO: 9264 - protein, 249 aa, Escherichia coli DEC11A; identical to SEQ ID NO: 6450

SEQ ID NO: 9265 - protein, 231 aa, Escherichia coli DEC11A; identical to SEQ ID NO: 6351

SEQ ID NO: 9266 - protein, 838 aa, Escherichia coli DEC11A
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWNYNSRQKSEIQFNISQTIFDGVSLYASGSQQDYWGNNEKNRNISVGVSGQQWGIGYSLNYQYSRYTDQNNDRALYLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 9267 - protein, 662 aa, Escherichia coli DEC11A; identical to SEQ ID NO: 8481

SEQ ID NO: 9268 - protein, 386 aa, Escherichia coli DEC11A; identical to SEQ ID NO: 7908

SEQ ID NO: 9269 - protein, 843 aa, Escherichia coli DEC11A; identical to SEQ ID NO: 7909

SEQ ID NO: 9270 - protein, 228 aa, Escherichia coli DEC11A
MKRISFAVLALLMTAQQCFAGGVALSTTRVIYDGGKKEASLTVENHNKNEEFLIQSWIDDVNSNKKTPFIITPPLFKLDPDKNNVLRIVNIEDTLPKDRESVYWINVKAIPAKSAENENKNVLQIAVRTRLKLFYRPKGLPGSNLEAMKQLRFQRQNNQIVVNNDSAYNLTFNQFSINGQKIERAGMVLAKGKLNINLPAGTGNAHEVKYSIINDFGVAGEMLTKPIN

SEQ ID NO: 9271 - protein, 614 aa, Escherichia coli DEC11A; identical to SEQ ID NO: 7971

SEQ ID NO: 9272 - protein, 208 aa, Escherichia coli DEC11A; identical to SEQ ID NO: 5717

SEQ ID NO: 9273 - protein, 368 aa, Escherichia coli DEC11A; identical to SEQ ID NO: 7974

SEQ ID NO: 9274 - protein, 241 aa, Escherichia coli DEC11A; identical to SEQ ID NO: 6143

SEQ ID NO: 9275 - protein, 863 aa, Escherichia coli DEC11A
MHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTTMIQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 9276 - protein, 446 aa, Escherichia coli DEC11A; identical to SEQ ID NO: 8470

SEQ ID NO: 9277 - protein, 478 aa, Escherichia coli DEC11A; identical to SEQ ID NO: 8471

SEQ ID NO: 9278 - protein, 784 aa, Escherichia coli DEC11A; identical to SEQ ID NO: 6283

SEQ ID NO: 9279 - protein, 170 aa, Escherichia coli DEC11A [sequence omitted]

SEQ ID NO: 9280 - protein, 866 aa, Escherichia coli DEC11A; identical to SEQ ID NO: 8486

SEQ ID NO: 9281 - protein, 230 aa, Escherichia coli DEC11A; identical to SEQ ID NO: 7855

SEQ ID NO: 9282 - protein, 747 aa, Escherichia coli DEC11B; identical to SEQ ID NO: 6343

SEQ ID NO: 9283 - protein, 266 aa, Escherichia coli DEC11B; identical to SEQ ID NO: 5772

SEQ ID NO: 9284 - protein, 161 aa, Escherichia coli DEC11B; identical to SEQ ID NO: 5769

SEQ ID NO: 9285 - protein, 230 aa, Escherichia coli DEC11B; identical to SEQ ID NO: 6294

SEQ ID NO: 9286 - protein, 820 aa, Escherichia coli DEC11B; identical to SEQ ID NO: 9222

SEQ ID NO: 9287 - protein, 351 aa, Escherichia coli DEC11B; identical to SEQ ID NO: 5767

SEQ ID NO: 9288 - protein, 746 aa, Escherichia coli DEC11B; identical to SEQ ID NO: 9223

SEQ ID NO: 9289 - protein, 193 aa, Escherichia coli DEC11B; identical to SEQ ID NO: 6300

SEQ ID NO: 9290 - protein, 243 aa, Escherichia coli DEC11B; identical to SEQ ID NO: 6463

SEQ ID NO: 9291 - protein, 659 aa, Escherichia coli DEC11B; identical to SEQ ID NO: 9226

SEQ ID NO: 9292 - protein, 430 aa, Escherichia coli DEC11B; identical to SEQ ID NO: 5758

SEQ ID NO: 9293 - protein, 331 aa, Escherichia coli DEC11B; identical to SEQ ID NO: 9228

SEQ ID NO: 9294 - protein, 760 aa, Escherichia coli DEC11B; identical to SEQ ID NO: 6455

SEQ ID NO: 9295 - protein, 203 aa, Escherichia coli DEC11B; identical to SEQ ID NO: 6414

SEQ ID NO: 9296 - protein, 361 aa, Escherichia coli DEC11B; identical to SEQ ID NO: 7868

SEQ ID NO: 9297 - protein, 224 aa, Escherichia coli DEC11B; identical to SEQ ID NO: 7869

SEQ ID NO: 9298 - protein, 851 aa, Escherichia coli DEC11B; identical to SEQ ID NO: 9233

SEQ ID NO: 9299 - protein, 130 aa, Escherichia coli DEC11B; identical to SEQ ID NO: 8814

SEQ ID NO: 9300 - protein, 191 aa, Escherichia coli DEC11B; identical to SEQ ID NO: 5748

SEQ ID NO: 9301 - protein, 232 aa, Escherichia coli DEC11B; identical to SEQ ID NO: 5747

SEQ ID NO: 9302 - protein, 729 aa, Escherichia coli DEC11B; identical to SEQ ID NO: 5745

SEQ ID NO: 9303 - protein, 213 aa, Escherichia coli DEC11B; identical to SEQ ID NO: 5744

SEQ ID NO: 9304 - protein, 407 aa, Escherichia coli DEC11B
MTERELSIIRALGEEFSTVLADLQRTFEGKMAAQAQAFEEKLASLSAVLQKHVTVDEVHPVLQAMVDDAVGTIPVPRDGRDYDPDVLQQAVNDAVANIPVPADGKSITPDDVRPMLEQMVKEAVSHIPAPRDGRDYDPEVLKQAVNDAVANIPVPADGKSITPDDVRPMLEQMVKEAVSHIPAPRDGRDYDPEVLKQAVNDAVANIPVPADGKSITPDDVRPMLEQMVKEAVSHIPAPRDGRDYDPEVLKQAVLEAVNALPAPQDGRDATALEVLPAIDDQKSFPRGTYATHLGGLWRAYEKTHGMRGWECLVDGVADIDVSMTDERLFSVVIRQSSGQCTEKTFSLPVMLYRGVFRAGETYHPGDTVTWGGSLWHCNSMTGDKPGEAHSSGWTLAAKRGRDAGGGK

SEQ ID NO: 9305 - protein, 365 aa, Escherichia coli DEC11B; identical to SEQ ID NO: 7931

SEQ ID NO: 9306 - protein, 203 aa, Escherichia coli DEC11B; identical to SEQ ID NO: 6347

SEQ ID NO: 9307 - protein, 565 aa, Escherichia coli DEC11B; identical to SEQ ID NO: 6492

SEQ ID NO: 9308 - protein, 207 aa, Escherichia coli DEC11B; identical to SEQ ID NO: 5743

SEQ ID NO: 9309 - protein, 539 aa, Escherichia coli DEC11B; identical to SEQ ID NO: 6525

SEQ ID NO: 9310 - protein, 700 aa, Escherichia coli DEC11B; identical to SEQ ID NO: 9243

SEQ ID NO: 9311 - protein, 236 aa, Escherichia coli DEC11B; identical to SEQ ID NO: 7814

SEQ ID NO: 9312 - protein, 200 aa, Escherichia coli DEC11B; identical to SEQ ID NO: 6311

SEQ ID NO: 9313 - protein, 111 aa, Escherichia coli DEC11B; identical to SEQ ID NO: 8460

SEQ ID NO: 9314 - protein, 118 aa, Escherichia coli DEC11B [sequence omitted]

SEQ ID NO: 9315 - protein, 826 aa, Escherichia coli DEC11B; identical to SEQ ID NO: 8499

SEQ ID NO: 9316 - protein, 224 aa, Escherichia coli DEC11B; identical to SEQ ID NO: 6435

SEQ ID NO: 9317 - protein, 631 aa, Escherichia coli DEC11B; identical to SEQ ID NO: 6430

SEQ ID NO: 9318 - protein, 162 aa, Escherichia coli DEC11B; identical to SEQ ID NO: 6365

SEQ ID NO: 9319 - protein, 367 aa, Escherichia coli DEC11B; identical to SEQ ID NO: 5784

SEQ ID NO: 9320 - protein, 274 aa, Escherichia coli DEC11B; identical to SEQ ID NO: 8357

SEQ ID NO: 9321 - protein, 250 aa, Escherichia coli DEC11B; identical to SEQ ID NO: 6317

SEQ ID NO: 9322 - protein, 880 aa, Escherichia coli DEC11B; identical to SEQ ID NO: 6482

SEQ ID NO: 9323 - protein, 518 aa, Escherichia coli DEC11B; identical to SEQ ID NO: 6358

SEQ ID NO: 9324 - protein, 432 aa, Escherichia coli DEC11B; identical to SEQ ID NO: 5727

SEQ ID NO: 9325 - protein, 359 aa, Escherichia coli DEC11B; identical to SEQ ID NO: 6332

SEQ ID NO: 9326 - protein, 616 aa, Escherichia coli DEC11B; identical to SEQ ID NO: 6222

SEQ ID NO: 9327 - protein, 834 aa, Escherichia coli DEC11B; identical to SEQ ID NO: 8715

SEQ ID NO: 9328 - protein, 249 aa, Escherichia coli DEC11B; identical to SEQ ID NO: 6450

SEQ ID NO: 9329 - protein, 512 aa, Escherichia coli DEC11B; identical to SEQ ID NO: 6251

SEQ ID NO: 9330 - protein, 231 aa, Escherichia coli DEC11B; identical to SEQ ID NO: 6351

SEQ ID NO: 9331 - protein, 721 aa, Escherichia coli DEC11B
MDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWNYNSRQKSEIQFNISQTIFDGVSLYASGSQQDYWGNNEKNRNISVGVSGQQWGIGYSLNYQYSRYTDQNNDRALYLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 9332 - protein, 662 aa, Escherichia coli DEC11B; identical to SEQ ID NO: 8481

SEQ ID NO: 9333 - protein, 386 aa, Escherichia coli DEC11B; identical to SEQ ID NO: 7908

SEQ ID NO: 9334 - protein, 843 aa, Escherichia coli DEC11B; identical to SEQ ID NO: 7909

SEQ ID NO: 9335 - protein, 228 aa, Escherichia coli DEC11B; identical to SEQ ID NO: 9270

SEQ ID NO: 9336 - protein, 208 aa, Escherichia coli DEC11B; identical to SEQ ID NO: 5717

SEQ ID NO: 9337 - protein, 614 aa, Escherichia coli DEC11B; identical to SEQ ID NO: 7971

SEQ ID NO: 9338 - protein, 446 aa, Escherichia coli DEC11B; identical to SEQ ID NO: 8470

SEQ ID NO: 9339 - protein, 478 aa, Escherichia coli DEC11B; identical to SEQ ID NO: 8471

SEQ ID NO: 9340 - protein, 368 aa, Escherichia coli DEC11B; identical to SEQ ID NO: 7974

SEQ ID NO: 9341 - protein, 241 aa, Escherichia coli DEC11B; identical to SEQ ID NO: 6143

SEQ ID NO: 9342 - protein, 863 aa, Escherichia coli DEC11B; identical to SEQ ID NO: 9275

SEQ ID NO: 9343 - protein, 784 aa, Escherichia coli DEC11B; identical to SEQ ID NO: 6283

SEQ ID NO: 9344 - protein, 170 aa, Escherichia coli DEC11B [sequence omitted]

SEQ ID NO: 9345 - protein, 866 aa, Escherichia coli DEC11B; identical to SEQ ID NO: 8486

SEQ ID NO: 9346 - protein, 230 aa, Escherichia coli DEC11B; identical to SEQ ID NO: 7855

SEQ ID NO: 9347 - protein, 784 aa, Escherichia coli DEC11C; identical to SEQ ID NO: 6283

SEQ ID NO: 9348 - protein, 170 aa, Escherichia coli DEC11C [sequence omitted]

SEQ ID NO: 9349 - protein, 866 aa, Escherichia coli DEC11C; identical to SEQ ID NO: 8486

SEQ ID NO: 9350 - protein, 246 aa, Escherichia coli DEC11C; identical to SEQ ID NO: 6342

SEQ ID NO: 9351 - protein, 747 aa, Escherichia coli DEC11C; identical to SEQ ID NO: 6343

SEQ ID NO: 9352 - protein, 266 aa, Escherichia coli DEC11C; identical to SEQ ID NO: 5772

SEQ ID NO: 9353 - protein, 161 aa, Escherichia coli DEC11C; identical to SEQ ID NO: 5769

SEQ ID NO: 9354 - protein, 351 aa, Escherichia coli DEC11C; identical to SEQ ID NO: 5767

SEQ ID NO: 9355 - protein, 230 aa, Escherichia coli DEC11C; identical to SEQ ID NO: 6294

SEQ ID NO: 9356 - protein, 820 aa, Escherichia coli DEC11C; identical to SEQ ID NO: 9222

SEQ ID NO: 9357 - protein, 365 aa, Escherichia coli DEC11C; identical to SEQ ID NO: 7931

SEQ ID NO: 9358 - protein, 746 aa, Escherichia coli DEC11C
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYVTTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSKNKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 9359 - protein, 193 aa, Escherichia coli DEC11C; identical to SEQ ID NO: 6300

SEQ ID NO: 9360 - protein, 243 aa, Escherichia coli DEC11C; identical to SEQ ID NO: 6463

SEQ ID NO: 9361 - protein, 659 aa, Escherichia coli DEC11C; identical to SEQ ID NO: 9226

SEQ ID NO: 9362 - protein, 430 aa, Escherichia coli DEC11C; identical to SEQ ID NO: 5758

SEQ ID NO: 9363 - protein, 331 aa, Escherichia coli DEC11C; identical to SEQ ID NO: 6456

SEQ ID NO: 9364 - protein, 760 aa, Escherichia coli DEC11C; identical to SEQ ID NO: 6455

SEQ ID NO: 9365 - protein, 203 aa, Escherichia coli DEC11C; identical to SEQ ID NO: 6414

SEQ ID NO: 9366 - protein, 361 aa, Escherichia coli DEC11C; identical to SEQ ID NO: 7868

SEQ ID NO: 9367 - protein, 224 aa, Escherichia coli DEC11C; identical to SEQ ID NO: 7869

SEQ ID NO: 9368 - protein, 591 aa, Escherichia coli DEC11C
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKITPG

SEQ ID NO: 9369 - protein, 229 aa, Escherichia coli DEC11C
MALLIFAVLSLLVAGELRAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQLSVNGKALSNAGVVPPKSQRQTSWCQAIAPCHVAWRAINDYGGLSAKKEQNLP

SEQ ID NO: 9370 - protein, 191 aa, Escherichia coli DEC11C; identical to SEQ ID NO: 5748

SEQ ID NO: 9371 - protein, 232 aa, Escherichia coli DEC11C; identical to SEQ ID NO: 5747

SEQ ID NO: 9372 - protein, 729 aa, Escherichia coli DEC11C; identical to SEQ ID NO: 5745

SEQ ID NO: 9373 - protein, 213 aa, Escherichia coli DEC11C; identical to SEQ ID NO: 5744

SEQ ID NO: 9374 - protein, 203 aa, Escherichia coli DEC11C; identical to SEQ ID NO: 6347

SEQ ID NO: 9375 - protein, 565 aa, Escherichia coli DEC11C; identical to SEQ ID NO: 6492

SEQ ID NO: 9376 - protein, 207 aa, Escherichia coli DEC11C; identical to SEQ ID NO: 5743

SEQ ID NO: 9377 - protein, 539 aa, Escherichia coli DEC11C; identical to SEQ ID NO: 6525

SEQ ID NO: 9378 - protein, 700 aa, Escherichia coli DEC11C; identical to SEQ ID NO: 9243

SEQ ID NO: 9379 - protein, 236 aa, Escherichia coli DEC11C; identical to SEQ ID NO: 7814

SEQ ID NO: 9380 - protein, 111 aa, Escherichia coli DEC11C; identical to SEQ ID NO: 8460

SEQ ID NO: 9381 - protein, 118 aa, Escherichia coli DEC11C [sequence omitted]

SEQ ID NO: 9382 - protein, 270 aa, Escherichia coli DEC11C
MPERRRRQRGMPAYQPVRQKRALQMLTLQQGRHRSQPGRRQKVQPQQSSQRMRPRPRLLRPLKKPVSHHKVQQKLNCQERRQKVQPVMQPGMATTATEKRPGVQQKATQSAEQSRIAAEEAVNRIPTVVGPPGPKGEQGPAGPQGPKGDKGERGDTGPVGATGERGPAGDAGPAGPQGPKGDRGERGETDLTGNAGPQGPKGDTGAAGPAGPQGPKGETGAAGPVGATGPQGPKGDPGETQIRFVWGRRALLRQTAMAGSRIQMVRSSPD

SEQ ID NO: 9383 - protein, 826 aa, Escherichia coli DEC11C; identical to SEQ ID NO: 8499

SEQ ID NO: 9384 - protein, 224 aa, Escherichia coli DEC11C
MKGLLSLLIFSMVLPAHAGIVIYGTRIIYPAEIKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSDNGLVIKNDSANWVTISDVKANNVKVNYETIMIAPLESQSVNVKSNNANNWYLTIIDDHGNYISDKI

SEQ ID NO: 9385 - protein, 650 aa, Escherichia coli DEC11C
MSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGQYTGQKRADSATAKTPGGYTIWNTGAAWQVTKDVKLRAGVLNLGDKDLSRDDYSYNEDGRRYFMAVDYRF

SEQ ID NO: 9386 - protein, 162 aa, Escherichia coli DEC11C; identical to SEQ ID NO: 6365

SEQ ID NO: 9387 - protein, 367 aa, Escherichia coli DEC11C; identical to SEQ ID NO: 5784

SEQ ID NO: 9388 - protein, 200 aa, Escherichia coli DEC11C; identical to SEQ ID NO: 6311

SEQ ID NO: 9389 - protein, 274 aa, Escherichia coli DEC11C; identical to SEQ ID NO: 8357

SEQ ID NO: 9390 - protein, 250 aa, Escherichia coli DEC11C; identical to SEQ ID NO: 6317

SEQ ID NO: 9391 - protein, 880 aa, Escherichia coli DEC11C; identical to SEQ ID NO: 6482

SEQ ID NO: 9392 - protein, 518 aa, Escherichia coli DEC11C; identical to SEQ ID NO: 6358

SEQ ID NO: 9393 - protein, 359 aa, Escherichia coli DEC11C; identical to SEQ ID NO: 6332

SEQ ID NO: 9394 - protein, 432 aa, Escherichia coli DEC11C; identical to SEQ ID NO: 5727

SEQ ID NO: 9395 - protein, 514 aa, Escherichia coli DEC11C; identical to SEQ ID NO: 9000

SEQ ID NO: 9396 - protein, 834 aa, Escherichia coli DEC11C; identical to SEQ ID NO: 8715

SEQ ID NO: 9397 - protein, 249 aa, Escherichia coli DEC11C; identical to SEQ ID NO: 6450

SEQ ID NO: 9398 - protein, 231 aa, Escherichia coli DEC11C; identical to SEQ ID NO: 6351

SEQ ID NO: 9399 - protein, 721 aa, Escherichia coli DEC11C; identical to SEQ ID NO: 9331

SEQ ID NO: 9400 - protein, 662 aa, Escherichia coli DEC11C; identical to SEQ ID NO: 8481

SEQ ID NO: 9401 - protein, 386 aa, Escherichia coli DEC11C; identical to SEQ ID NO: 7908

SEQ ID NO: 9402 - protein, 843 aa, Escherichia coli DEC11C; identical to SEQ ID NO: 7909

SEQ ID NO: 9403 - protein, 208 aa, Escherichia coli DEC11C; identical to SEQ ID NO: 5717

SEQ ID NO: 9404 - protein, 614 aa, Escherichia coli DEC11C; identical to SEQ ID NO: 7971

SEQ ID NO: 9405 - protein, 446 aa, Escherichia coli DEC11C; identical to SEQ ID NO: 8470

SEQ ID NO: 9406 - protein, 478 aa, Escherichia coli DEC11C; identical to SEQ ID NO: 8471

SEQ ID NO: 9407 - protein, 368 aa, Escherichia coli DEC11C; identical to SEQ ID NO: 7974

SEQ ID NO: 9408 - protein, 241 aa, Escherichia coli DEC11C; identical to SEQ ID NO: 6143

SEQ ID NO: 9409 - protein, 856 aa, Escherichia coli DEC11C
MAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTTMIQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSLVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 9410 - protein, 185 aa, Escherichia coli DEC11C
MLEQMVKEAVSHIPAPRDGRDYDPEVLKQAVLEAVNALPAPQDGRDATALEVLPAIDDQKSFPRGTYATHLGGLWRAYEKTHGMRGWECLVDGVADIDVSMTDERLFSVVIRQSSGQCTEKTFSLPVMLYRGVFRAGETYHPGDTVTWGGSLWHCNSMTGDKPGEAHSSGWTLAAKRGRDAGGGK

SEQ ID NO: 9411 - protein, 998 aa, Escherichia coli DEC11C; identical to SEQ ID NO: 5651

SEQ ID NO: 9412 - protein, 89 aa, Escherichia coli DEC11C; identical to SEQ ID NO: 6232

SEQ ID NO: 9413 - protein, 514 aa, Escherichia coli DEC11D; identical to SEQ ID NO: 9000

SEQ ID NO: 9414 - protein, 121 aa, Escherichia coli DEC11D; identical to SEQ ID NO: 6175

SEQ ID NO: 9415 - protein, 353 aa, Escherichia coli DEC11D; identical to SEQ ID NO: 9049

SEQ ID NO: 9416 - protein, 784 aa, Escherichia coli DEC11D; identical to SEQ ID NO: 6283

SEQ ID NO: 9417 - protein, 170 aa, Escherichia coli DEC11D [sequence omitted]

SEQ ID NO: 9418 - protein, 765 aa, Escherichia coli DEC11D
MQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGSLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 9419 - protein, 246 aa, Escherichia coli DEC11D; identical to SEQ ID NO: 6342

SEQ ID NO: 9420 - protein, 747 aa, Escherichia coli DEC11D; identical to SEQ ID NO: 6343

SEQ ID NO: 9421 - protein, 266 aa, Escherichia coli DEC11D; identical to SEQ ID NO: 5772

SEQ ID NO: 9422 - protein, 161 aa, Escherichia coli DEC11D; identical to SEQ ID NO: 5769

SEQ ID NO: 9423 - protein, 230 aa, Escherichia coli DEC11D; identical to SEQ ID NO: 6294

SEQ ID NO: 9424 - protein, 820 aa, Escherichia coli DEC11D; identical to SEQ ID NO: 9222

SEQ ID NO: 9425 - protein, 360 aa, Escherichia coli DEC11D; identical to SEQ ID NO: 8317

SEQ ID NO: 9426 - protein, 351 aa, Escherichia coli DEC11D; identical to SEQ ID NO: 5767

SEQ ID NO: 9427 - protein, 746 aa, Escherichia coli DEC11D; identical to SEQ ID NO: 9223

SEQ ID NO: 9428 - protein, 193 aa, Escherichia coli DEC11D; identical to SEQ ID NO: 6300

SEQ ID NO: 9429 - protein, 243 aa, Escherichia coli DEC11D; identical to SEQ ID NO: 6463

SEQ ID NO: 9430 - protein, 659 aa, Escherichia coli DEC11D; identical to SEQ ID NO: 9226

SEQ ID NO: 9431 - protein, 430 aa, Escherichia coli DEC11D; identical to SEQ ID NO: 5758

SEQ ID NO: 9432 - protein, 331 aa, Escherichia coli DEC11D; identical to SEQ ID NO: 6456

SEQ ID NO: 9433 - protein, 760 aa, Escherichia coli DEC11D
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWLVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 9434 - protein, 203 aa, Escherichia coli DEC11D; identical to SEQ ID NO: 6414

SEQ ID NO: 9435 - protein, 361 aa, Escherichia coli DEC11D; identical to SEQ ID NO: 7868

SEQ ID NO: 9436 - protein, 224 aa, Escherichia coli DEC11D; identical to SEQ ID NO: 7869

SEQ ID NO: 9437 - protein, 591 aa, Escherichia coli DEC11D; identical to SEQ ID NO: 9368

SEQ ID NO: 9438 - protein, 128 aa, Escherichia coli DEC11D; identical to SEQ ID NO: 7871

SEQ ID NO: 9439 - protein, 191 aa, Escherichia coli DEC11D; identical to SEQ ID NO: 5748

SEQ ID NO: 9440 - protein, 232 aa, Escherichia coli DEC11D
MQKNAAHTYAISSLLVLSLTGCAWIPSTPLVQGATSAQPVPGPTPVANGSIFQSAQPINYGYQPLFEDRRPRNIGDTLTIVLQENVSASKSSSANASRDGKTNFGFDTVPRYLQGLFGNARADVEASGGNTFNGKGGANASNTFSGTLTVTVDQVLVNGNLHVVGEKQIAINQGTESIRFSGVVNPRTISGSNTVPSTQVADARIEYVGNGYINEAQNMGWLQRFFLNLSPM

SEQ ID NO: 9441 - protein, 729 aa, Escherichia coli DEC11D; identical to SEQ ID NO: 5745

SEQ ID NO: 9442 - protein, 213 aa, Escherichia coli DEC11D; identical to SEQ ID NO: 5744

SEQ ID NO: 9443 - protein, 539 aa, Escherichia coli DEC11D; identical to SEQ ID NO: 6525

SEQ ID NO: 9444 - protein, 700 aa, Escherichia coli DEC11D; identical to SEQ ID NO: 9243

SEQ ID NO: 9445 - protein, 203 aa, Escherichia coli DEC11D; identical to SEQ ID NO: 6347

SEQ ID NO: 9446 - protein, 565 aa, Escherichia coli DEC11D; identical to SEQ ID NO: 6492

SEQ ID NO: 9447 - protein, 207 aa, Escherichia coli DEC11D; identical to SEQ ID NO: 5743

SEQ ID NO: 9448 - protein, 236 aa, Escherichia coli DEC11D; identical to SEQ ID NO: 7814

SEQ ID NO: 9449 - protein, 111 aa, Escherichia coli DEC11D; identical to SEQ ID NO: 8460

SEQ ID NO: 9450 - protein, 118 aa, Escherichia coli DEC11D [sequence omitted]

SEQ ID NO: 9451 - protein, 826 aa, Escherichia coli DEC11D; identical to SEQ ID NO: 8499

SEQ ID NO: 9452 - protein, 224 aa, Escherichia coli DEC11D; identical to SEQ ID NO: 6435

SEQ ID NO: 9453 - protein, 641 aa, Escherichia coli DEC11D; identical to SEQ ID NO: 7667

SEQ ID NO: 9454 - protein, 367 aa, Escherichia coli DEC11D; identical to SEQ ID NO: 5784

SEQ ID NO: 9455 - protein, 200 aa, Escherichia coli DEC11D; identical to SEQ ID NO: 6311

SEQ ID NO: 9456 - protein, 274 aa, Escherichia coli DEC11D; identical to SEQ ID NO: 8357

SEQ ID NO: 9457 - protein, 250 aa, Escherichia coli DEC11D; identical to SEQ ID NO: 6317

SEQ ID NO: 9458 - protein, 880 aa, Escherichia coli DEC11D
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVANNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPYPLPADLFNGLLLPCQHKGNVAPVVPDDIKPVIQEQTQQVTPTNPPVSVSANQ

SEQ ID NO: 9459 - protein, 518 aa, Escherichia coli DEC11D; identical to SEQ ID NO: 6358

SEQ ID NO: 9460 - protein, 432 aa, Escherichia coli DEC11D; identical to SEQ ID NO: 5727

SEQ ID NO: 9461 - protein, 359 aa, Escherichia coli DEC11D; identical to SEQ ID NO: 6332

SEQ ID NO: 9462 - protein, 822 aa, Escherichia coli DEC11D
MIKNIYCSLSVLIIGCASAYAVEFNKDLIEAEDRENVNLSQFETDGQLPVGKYSLNALINNKRTPIHLDLQWALIDNQTAVCLTPEQLTLLGFTDEIIEVAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 9463 - protein, 249 aa, Escherichia coli DEC11D; identical to SEQ ID NO: 6450

SEQ ID NO: 9464 - protein, 231 aa, Escherichia coli DEC11D; identical to SEQ ID NO: 6351

SEQ ID NO: 9465 - protein, 721 aa, Escherichia coli DEC11D; identical to SEQ ID NO: 9331

SEQ ID NO: 9466 - protein, 662 aa, Escherichia coli DEC11D; identical to SEQ ID NO: 8481

SEQ ID NO: 9467 - protein, 386 aa, Escherichia coli DEC11D; identical to SEQ ID NO: 7908

SEQ ID NO: 9468 - protein, 208 aa, Escherichia coli DEC11D; identical to SEQ ID NO: 5717

SEQ ID NO: 9469 - protein, 614 aa, Escherichia coli DEC11D
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHFGRYDSSATLDEMKQYTVQWANNVIVGHGSIGAGVDWQKQTTTPGTGYVENGYDQRNTGIYLTGLQQVGDFTFEGAARSDDNSQFGCHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 9470 - protein, 446 aa, Escherichia coli DEC11D; identical to SEQ ID NO: 8470

SEQ ID NO: 9471 - protein, 478 aa, Escherichia coli DEC11D; identical to SEQ ID NO: 8471

SEQ ID NO: 9472 - protein, 368 aa, Escherichia coli DEC11D; identical to SEQ ID NO: 7974

SEQ ID NO: 9473 - protein, 241 aa, Escherichia coli DEC11D; identical to SEQ ID NO: 6143

SEQ ID NO: 9474 - protein, 856 aa, Escherichia coli DEC11D
MAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTTMIQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 9475 - protein, 784 aa, Escherichia coli DEC11E; identical to SEQ ID NO: 6283

SEQ ID NO: 9476 - protein, 170 aa, Escherichia coli DEC11E [sequence omitted]

SEQ ID NO: 9477 - protein, 765 aa, Escherichia coli DEC11E; identical to SEQ ID NO: 9418

SEQ ID NO: 9478 - protein, 230 aa, Escherichia coli DEC11E; identical to SEQ ID NO: 7855

SEQ ID NO: 9479 - protein, 747 aa, Escherichia coli DEC11E; identical to SEQ ID NO: 6343

SEQ ID NO: 9480 - protein, 266 aa, Escherichia coli DEC11E; identical to SEQ ID NO: 5772

SEQ ID NO: 9481 - protein, 161 aa, Escherichia coli DEC11E; identical to SEQ ID NO: 5769

SEQ ID NO: 9482 - protein, 351 aa, Escherichia coli DEC11E; identical to SEQ ID NO: 5767

SEQ ID NO: 9483 - protein, 230 aa, Escherichia coli DEC11E; identical to SEQ ID NO: 6294

SEQ ID NO: 9484 - protein, 820 aa, Escherichia coli DEC11E; identical to SEQ ID NO: 9222

SEQ ID NO: 9485 - protein, 746 aa, Escherichia coli DEC11E; identical to SEQ ID NO: 9223

SEQ ID NO: 9486 - protein, 193 aa, Escherichia coli DEC11E; identical to SEQ ID NO: 6300

SEQ ID NO: 9487 - protein, 243 aa, Escherichia coli DEC11E; identical to SEQ ID NO: 6463

SEQ ID NO: 9488 - protein, 659 aa, Escherichia coli DEC11E; identical to SEQ ID NO: 9226

SEQ ID NO: 9489 - protein, 430 aa, Escherichia coli DEC11E; identical to SEQ ID NO: 5758

SEQ ID NO: 9490 - protein, 191 aa, Escherichia coli DEC11E; identical to SEQ ID NO: 5748

SEQ ID NO: 9491 - protein, 232 aa, Escherichia coli DEC11E; identical to SEQ ID NO: 9440

SEQ ID NO: 9492 - protein, 729 aa, Escherichia coli DEC11E; identical to SEQ ID NO: 5745

SEQ ID NO: 9493 - protein, 213 aa, Escherichia coli DEC11E; identical to SEQ ID NO: 5744

SEQ ID NO: 9494 - protein, 331 aa, Escherichia coli DEC11E
MKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGCPDKPYHGQIGFVSPTAEFTPKTVETPDLRTDLVYRLRIVVTDADDALRQGMPVTVQFGNEAGHE

SEQ ID NO: 9495 - protein, 760 aa, Escherichia coli DEC11E; identical to SEQ ID NO: 9433

SEQ ID NO: 9496 - protein, 203 aa, Escherichia coli DEC11E; identical to SEQ ID NO: 6414

SEQ ID NO: 9497 - protein, 361 aa, Escherichia coli DEC11E; identical to SEQ ID NO: 7868

SEQ ID NO: 9498 - protein, 224 aa, Escherichia coli DEC11E; identical to SEQ ID NO: 7869

SEQ ID NO: 9499 - protein, 591 aa, Escherichia coli DEC11E; identical to SEQ ID NO: 9368

SEQ ID NO: 9500 - protein, 128 aa, Escherichia coli DEC11E; identical to SEQ ID NO: 7871

SEQ ID NO: 9501 - protein, 203 aa, Escherichia coli DEC11E; identical to SEQ ID NO: 6347

SEQ ID NO: 9502 - protein, 565 aa, Escherichia coli DEC11E; identical to SEQ ID NO: 6492

SEQ ID NO: 9503 - protein, 207 aa, Escherichia coli DEC11E; identical to SEQ ID NO: 5743

SEQ ID NO: 9504 - protein, 539 aa, Escherichia coli DEC11E; identical to SEQ ID NO: 6525

SEQ ID NO: 9505 - protein, 700 aa, Escherichia coli DEC11E; identical to SEQ ID NO: 9243

SEQ ID NO: 9506 - protein, 236 aa, Escherichia coli DEC11E; identical to SEQ ID NO: 7814

SEQ ID NO: 9507 - protein, 111 aa, Escherichia coli DEC11E; identical to SEQ ID NO: 8460

SEQ ID NO: 9508 - protein, 118 aa, Escherichia coli DEC11E [sequence omitted]

SEQ ID NO: 9509 - protein, 360 aa, Escherichia coli DEC11E; identical to SEQ ID NO: 8317

SEQ ID NO: 9510 - protein, 826 aa, Escherichia coli DEC11E; identical to SEQ ID NO: 8499

SEQ ID NO: 9511 - protein, 224 aa, Escherichia coli DEC11E; identical to SEQ ID NO: 6435

SEQ ID NO: 9512 - protein, 650 aa, Escherichia coli DEC11E; identical to SEQ ID NO: 9042

SEQ ID NO: 9513 - protein, 162 aa, Escherichia coli DEC11E
MKTILPAVLFAAFTTTSAWAAESVQPLEKIAPYPQAEKGMKRQVIQLTPQEDESTLKVELLIGQTLEVDCNLHRLGGKLENKTLEGWGYDYYVFDKVSSPVSTMMACPDGKKEKKFVTAYLGDAGMLRYNSKLPIVVYTPDNVDVKYRVWKAEEKIDNAVVR

SEQ ID NO: 9514 - protein, 367 aa, Escherichia coli DEC11E; identical to SEQ ID NO: 5784

SEQ ID NO: 9515 - protein, 200 aa, Escherichia coli DEC11E; identical to SEQ ID NO: 6311

SEQ ID NO: 9516 - protein, 274 aa, Escherichia coli DEC11E; identical to SEQ ID NO: 8357

SEQ ID NO: 9517 - protein, 250 aa, Escherichia coli DEC11E; identical to SEQ ID NO: 6317

SEQ ID NO: 9518 - protein, 597 aa, Escherichia coli DEC11E
MLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPYPLPADLFNGLLLPCQHKGNVAPVVPDDIKPVIQEQTQQVTPTNPPVSVSANQ

SEQ ID NO: 9519 - protein, 518 aa, Escherichia coli DEC11E; identical to SEQ ID NO: 6358

SEQ ID NO: 9520 - protein, 432 aa, Escherichia coli DEC11E; identical to SEQ ID NO: 5727

SEQ ID NO: 9521 - protein, 359 aa, Escherichia coli DEC11E; identical to SEQ ID NO: 6332

SEQ ID NO: 9522 - protein, 512 aa, Escherichia coli DEC11E; identical to SEQ ID NO: 6251

SEQ ID NO: 9523 - protein, 834 aa, Escherichia coli DEC11E
MYKKLKLTTISELIKNIYCSLSVLIIGCASAYAVEFNKDLIEAEDRENVNLSQFETDGQLPVGKYSLNALINNKRTPIHLDLQWALIDNQTAVCLTPEQLTLLGFTDEIIEVAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 9524 - protein, 125 aa, Escherichia coli DEC11E; identical to SEQ ID NO: 7904

SEQ ID NO: 9525 - protein, 231 aa, Escherichia coli DEC11E; identical to SEQ ID NO: 6351

SEQ ID NO: 9526 - protein, 838 aa, Escherichia coli DEC11E; identical to SEQ ID NO: 9266

SEQ ID NO: 9527 - protein, 662 aa, Escherichia coli DEC11E; identical to SEQ ID NO: 8481

SEQ ID NO: 9528 - protein, 386 aa, Escherichia coli DEC11E; identical to SEQ ID NO: 7908

SEQ ID NO: 9529 - protein, 614 aa, Escherichia coli DEC11E; identical to SEQ ID NO: 9469

SEQ ID NO: 9530 - protein, 208 aa, Escherichia coli DEC11E; identical to SEQ ID NO: 5717

SEQ ID NO: 9531 - protein, 446 aa, Escherichia coli DEC11E; identical to SEQ ID NO: 8470

SEQ ID NO: 9532 - protein, 478 aa, Escherichia coli DEC11E; identical to SEQ ID NO: 8471

SEQ ID NO: 9533 - protein, 368 aa, Escherichia coli DEC11E; identical to SEQ ID NO: 7974

SEQ ID NO: 9534 - protein, 241 aa, Escherichia coli DEC11E; identical to SEQ ID NO: 6143

SEQ ID NO: 9535 - protein, 856 aa, Escherichia coli DEC11E; identical to SEQ ID NO: 9474

SEQ ID NO: 9536 - protein, 353 aa, Escherichia coli DEC11E; identical to SEQ ID NO: 9049

SEQ ID NO: 9537 - protein, 121 aa, Escherichia coli DEC11E; identical to SEQ ID NO: 6175

SEQ ID NO: 9538 - protein, 368 aa, Escherichia coli DEC12A; identical to SEQ ID NO: 8468

SEQ ID NO: 9539 - protein, 241 aa, Escherichia coli DEC12A; identical to SEQ ID NO: 6143

SEQ ID NO: 9540 - protein, 856 aa, Escherichia coli DEC12A
MAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTLTLYLSGSHQTYWGTSNVDEQFQAGLNTAFEDINWTLSYSLTKNAWQKGRDQMLALNVNIPFSHWLRSDSKSQWRHASASYSMSHDLNGRMTNLVGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 9541 - protein, 784 aa, Escherichia coli DEC12A; identical to SEQ ID NO: 6283

SEQ ID NO: 9542 - protein, 170 aa, Escherichia coli DEC12A [sequence omitted]

SEQ ID NO: 9543 - protein, 765 aa, Escherichia coli DEC12A; identical to SEQ ID NO: 9418

SEQ ID NO: 9544 - protein, 230 aa, Escherichia coli DEC12A
MAFSSSSIADIVISGTRVIYKSDQKSVNVRLENKGNNPLLVQSWLDTGYDNAEPGSITVPFTATPPVSRIDAKRGQTIKLMYTASTSLPKDRESVFWFNVLEVPPKPDAEKVANQSLLQLAFRTRIKLFYRPDGLKGNPSEAPLALKWFWSGSEGKASLRVTNPTPYYVSFSSGDLEASGKRYPIDVKMIAPFSDEVMKVTGLNGKASSAKVHFYAINDFGGAIEGNASL

SEQ ID NO: 9545 - protein, 747 aa, Escherichia coli DEC12A; identical to SEQ ID NO: 6343

SEQ ID NO: 9546 - protein, 266 aa, Escherichia coli DEC12A; identical to SEQ ID NO: 5772

SEQ ID NO: 9547 - protein, 161 aa, Escherichia coli DEC12A; identical to SEQ ID NO: 5769

SEQ ID NO: 9548 - protein, 351 aa, Escherichia coli DEC12A; identical to SEQ ID NO: 5767

SEQ ID NO: 9549 - protein, 230 aa, Escherichia coli DEC12A; identical to SEQ ID NO: 6294

SEQ ID NO: 9550 - protein, 570 aa, Escherichia coli DEC12A
MGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYATLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSIGITSMWVMTGKFI

SEQ ID NO: 9551 - protein, 746 aa, Escherichia coli DEC12A; identical to SEQ ID NO: 8482

SEQ ID NO: 9552 - protein, 193 aa, Escherichia coli DEC12A; identical to SEQ ID NO: 6300

SEQ ID NO: 9553 - protein, 243 aa, Escherichia coli DEC12A; identical to SEQ ID NO: 6463

SEQ ID NO: 9554 - protein, 658 aa, Escherichia coli DEC12A
MDYNLFASSYRPQDGSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 9555 - protein, 430 aa, Escherichia coli DEC12A; identical to SEQ ID NO: 5758

SEQ ID NO: 9556 - protein, 331 aa, Escherichia coli DEC12A; identical to SEQ ID NO: 6456

SEQ ID NO: 9557 - protein, 760 aa, Escherichia coli DEC12A; identical to SEQ ID NO: 6455

SEQ ID NO: 9558 - protein, 203 aa, Escherichia coli DEC12A; identical to SEQ ID NO: 6414

SEQ ID NO: 9559 - protein, 361 aa, Escherichia coli DEC12A; identical to SEQ ID NO: 7868

SEQ ID NO: 9560 - protein, 204 aa, Escherichia coli DEC12A
MTVSLTAILLSCSSAWAAGKGGIGLAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLGEAPAKLRCTSSADMVTVSNPTPYFITLTDLKIGGKVVKNQMISPFDKYQFSLPKGATNHQ

SEQ ID NO: 9561 - protein, 591 aa, Escherichia coli DEC12A; identical to SEQ ID NO: 9368

SEQ ID NO: 9562 - protein, 226 aa, Escherichia coli DEC12A; identical to SEQ ID NO: 7934

SEQ ID NO: 9563 - protein, 191 aa, Escherichia coli DEC12A; identical to SEQ ID NO: 5748

SEQ ID NO: 9564 - protein, 232 aa, Escherichia coli DEC12A; identical to SEQ ID NO: 5747

SEQ ID NO: 9565 - protein, 729 aa, Escherichia coli DEC12A; identical to SEQ ID NO: 5745

SEQ ID NO: 9566 - protein, 213 aa, Escherichia coli DEC12A; identical to SEQ ID NO: 5744

SEQ ID NO: 9567 - protein, 774 aa, Escherichia coli DEC12A; identical to SEQ ID NO: 8469

SEQ ID NO: 9568 - protein, 203 aa, Escherichia coli DEC12A; identical to SEQ ID NO: 6347

SEQ ID NO: 9569 - protein, 565 aa, Escherichia coli DEC12A; identical to SEQ ID NO: 6492

SEQ ID NO: 9570 - protein, 207 aa, Escherichia coli DEC12A; identical to SEQ ID NO: 5743

SEQ ID NO: 9571 - protein, 539 aa, Escherichia coli DEC12A; identical to SEQ ID NO: 6525

SEQ ID NO: 9572 - protein, 646 aa, Escherichia coli DEC12A
MRLATSRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 9573 - protein, 236 aa, Escherichia coli DEC12A; identical to SEQ ID NO: 7814

SEQ ID NO: 9574 - protein, 111 aa, Escherichia coli DEC12A; identical to SEQ ID NO: 8460

SEQ ID NO: 9575 - protein, 118 aa, Escherichia coli DEC12A [sequence omitted]

SEQ ID NO: 9576 - protein, 826 aa, Escherichia coli DEC12A; identical to SEQ ID NO: 8499

SEQ ID NO: 9577 - protein, 224 aa, Escherichia coli DEC12A; identical to SEQ ID NO: 6435

SEQ ID NO: 9578 - protein, 365 aa, Escherichia coli DEC12A; identical to SEQ ID NO: 7931

SEQ ID NO: 9579 - protein, 641 aa, Escherichia coli DEC12A
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGLETELKIPFNDEWKLSINYIYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 9580 - protein, 162 aa, Escherichia coli DEC12A; identical to SEQ ID NO: 6365

SEQ ID NO: 9581 - protein, 367 aa, Escherichia coli DEC12A; identical to SEQ ID NO: 5784

SEQ ID NO: 9582 - protein, 196 aa, Escherichia coli DEC12A
MPLIIEVKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRLLQCGNEIYSAIKDLQSKAPDKNIVIFTHNHCLTYIAKNKRDATFKPDYLDGLVMHVEKGKVYLDGEFVNH

SEQ ID NO: 9583 - protein, 274 aa, Escherichia coli DEC12A; identical to SEQ ID NO: 8357

SEQ ID NO: 9584 - protein, 250 aa, Escherichia coli DEC12A; identical to SEQ ID NO: 6317

SEQ ID NO: 9585 - protein, 880 aa, Escherichia coli DEC12A; identical to SEQ ID NO: 6482

SEQ ID NO: 9586 - protein, 518 aa, Escherichia coli DEC12A; identical to SEQ ID NO: 6358

SEQ ID NO: 9587 - protein, 432 aa, Escherichia coli DEC12A; identical to SEQ ID NO: 5727

SEQ ID NO: 9588 - protein, 359 aa, Escherichia coli DEC12A
MKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSNVDDITISKEPFLYGQVVDNTGQPIRWEGRASNFADYLLKNRLQSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 9589 - protein, 514 aa, Escherichia coli DEC12A; identical to SEQ ID NO: 9000

SEQ ID NO: 9590 - protein, 696 aa, Escherichia coli DEC12A
MQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASDSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 9591 - protein, 249 aa, Escherichia coli DEC12A; identical to SEQ ID NO: 6450

SEQ ID NO: 9592 - protein, 231 aa, Escherichia coli DEC12A; identical to SEQ ID NO: 6351

SEQ ID NO: 9593 - protein, 838 aa, Escherichia coli DEC12A; identical to SEQ ID NO: 9266

SEQ ID NO: 9594 - protein, 662 aa, Escherichia coli DEC12A; identical to SEQ ID NO: 8481

SEQ ID NO: 9595 - protein, 386 aa, Escherichia coli DEC12A; identical to SEQ ID NO: 7908

SEQ ID NO: 9596 - protein, 208 aa, Escherichia coli DEC12A; identical to SEQ ID NO: 5717

SEQ ID NO: 9597 - protein, 614 aa, Escherichia coli DEC12A; identical to SEQ ID NO: 7971

SEQ ID NO: 9598 - protein, 446 aa, Escherichia coli DEC12A; identical to SEQ ID NO: 8470

SEQ ID NO: 9599 - protein, 478 aa, Escherichia coli DEC12A; identical to SEQ ID NO: 8471

SEQ ID NO: 9600 - protein, 368 aa, Escherichia coli DEC12B; identical to SEQ ID NO: 8468

SEQ ID NO: 9601 - protein, 241 aa, Escherichia coli DEC12B; identical to SEQ ID NO: 6143

SEQ ID NO: 9602 - protein, 863 aa, Escherichia coli DEC12B; identical to SEQ ID NO: 8466

SEQ ID NO: 9603 - protein, 784 aa, Escherichia coli DEC12B; identical to SEQ ID NO: 6283

SEQ ID NO: 9604 - protein, 170 aa, Escherichia coli DEC12B [sequence omitted]

SEQ ID NO: 9605 - protein, 765 aa, Escherichia coli DEC12B; identical to SEQ ID NO: 9418

SEQ ID NO: 9606 - protein, 230 aa, Escherichia coli DEC12B; identical to SEQ ID NO: 7855

SEQ ID NO: 9607 - protein, 747 aa, Escherichia coli DEC12B; identical to SEQ ID NO: 6343

SEQ ID NO: 9608 - protein, 266 aa, Escherichia coli DEC12B; identical to SEQ ID NO: 5772

SEQ ID NO: 9609 - protein, 161 aa, Escherichia coli DEC12B; identical to SEQ ID NO: 5769

SEQ ID NO: 9610 - protein, 351 aa, Escherichia coli DEC12B; identical to SEQ ID NO: 5767

SEQ ID NO: 9611 - protein, 230 aa, Escherichia coli DEC12B; identical to SEQ ID NO: 6294

SEQ ID NO: 9612 - protein, 820 aa, Escherichia coli DEC12B; identical to SEQ ID NO: 9222

SEQ ID NO: 9613 - protein, 365 aa, Escherichia coli DEC12B; identical to SEQ ID NO: 7931

SEQ ID NO: 9614 - protein, 746 aa, Escherichia coli DEC12B; identical to SEQ ID NO: 8482

SEQ ID NO: 9615 - protein, 193 aa, Escherichia coli DEC12B; identical to SEQ ID NO: 6300

SEQ ID NO: 9616 - protein, 243 aa, Escherichia coli DEC12B; identical to SEQ ID NO: 6463

SEQ ID NO: 9617 - protein, 658 aa, Escherichia coli DEC12B; identical to SEQ ID NO: 9554

SEQ ID NO: 9618 - protein, 430 aa, Escherichia coli DEC12B; identical to SEQ ID NO: 5758

SEQ ID NO: 9619 - protein, 331 aa, Escherichia coli DEC12B; identical to SEQ ID NO: 6456

SEQ ID NO: 9620 - protein, 760 aa, Escherichia coli DEC12B; identical to SEQ ID NO: 6455

SEQ ID NO: 9621 - protein, 203 aa, Escherichia coli DEC12B; identical to SEQ ID NO: 6414

SEQ ID NO: 9622 - protein, 361 aa, Escherichia coli DEC12B; identical to SEQ ID NO: 7868

SEQ ID NO: 9623 - protein, 204 aa, Escherichia coli DEC12B; identical to SEQ ID NO: 9560

SEQ ID NO: 9624 - protein, 591 aa, Escherichia coli DEC12B; identical to SEQ ID NO: 9368

SEQ ID NO: 9625 - protein, 130 aa, Escherichia coli DEC12B; identical to SEQ ID NO: 8814

SEQ ID NO: 9626 - protein, 191 aa, Escherichia coli DEC12B; identical to SEQ ID NO: 5748

SEQ ID NO: 9627 - protein, 232 aa, Escherichia coli DEC12B; identical to SEQ ID NO: 5747

SEQ ID NO: 9628 - protein, 729 aa, Escherichia coli DEC12B; identical to SEQ ID NO: 5745

SEQ ID NO: 9629 - protein, 213 aa, Escherichia coli DEC12B; identical to SEQ ID NO: 5744

SEQ ID NO: 9630 - protein, 203 aa, Escherichia coli DEC12B; identical to SEQ ID NO: 6347

SEQ ID NO: 9631 - protein, 565 aa, Escherichia coli DEC12B; identical to SEQ ID NO: 6492

SEQ ID NO: 9632 - protein, 207 aa, Escherichia coli DEC12B; identical to SEQ ID NO: 5743

SEQ ID NO: 9633 - protein, 539 aa, Escherichia coli DEC12B; identical to SEQ ID NO: 6525

SEQ ID NO: 9634 - protein, 700 aa, Escherichia coli DEC12B; identical to SEQ ID NO: 9243

SEQ ID NO: 9635 - protein, 121 aa, Escherichia coli DEC12B
MNVKAIPAMEKDQKNENTLQLAIISRIKMFYRPTNLAMAPEEAPAMLRFRRSGSKLTLINPTPYFITVTNMKAGNSNLPNTMVPPKGEVSVDIPHAATGDISFQTINDYGALTPRIKATMQ

SEQ ID NO: 9636 - protein, 324 aa, Escherichia coli DEC12B
MKDGVDYISVIKQTEQKVPDVVFTYRPKYRSVSYLSAMLNSVVSSGAFSNHIQSVDYLSGGVSGITTTDSASTRMSIATDAEVLVYSGPAASVRQIEKILPRIDVPAEQVTVSGYVLGVQTTDRNATGLQIIADLFRNKLGMSVGARLDGGNSFTLNVGGLNAFYSLIKEDSRFNVVSNPRLTVLSGSKSQFTVGQEVPVLDSVSYQGSSGTPVQSVTYRNSGAIFTVTPVVLDGLITLDISQQLSDFVKTTTGVNSSPTLTKREISTKVDVKDGELLVLGGLASSKLTQSRTGFSFLPGFTGKSDENNRTDIIVVLQARRVGK

SEQ ID NO: 9637 - protein, 111 aa, Escherichia coli DEC12B; identical to SEQ ID NO: 8460

SEQ ID NO: 9638 - protein, 118 aa, Escherichia coli DEC12B [sequence omitted]

SEQ ID NO: 9639 - protein, 826 aa, Escherichia coli DEC12B; identical to SEQ ID NO: 8499

SEQ ID NO: 9640 - protein, 224 aa, Escherichia coli DEC12B; identical to SEQ ID NO: 6435

SEQ ID NO: 9641 - protein, 641 aa, Escherichia coli DEC12B
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGLETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 9642 - protein, 162 aa, Escherichia coli DEC12B; identical to SEQ ID NO: 6365

SEQ ID NO: 9643 - protein, 367 aa, Escherichia coli DEC12B; identical to SEQ ID NO: 5784

SEQ ID NO: 9644 - protein, 200 aa, Escherichia coli DEC12B; identical to SEQ ID NO: 6311

SEQ ID NO: 9645 - protein, 274 aa, Escherichia coli DEC12B; identical to SEQ ID NO: 8357

SEQ ID NO: 9646 - protein, 250 aa, Escherichia coli DEC12B; identical to SEQ ID NO: 6317

SEQ ID NO: 9647 - protein, 880 aa, Escherichia coli DEC12B; identical to SEQ ID NO: 6482

SEQ ID NO: 9648 - protein, 518 aa, Escherichia coli DEC12B; identical to SEQ ID NO: 6358

SEQ ID NO: 9649 - protein, 359 aa, Escherichia coli DEC12B; identical to SEQ ID NO: 6332

SEQ ID NO: 9650 - protein, 432 aa, Escherichia coli DEC12B; identical to SEQ ID NO: 5727

SEQ ID NO: 9651 - protein, 512 aa, Escherichia coli DEC12B; identical to SEQ ID NO: 6251

SEQ ID NO: 9652 - protein, 834 aa, Escherichia coli DEC12B
MYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEVAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASDSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 9653 - protein, 249 aa, Escherichia coli DEC12B; identical to SEQ ID NO: 6450

SEQ ID NO: 9654 - protein, 231 aa, Escherichia coli DEC12B; identical to SEQ ID NO: 6351

SEQ ID NO: 9655 - protein, 721 aa, Escherichia coli DEC12B; identical to SEQ ID NO: 9331

SEQ ID NO: 9656 - protein, 662 aa, Escherichia coli DEC12B; identical to SEQ ID NO: 8481

SEQ ID NO: 9657 - protein, 412 aa, Escherichia coli DEC12B; identical to SEQ ID NO: 6495

SEQ ID NO: 9658 - protein, 208 aa, Escherichia coli DEC12B; identical to SEQ ID NO: 5717

SEQ ID NO: 9659 - protein, 475 aa, Escherichia coli DEC12B
MNRSVSTNDQGYAANPFPTSSAAKPDAVLVKNEEKNASETGSIYSSMTLKDFSKFVKDEIGFSYNGYYRSGWGTASHGSPKSWAIGSLGRFGNEYSGWFDLQLKQRVYNENGKRVDAVVMMDGNVGQQYSTGWFGDNAGGENFMQFSDMYVTTKGFLPFAPEADFWVGKHGAPKIEIQMLDWKTQRTDAAAGVGLENWKVGPGKIDIALVREDVDDYDRSLQNKQQINTNAIDLRYKDIPLWDKATLMVSGRYVTANESASEKDNQDNNGYYDWKDTWMFGTSLTQKFDKGGFNEFSFLVANNSIASNFGRYAGASPFTTFNGRYYGDHTGGTAVRLTSQGEAYIGDHFIVANAIVYSFGNDIYSYETGAHSDFESIRAVVRPAYIWDQYNQTGVELGYFTQQNKDANSNKFNESGYKTTLFHTFKVNTSMLTSRPEIRFYATYIKALENELDGFTFEDNKDDQFAVGAQAEIWW

SEQ ID NO: 9660 - protein, 614 aa, Escherichia coli DEC12B; identical to SEQ ID NO: 7971

SEQ ID NO: 9661 - protein, 446 aa, Escherichia coli DEC12B; identical to SEQ ID NO: 8470

SEQ ID NO: 9662 - protein, 774 aa, Escherichia coli DEC12B; identical to SEQ ID NO: 8469

SEQ ID NO: 9663 - protein, 120 aa, Escherichia coli DEC12C
MNTVLSVQGASAPVEKKSFFSKFTRLNMLRLARAVIPAAVLMMFFPQLAMAAQGQDLMASGNTTVKATFGKDSSVVKWVVLAEVLVGAVMYMMTKNVKFLAGFAIISVFIAVGMAVVGLK

SEQ ID NO: 9664 - protein, 299 aa, Escherichia coli DEC12C
MASNGSLPSTGKGAVERNGNLFDNSVKISADPRLNAVVVKDREITMDIYRQLISELDIEQRQIEISVSIIDVDANDLQQLGVNWSGTLNAGQGSIAFNSSTAQANLSSSVISNANNFMIRVNALQQNSKAKILSQPSIITLNNMQAILDKNVTFYTKVSGEKVASLESITSGTLLRVTPRILDDNSNSLTGKRRERVRLLLDIQDGNQSTNQSNAQDASSILPEVQNSEMTTEATLSAGESLLLGGFIQDKESSSKDGIPLLSDIPVIGNLFSSTTKQKHSVVRLFLIKATPIKSASSE

SEQ ID NO: 9665 - protein, 446 aa, Escherichia coli DEC12C; identical to SEQ ID NO: 8470

SEQ ID NO: 9666 - protein, 765 aa, Escherichia coli DEC12C; identical to SEQ ID NO: 9418

SEQ ID NO: 9667 - protein, 230 aa, Escherichia coli DEC12C; identical to SEQ ID NO: 7855

SEQ ID NO: 9668 - protein, 784 aa, Escherichia coli DEC12C; identical to SEQ ID NO: 6283

SEQ ID NO: 9669 - protein, 170 aa, Escherichia coli DEC12C [sequence omitted]

SEQ ID NO: 9670 - protein, 747 aa, Escherichia coli DEC12C; identical to SEQ ID NO: 6343

SEQ ID NO: 9671 - protein, 266 aa, Escherichia coli DEC12C; identical to SEQ ID NO: 5772

SEQ ID NO: 9672 - protein, 161 aa, Escherichia coli DEC12C; identical to SEQ ID NO: 5769

SEQ ID NO: 9673 - protein, 774 aa, Escherichia coli DEC12C; identical to SEQ ID NO: 8469

SEQ ID NO: 9674 - protein, 351 aa, Escherichia coli DEC12C; identical to SEQ ID NO: 5767

SEQ ID NO: 9675 - protein, 230 aa, Escherichia coli DEC12C; identical to SEQ ID NO: 6294

SEQ ID NO: 9676 - protein, 570 aa, Escherichia coli DEC12C; identical to SEQ ID NO: 9550

SEQ ID NO: 9677 - protein, 365 aa, Escherichia coli DEC12C; identical to SEQ ID NO: 7931

SEQ ID NO: 9678 - protein, 746 aa, Escherichia coli DEC12C; identical to SEQ ID NO: 8482

SEQ ID NO: 9679 - protein, 193 aa, Escherichia coli DEC12C; identical to SEQ ID NO: 6300

SEQ ID NO: 9680 - protein, 243 aa, Escherichia coli DEC12C; identical to SEQ ID NO: 6463

SEQ ID NO: 9681 - protein, 658 aa, Escherichia coli DEC12C; identical to SEQ ID NO: 9554

SEQ ID NO: 9682 - protein, 430 aa, Escherichia coli DEC12C; identical to SEQ ID NO: 5758

SEQ ID NO: 9683 - protein, 331 aa, Escherichia coli DEC12C; identical to SEQ ID NO: 6456

SEQ ID NO: 9684 - protein, 760 aa, Escherichia coli DEC12C; identical to SEQ ID NO: 6455

SEQ ID NO: 9685 - protein, 203 aa, Escherichia coli DEC12C; identical to SEQ ID NO: 6414

SEQ ID NO: 9686 - protein, 361 aa, Escherichia coli DEC12C; identical to SEQ ID NO: 7868

SEQ ID NO: 9687 - protein, 204 aa, Escherichia coli DEC12C; identical to SEQ ID NO: 9560

SEQ ID NO: 9688 - protein, 591 aa, Escherichia coli DEC12C; identical to SEQ ID NO: 9368

SEQ ID NO: 9689 - protein, 128 aa, Escherichia coli DEC12C; identical to SEQ ID NO: 7871

SEQ ID NO: 9690 - protein, 191 aa, Escherichia coli DEC12C; identical to SEQ ID NO: 5748

SEQ ID NO: 9691 - protein, 232 aa, Escherichia coli DEC12C; identical to SEQ ID NO: 5747

SEQ ID NO: 9692 - protein, 729 aa, Escherichia coli DEC12C; identical to SEQ ID NO: 5745

SEQ ID NO: 9693 - protein, 213 aa, Escherichia coli DEC12C; identical to SEQ ID NO: 5744

SEQ ID NO: 9694 - protein, 203 aa, Escherichia coli DEC12C; identical to SEQ ID NO: 6347

SEQ ID NO: 9695 - protein, 207 aa, Escherichia coli DEC12C; identical to SEQ ID NO: 5743

SEQ ID NO: 9696 - protein, 539 aa, Escherichia coli DEC12C; identical to SEQ ID NO: 6525

SEQ ID NO: 9697 - protein, 646 aa, Escherichia coli DEC12C; identical to SEQ ID NO: 9572

SEQ ID NO: 9698 - protein, 236 aa, Escherichia coli DEC12C; identical to SEQ ID NO: 7814

SEQ ID NO: 9699 - protein, 111 aa, Escherichia coli DEC12C; identical to SEQ ID NO: 8460

SEQ ID NO: 9700 - protein, 130 aa, Escherichia coli DEC12C; identical to SEQ ID NO: 7726

SEQ ID NO: 9701 - protein, 826 aa, Escherichia coli DEC12C; identical to SEQ ID NO: 8499

SEQ ID NO: 9702 - protein, 154 aa, Escherichia coli DEC12C
MLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKSNNANNWYLTIIDDHGNYISDKI

SEQ ID NO: 9703 - protein, 341 aa, Escherichia coli DEC12C
MPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGLETELKIPFNDEWKLSINYIYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 9704 - protein, 162 aa, Escherichia coli DEC12C; identical to SEQ ID NO: 6365

SEQ ID NO: 9705 - protein, 367 aa, Escherichia coli DEC12C; identical to SEQ ID NO: 5784

SEQ ID NO: 9706 - protein, 200 aa, Escherichia coli DEC12C; identical to SEQ ID NO: 6311

SEQ ID NO: 9707 - protein, 274 aa, Escherichia coli DEC12C; identical to SEQ ID NO: 8357

SEQ ID NO: 9708 - protein, 250 aa, Escherichia coli DEC12C; identical to SEQ ID NO: 6317

SEQ ID NO: 9709 - protein, 597 aa, Escherichia coli DEC12C
MLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 9710 - protein, 518 aa, Escherichia coli DEC12C; identical to SEQ ID NO: 6358

SEQ ID NO: 9711 - protein, 432 aa, Escherichia coli DEC12C; identical to SEQ ID NO: 5727

SEQ ID NO: 9712 - protein, 359 aa, Escherichia coli DEC12C; identical to SEQ ID NO: 6332

SEQ ID NO: 9713 - protein, 834 aa, Escherichia coli DEC12C
MYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEVAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASDSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGGIRLADGSHPPLGISVKDKTSHKELGLVADGGFVYLNGIQDDSKLTLRWGDKSCFIQPPNSSNLTTGTVILPCISQN

SEQ ID NO: 9714 - protein, 249 aa, Escherichia coli DEC12C; identical to SEQ ID NO: 6450

SEQ ID NO: 9715 - protein, 231 aa, Escherichia coli DEC12C; identical to SEQ ID NO: 6351

SEQ ID NO: 9716 - protein, 721 aa, Escherichia coli DEC12C; identical to SEQ ID NO: 9331
